United States Patent 11,931,406 (FLAVIVIRUS VACCINE) - sequence listing, part 76

SEQ ID NO: 26075 - RNA, 9873 nt, Artificial Sequence
  derived and/or modified CDS sequence (opt11) from DENV-3__GQ252678__SS-prME
accagccugugcuugaugaugauacugcccgccgcccuugcguuccaccucaccagccgggauggggaaccccguaugauuguggguaaaaaugagcggggcaaaagccugcuguucaagacggcgucuggcaucaacaugugcacgcucauugccauggaccugggugaaaugugcgacgacaccgugaccuauaaaugcccccacaucacggagguagagcccgaggauauagauugcuggugcaaccuuaccagcaccugggugacuuacgggacgugcaaucaggccggcgagcaucggcgcgacaagcggagcguggcccucgcgccucacgugggcauggggcuggauacucgcacucagaccuggaugagcgccgagggcgcguggcgucaaguggagaagguggagacgugggccuuacgacacccgggguucacuauccucgcacucuuccuagcgcacuacaucggcaccucccucacgcaaaagguggugauauucauccuucugaugcucgucacgcccagcaugaccaugcggugcguuggcgugggcaaccgcgacuucgucgaaggccugagcggggcuaccuggguggaugugguccuggagcacggcggguguguuacaacgauggcuaagaacaaaccaaccuuggacauagagcugcagaaaaccgaggccacgcagcuggcaacgcuccggaagcuauguaucgagggcaaaaucacaaacauuaccaccgauagucgcugccccacccaaggcgaggccguguuaccggaggagcaagaccagaauuacguaugcaagcacaccuacgucgaucggggguggggcaaugggugcgggcuguuugggaagggcucacuggugaccugcgccaaguuccagugucuggagcccaucgaggguaaggucgugcaguacgagaaccuuaaauacaccgucaucauaacgguacacaccggggaccagcaccaggugggcaacgaaacgcagggugucacagccgagaucaccccacaagccagcaccaccgaggcaauccugccagaguauggcacuuuagggcucgaaugcucuccgcguaccgguuuggacuucaaugagaugaucuugcuuacaaugaaaaacaaggcuuggaugguucaccgccagugguucuucgacuuaccccugccguggaccucaggggccaccaccgaaacgcccaccuggaaucgcaaggagcucuuggugacuuucaagaacgcgcacgccaagaagcaggaggucguggugcuggguagccaggagggggcgaugcauacggcccuaacgggggcgaccgaaauucagaacagcggcgguaccuccauauucgccgggcaucugaagugccgucuuaagauggacaagcucgaacugaaggggauguccuacgcaaugugcaccaauaccuucguccuuaagaaagaaguauccgagacccagcaugggaccauccucaucaagguugaguacaaaggcgaggacgucccgugcaagauccccuucagcacggaggaugggcaggguaaggcucauaacggccgccugaucacggccaaccccgucgugacgaaaaaggaggagcccguuaacauugaagccgaaccacccuucggggagucaaacaucgucaucggcauuggggacaacgcccugaagaucaauugguacaagaagggcuccagcauagggaagauguucgaagcgaccgcccggggcgcccgccggauggccauccugggcgacaccgccugggacuucggguccgugggcggggugcucaacagcuuaggcaagaugguacaccagauauucggguccgcauacacggccuuguucuccggcguaaguugggugaugaagauuggcaucgguguacucuuaacguggaucggccuaaacucgaagaauaccucaaugagcuucuccugcaucgccaucgguaucaucacacucuaccuaggcgcggugguccaagccgacaugggaugcgugaucaacuggaaaggcaaagaacugaaguguggauccggcauauucgugacgaacgaaguccacacuuggaccgagcaguacaaauuccaggcagacucuccuaaacgccucgcgaccgccaucgccggagccugggaaaaugggguuugcggcauccgcagcacgacccgaauggaaaacuugcuuuggaagcagaucgcgaaugagcucaacuacauccugugggaaaacaacaucaaacugacaguagucgugggggacauaaucgggguucucgagcagggcaagcgcacccucacgccccaaccaauggagcugaaguacaguuggaagacuugggggaaggcgaaaauugucacagccgaaacucaaaacaguuccuuuaucaucgacggccccaacacgcccgaaugucccagcgcaaguagggcguggaacgugugggagguggaggacuauggauuuggcguauuuaccaccaacauuuggcucaagcugagagagguguacacgcagcugugugaccacagacucaugucugccgccgucaaggacgagcgcgccgugcacgccgacaugggcuauuggauugagucccaaaagaacgggucguggaaacucgaaaaggcgagccuaaucgaggugaagaccuguacguggccgaagucccacacccucuggagcaacggcguccuggaauccgauaugauuauccccaagagucuggcagggccuaucucccagcauaacuaccgcccaggcuaucacacgcagaccgccgggcccuggcaccucggcaaauuggaguuggacuucaacuacugcgaaggcacgaccguugugauaaccgagaauugcgggacccgcggacccucacuccggacgaccaccguguccgggaagcugauccaugaguggugcugccgcaguugcacccugcccccguuacgguacaugggagaggacggaugcugguacgggauggagauccgcccuauuagcgaaaaggaggagaacauggucaagaguuugguauccgccggcucuggggaaguagauaauuuuacgaugggcguacugugucucgccauucuuuucgaagaagugaugcggggcaaguucggcaagaagcauaugaucgcggggguguucuucaccuucguccuucuucuguccgggcaaaucaccuggcgugacauggcccacacacuaaucaugaucggcagcaacgccuccgacaggaugggcaugggagucacguaccucgcccugauugccacguuuaagauucagcccuuuuuagcgcuaggguucuucuuacgcaagcugaccucccgggagaaucuccuguugggagugggccucgccauggccacaacgcuccaacugccugaggacaucgagcagauggccaacggaaucgcgcuuggucucauggcucugaagcucaucacccaguucgagacuuaccagcuauggaccgcacugaucucgcucacgugcucuaauaccaucuuuacguuaaccguugcguggcgcacugcaacccugauccucgcuggggugucucuccucccgguaugucagagcucauccaugcggaagaccgacuggcuccccaugaccguugcugccaugggcgugccgccccucccgcuauucaucuucagccugaaggauacgcugaagcgccguuccuggccacugaacgaagggguaauggccgucggucucgucagcauccuggccaguucucucuugcggaacgacguccccauggccgguccccugguagccgggggccugcucaucgccugcuacgugaucacugggacauccgccgaccugacuguugagaaggccgcagacgugacaugggaagaggaagcugagcagacaggcgugagccacaaccugaugauaaccgucgacgacgacgggaccaugcgcaucaaagaugacgaaaccgaaaacauccucacgguucuccugaagaccgcccuccuaauaguguccggaaucuucccguacagcauucccgccacgcuacucgucuggcacaccuggcagaagcaaacgcagagaucaggcgugcugugggacgugcccagcccuccggaaacccagaaagcggagcucgaggaaggggucuaccgcaucaaacagcaggguaucuuugggaagacccagguuggcguuggaguucagaaggaaggaguguuccacaccauguggcacgugacucgcggcgcgguccucacccacaacgguaagcgcuuggagcccaacugggcuuccgugaaaaaggaccugauuucguauggcggaggguggcggcucagugcccaauggcagaagggggaggaggugcagguuaucgccguggagcccggcaaaaaucccaagaacuuccagacuaugcccggcaccuuccagacgacuaccggggagaucggggcgaucgcccuggacuucaaaccugggaccucggggucgcccaucauaaacagagagggaaaagugguggggcuuuacgggaacggaguggugacgaaaaacggaggguacgucucgggcaucgcccagaccaaugccgagccggacggcccuacacccgagcuggaggaggagauguucaagaagcggaaccuaaccaucauggaucugcaucccgggucggggaagacgcgcaaauaccucccggccaucgugcgggaggccaucaaacgacgccuucgcacccugauccucgcccccacccggguggucgccgccgagauggaagaggcccucaaggggcugccgauccgcuaccagacaacggcgaccaaaagugagcauaccggccgagagaucguggaccuaaugugccacgccacauucacgaugcgucuccugagcccaguccgggucccgaauuacaaccugaucauaauggacgaggcccauuucaccgaccccgccuccauugcagcgcgcggguacaucucgacccguguggguaugggcgaggcagccgccauuuucaugaccgcaacgccgcccgguaccgcugaugccuuuccgcagucgaacgcuccaauucaggacgaggaacgcgacauuccugagagaagcuggaacuccgggaacgaguggaucaccgacuucgccgggaaaaccgugugguucguccccagcaucaaagcgggcaacgauauugcaaauugccuucggaaaaacgggaagaaggugauacagcuaucccgcaagaccuuugacaccgaguaccagaagaccaaguuaaaugacugggauuucguggucacaacagauauuagcgagaugggcgccaacuucaaggcugaccgggugaucgacccgagacggugcuuaaagccggugauccucacggacggcccggagcgagucauccuggcugggcccaugccggugaccgccgccucagcagcacaacgucgcggucgggugggccggaacccccaaaaggagaacgaccaauacaucuucaccggacagccucuaaacaacgaugaggaccacgcucauuggaccgaggcaaagaugcugcuggacaacaucaauacgcccgaagguauaauaccagcacucuucgagccugagcgugagaaguccgccgcuauugacggcgaguaccgccugaagggcgaaucaaggaagaccuucgucgagcuaaugcgccgcggggaccuccccgucuggcuugcgcauaaggucgccagcgagggcaucaaguacaccgaccggaagugguguuucgacgggcagcgaaacaaccagauucuggaggagaacauggacguggagaucuggaccaaggaaggagagaagaagaagcuccgcccgcgguggcuggacgcaaggacguacuccgacccguuagcccucaaggaguucaaagauuucgcggcugggcgaaaaagcaucgcccuggaccuggugaccgagaucggccggguacccacccaccucgcacaucgcacuaggaacgcccucgacaaccuggugaugcugcacacguccgagcacggagggaaagccuaccgccacgcgguggaagaacuaccagaaaccauggagacacuacuccugcugggccucaugauccuccugacgggcggagcaaugcuguuccugauaucaggcaagggaauaggcaaaacaagcaucggacugaucugcgucauagcauccagcggcaugcucuggauggccgagauuccgcugcaauggaucgccuccgcuaucgugcuagaguucuucaugauggugcuucugauuccggagcccgagaagcagcggacgccccaggacaaccagcuggccuacgucgugaucgggaucuuaacccuggccgccaucaucgcugcgaaugagaugggccugcuggaaaccacgaagcgcgaccugggcaugagcaaggagccgggggugguuuccccaacgagcuaccuggacguggaucuacacccagccuccgccuggacccuguacgccgucgcgaccacggucauuacuccgaugcugcggcacacaaucgagaacagcacagcaaacguguccuuggcggcgaucgccaaccaggcgguggucuugaugggccuggacaagggguggccgaucagcaagauggaucucggugugccccuacuggcgcucgggugcuacucccaggugaacccccugaccuugaccgcagccguacuccugcuaauaacccacuacgccaucaucggccccggccuccaggcgaaggccacacgcgaggcgcagaagcggacggccgccgggauuaugaagaacccuacagucgacgguauaaugacgauugaucuggaccccguaaucuacgacucaaaauucgagaaacagcuugggcaggucauguugcuuguccugugcgcggugcagcuucugcuuaugcgcacguccugggcccucugcgaggcucugacguuagccaccggccccauuacgacacugugggagggcagccccgguaaguuuuggaacacgaccaucgcugucucaauggccaacaucuuccggggauccuaccuggccggagccggcuuggccuucucaauuaugaaguccguggggaccggaaagcgagguacugggucucagggcgagaccuugggggaaaaguggaagaagaagcuaaaccaguugagccggaaggaguucgaccucuauaagaagucgggcaucacggagguggacagaaccgaggcgaaggaggggcugaagcggggcgaaaucacccaccacgcggucucaagaggcagcgccaaacugcagugguuugucgagaggaacauggugauuccggaggggcgagucauagaccucggcugcgggcggggcgguugguccuacuacugcgccggccugaagaagguuacggaggugcgcggcuacacgaagggcggucccgggcacgaggagcccgugccgaugucgaccuacggcuggaacaucgugaagcugauguccggcaaagacguguucuaccucccucccgagaagugcgacaccuuacugugcgauaucggcgaaagcuccccuagccccaccgucgaggagucccggacaaucagagugcugaagaugguggagccguggcucaagaacaaccaguucugcauaaagguccugaaccccuacaugccgaccgugaucgagcacuuggaacgccugcagcggaagcacggggguaugcucgugcgcaauccccuuagccggaacaguacccacgagauguauuggaucucgaacgguaccggcaauaucguugccuccgugaacauggugagccgccuccugcucaaucguuucacgaugacccaccgacggccgacaauagagaaggacguugaccucggagcgggcacccgccacgugaacgcggagccagagacgcccaacauggaugucaucggggaacggaucaagcgcaucaaggaggaacacaacuccacguggcacuaugaugacgagaacccguauaagaccugggcuuaccacggcagcuacgaggucaaggccaccgggucggccagcuccaugauaaacggcguggucaagcugcugacgaaacccugggacguggugcccauggucacccaaauggcgaugacugacaccacucccuucgggcaacagaggguauucaaagagaagguggacacucgcacgccacggagcaugcccggcacacgcagggucaugggcaucacggccgagugguuguggcguacccuggggcguaacaagaaaccacgcuuaugcacucgcgaagaguucaccaagaaggugcgcacgaacgccgcuaugggcgcgguuuuuaccgaagagaaccagugggacuccgcaaaggccgcagucgaggaugaggacuuuuggaaacuuguggaccgcgaacgugagcugcacaaacuuggcaaaugcggcucuugcguguacaacaugauggggaagcgugagaagaagcucggcgaguuuggcaaggccaaggggagcagggcgaucugguacauguggcugggcgcgcgguaccuggaguucgaggcgcucggauuccugaacgaggaccacugguucucucgagagaauagcuauuccggcguagagggagagggacugcacaaacucgguuauauccugcgggacauuagcaagauccccgggggcgccauguacgccgaugacaccgcggggugggauacacgaauaacggaggacgaccugcacaaugaggagaaaauuacccagcaaauggauccagagcaccgccaacucgccaacgcuaucuuuaaauuaaccuaccagaacaaaguggugaagguacagcgacccacgcccaccggaacagucauggauaucaucucucgcaaggaccagcgggggucgggacagguggguaccuacgggcugaauacuuucaccaauauggaggcgcagcucauaagacagauggagggcgaggguguccuguccaaggcggaucuugagaauccccaucugccggagaagaagaucacucaguggcuggagacuaagggcguggagagauuaaagcgcauggcgaucagcggggacgacugcguggucaagcccaucgacgaccgcuucgcuaacgcucuccuggcccugaacgacauggggaaggugcgcaaggacaucccucaguggcagcccuccaaaggguggcacgacuggcagcaggucccguucugcagccaccacuuccacgagcucaucaugaaggacgggcgcaagcucgucgugcccugccgcccccaagacgaguugaucggccgagcccgcaucucccagggugcuggcugguccuugcgcgagacugcgugccugggcaaggcguacgcccagauguggucguugauguacuuccaccggcgcgaccuccggcuggcguccaacgccaucuguuccgcggugccgguccacugggugccuacuucgcgcacgacuugguccauccacgcacaccaccaguggaugacgacggaagacaugcugacgguguggaaccgugucuggaucgaggauaaccccuggauggaagacaagacccccgugaccaccugggagaacgugccauaccucggcaagcgggaggaccagugguguggcagccugauugggcuaacgucgagagccaccugggcgcagaacaucagcacagcaauccagcagguccguagccucaucggcaacgaggaguuucuggauuacaugccguccaugaaacgguuccgcaaagaggaggagagcgagggggccaucugguga

SEQ ID NO: 26076 - RNA, 9873 nt, Artificial Sequence
  derived and/or modified CDS sequence (opt11) from DENV-3__FJ850098__SS-prME
accucacucugccucaugaugauccugccagcagcccuggcguuccaccucaccagccgggacggggagccccggaugaucguggggaagaaugagcgcggcaagagccuguuguucaagacggcaucggggaucaacaugugcacccucaucgccauggaucugggggagaugugcgacgacaccgugaccuacaagugcccccacaucacggagguggagcccgaagacaucgacugcuggugcaaccucacaucaaccugggugaccuaugggacaugcaaccaggccggagagcaccggcgcgacaagcggucaguagcgcucgcgccccacgucggcaugggguuggacacacgcacccagaccuggaugagcgccgagggcgcauggcggcaggucgagaagguggagacgugggccuuacgccaccccggguucacgaucuuggccuuauuccuggcccacuacaucggcacuucccuaacccaaaagguugugauauucauacuguuaaugcuagucacgcccagcaugaccaugcgaugcgugggggugggcaaccgcgacuucgucgagggccugaguggggcuaccugggucgacgugguacucgagcauggcgggugcgugaccacgauggccaagaauaagcccacccucgacaucgaguugcagaagaccgaagccacccagcuggcgacgcuccggaaguugugcaucgagggcaagaucacgaacaucaccaccgacagccgcugccccacgcaaggcgaagcugugcugcccgaggagcaggaccagaauuacgugugcaagcacaccuacguggaccggggguggggcaacgggugcggcuuguucgguaaaggaucucuggugaccugcgccaaguuucagugccuggagcccaucgagggcaaggucguucaauacgagaaccucaaguacacugucaucaucacgguccauaccggggaccagcaccaggugggcaacgagacccagggggucaccgccgagaucacgccccaggcuucuaccacugaagcgauccugcccgaguacggcacccuggggcucgaauguuccccacgcaccggccuggacuucaaugaaaugauacugcucacuaugaagaacaaggccuggauggugcaccggcaaugguucuuugaccuuccccugcccuggaccagcggcgccaccaccgagacgccuaccuggaaccgcaaggagcuccuggugaccuucaagaacgcccacgccaaaaaacaagaggucguggugcuggggucucaggaaggcgcgaugcauaccgcccuaacgggggcaacugaaauccaaaacagcggggggaccuccaucuucgcgggucaccugaagugccggcugaaaauggauaagcucgagcugaagggcaugagcuacgccaugugcacaaacacguuuguccugaagaaggaaguguccgagacccaacacgggaccauccucaucaagguggaauacaagggcgaggaugucccgugcaagauccccuucagcacagaagacggacagggcaaggcacauaacggccgccugaucacggccaaccccgucgugaccaagaaggaggaccccgucaacaucgaggccgagccgccauuuggggaaagcaacaucgugaucggcaucggcgacaacgcccugaaaaucaacugguacaaaaagggcuccagcaucgggaagauguucgaggcgaccgcccggggcgcccgccggauggcaauccugggcgacaccgccugggacuucggguccgugggagggguccucaacucucugggcaagauggugcaucagaucuuuggguccgcuuacaccgcccucuuuagcggaguguccugggugaugaaaauuggcaucgggguucuccuuacauggaucggccugaacagcaagaacaccuccaugagcuucuccugcaucgcaauagggaucaucacccucuaccuuggcgcggugguccaagcggacauggggugcguuaucaacuggaaggguaaggaacugaagugcgguagcgggaucuucgugacgaacgagguccacaccuggaccgagcaauacaaguuccaggcggacucccccaagcgccucgccaccgccaucgcgggggccugggagaacggggugugcggcauacggagcacgacccggauggagaaccugcuguggaagcaaaucgcgaaugagcugaacuacaucuugugggagaauaacaucaagcugaccguggucgugggggacgugauaggcguacucgagcaggggaagcgcacccugacacuucagccuauggagcucaaauacagcuggaagacgugggguaaggccaagauagugacggccgagacccagaacagcuccuucaucaucgaugggccgaacacgcccgaguguccaagcgccucccgggcguggaacgugugggaagucgaggacuacggguucggcguuuuuacaaccaacaucuggcugaagcugcgcgagguguacacccagcucugcgaccaccgguugaugagcgccgccgucaaggacgagcgggccguccacgcugacaugggguacuggaucgaaucgcagaagaacggguccuggaaguuagaaaaagcaagccuaaucgaggugaagaccugcacguggcccaagagccacacccuguggagcaacggcguccuggaauccgacaugaucauccccaagagccucgcuggucccauaucccagcacaacuaccgccccggcuaccacacgcagacggcugggccguggcaccugggcaagcuggaauuagacuucaacuacugcgaggguacgaccgucgugaucaccgagaacugcgggacucgcggccccagccuucggacgaccaccgucuccgggaagcugauccacgaguggugcugcagaagcugcacccuuccgccccucagguacaugggugaggacggcugcugguacggcauggagauccgcccgaucuccgagaaggaggagaauauggucaagagccuugucagcgcgggcagcggagaggucgacaauuucacgaugggcguguugugccuggcaauucuguuugaagaagucaugagagggaaauucgggaagaagcacaugaucgcgggggucuucuucaccuucguacuccugcuguccggccagaucaccuggcgcgacauggcccauacccucaucaugaucggcagcaacgccuccgacagaaugggaaugggcgugacguaucuggcccugaucgcuaccuuuaagauccagccuuuccuugcgcugggauucuuccugcgaaagcucacgagccgggagaaccugcugcuggggguaggccuggccauggccacgacguuacaguugcccgaagacaucgagcagauggcaaacgggauugcgcuggggcugauggcccuuaaacugauaacccaguuugaaacguaccagcuguggaccgcgcucauuucccugacgugcuccaacaccaucuucacccugaccguggccuggcgaacggcgacccucauccuggcggggguuagccuguugcccgugugucaguccaguuccaugcggaagaccgacuggcuaccgaugaccguggcggccaugggcgugccgccccugccucucuucaucuucagccugaaggacacgcugaagcgccgcucuuggccacucaacgagggggugauggccgugggguuagucagcauccuggccucuagccuccugcggaaugaugugcccauggcuggaccccugguggccgggggcuuacugaucgccugcuacguuaucaccgggaccuccgccgaucugaccguggagaaggccgcggacguaacgugggaggaggaggccgagcagaccggcgugucacauaaccucaugaucaccguggaugacgacgggaccaugcgcaucaaggacgacgagaccgaaaacauccugacggugcugcucaaaaccgcccugcugaucguuuccgggauuuuccccuacagcauccccgccacucuccuggucuggcacaccuggcaaaagcaaacgcagcgguccggcgugcuaugggauguucccuccccgcccgagacccagaaggcagaacucgaagagggaguguaccgcaucaagcagcagggcaucuucgggaagacccaggugggcguuggggugcagaaggagggcguguuccauaccauguggcacguaaccaggggcgcggugcugaccuacaaugggaagcgccuggagccgaacugggcuuccguaaagaaggaucuaaucaguuacggugggggguggcggcugucugcacaauggcagaaaggggaggaaguucaagugaucgccguggagcccggcaagaaccccaagaauuuccagaccaugccagggacauuccagacaaccaccggggagaucggcgcgaucgcccuggacuucaagccggggaccagcgggagcccaaucauuaaccgcgaaggcaaggucguggggcuguacggcaacggggucgucacgaagaacggcggguacguguccggcauagcccagacuaacgcugagcccgacggcccgaccccugagcucgaggaggaaauguucaagaagcggaaccugaccaucauggaccugcaccccgggagcggcaagacacgcaaguaccuccccgccaucgugcgggaggcgaucaagagacggcugcgcacuuugauccucgccccgacccgcgucguggccgccgagauggaggaggccuuaaaaggccucccgauccgcuaucagacuacagcaaccaaguccgagcacaccggccgggaaaucguggaccucaugugccacgccaccuucacgaugcgccugcuuucucccguacggguccccaacuacaaucucaucaucauggacgaggcccacuucacugacccggccuccaucgccgcgcgcggguacaucagcacccggguaggcaugggugaggccgcggccauuuucaugaccgcgacgccacccgggaccgcugacgccuucccccaauccaacgcgccaauccaggacgaggaacgcgacauacccgagcgcagcuggaacuccgguaacgaguggauuaccgacuucgccgggaagaccgucugguucguuccuucaaucaaggcgggcaacgacaucgccaacugcuugcggaaaaacgggaagaaggugauccagcugagucgcaagacauucgacaccgaguaccagaaaacgaaacucaacgacugggacuucgucgugaccacggacaucagcgagaugggagccaauuucaaggccgaccgggugaucgacccacgccggugucuaaagcccgucauauugacagacggccccgaacgcgugauauuggcggggccuaugcccguuaccgcggccagugcugcccagcggcgugggcgggucgggagaaacccgcagaaggaaaacgaccaguacaucuucaccggccaaccccugaacaacgacgaagaccacgcccauuggacagaggcgaagaugcugcucgacaacaucaacacgcccgaagggaucauccccgcuuuguucgagccggaacgagaaaaauccgccgccaucgacggcgaguaccgccugaagggcgagucccggaagacauucguagagcuaaugaggcggggggaccugcccgucuggcuggcacacaagguggccagcgagggcauaaaguauacggaccgcaaguggugcuucgacgggcagcggaauaaccagauccucgaggagaacauggacguggagaucuggaccaaggagggcgagaagaaaaagcugcgcccccgguggcuugacgcccgcacguacuccgacccccucgccuugaaggaguucaaggacuucgcagcgggccgcaagagcaucgcccuggaccucguuaccgagaucgggcgggugccgucccaucuugcccauaggacccggaaugcccuggacaaccucgugaugcuacauacaagcgagcacggggggaaggccuaccgccacgcgguggaggaguugccagagacgauggaaacccuccuacugcucggccugaugauccuguuaaccgggggcgcaaugcucuuccugaucucaggcaagggaaucggcaaaaccuccauagggcucaucugcgugaucgccagcuccgguaugcuguggauggccgagaucccgcugcaguggauugccagcgcgaucgugcucgaguucuucaugaugguccugcugauuccggaacccgagaagcagcggacuccccaggauaaccagcucgccuauguugugaucgggauccugacacuggccgccaucaucgccgcgaacgagaugggccucuuagagaccaccaagcgugaccugggcauguccaaggagcccggcgucgugagcccgacguccuaccuugacguugaccugcaccccgccucagccuggaccuuauacgccguggcgaccaccgugaucacgcccaugcuacggcacacgauagaaaacuccaccgccaacgucagucuugcggccaucgccaaccaagcugucguucugaugggacuagauaagggguggcccaucuccaagauggaccugggcgugccgcugcucgcucuggggugcuacagucaggucaacccccugaccuuaacggccgcgguccuccugcucaucacccacuaugccaucaucggcccgggccugcaggcgaaggccacccgagaggcacagaagcggaccgcggccgggauaaugaagaaccccaccguugacggcaucaugaccaucgaccuggacccggucauuuacgacuccaaguucgagaagcagcugggucaggugauguugcugguccucugugcgguccagcugcugcucaugcgcacgagcugggcucugugcgaggcccugacgcucgcuacgggccccaucacuacccugugggagggcucccccgggaaauucuggaacaccacuauugcggugagcauggcaaacaucuuucggggguccuacuuggcaggugcgggcuuagccuuuagcaucaugaagucgguggggaccggcaaacgcggcaccgggagccagggcgagacucugggagaaaaauggaagaagaagcuaaaccagcucucccggaaggaguucgaucuguauaagaaguccggcaucacugaagucgaccgcacggaggcaaaggaaggacugaagcggggcgagauuacccaccacgccgugucccgcggcuccgccaagcuccagugguuuguggagagaaacaugguuaucccugaagggcgugugaucgaccuaggcugcgggcgggggggcuggagcuacuauugugcgggacugaagaagguuacagaaguccgcggcuacaccaagggcgggccggggcacgaagagccaguacccauguccacauacggcuggaauauugugaagcucaugagcgggaaggacgucuucuaucugccccccgagaagugcgacacacugcugugcgauaucggcgaguccagccccuccccuaccguggaggagagccggaccaucaggguccucaagaugguagagcccuggcugaaaaacaaccaguucugcaucaagguguuaaacccguacaugcccacgguggucgagcaccucgaacgccugcagaggaagcacggcgggaugcuggugcgcaacccccucucccggaacucaacccaugagauguauuggaucaguaacggcaccgggaacaucguggccagcgucaacaugguaucccggcuucugcucaaccgguucaccaugacccaccgccggcccaccaucgagaaggauguggaccugggcgcgggcacccgccacgucaacgccgagcccgagacucccaacauggacgugaucggcgagcggaucaaaagaaucaaggaggagcacaacagcacguggcacuacgacgacgagaaucccuacaagaccugggcguaccacggguccuacgaggucaaggccacugggagcgccaguucuaugaucaacggcguggugaagcugcucaccaagccgugggacgucgugcccauggucacgcagauggcgaugaccgacaccaccccguucgggcagcagcgggucuuuaaggagaagguggacacucgcacgccccggagcaugccgggcacccgccgagugaugggcauaaccgcugaauggcuguggaggacccuaggacggaacaaaaagccccgccucuguacccgggaggaauucaccaagaagguccgcaccaacgccgccaugggagcgguguucacggaggaaaaccagugggacuccgccaaagccgcaguggaggacgaagacuucuggaagcuggucgaccgcgagcgggagcuacauaagcugggcaagugcggcagcugcguguacaauaugaugggaaagcgcgagaagaaauuaggugaguucggcaaggccaaggggagucgggcgaucugguacauguggcugggcgcccgauacuuagaauucgaagcccugggguuccugaacgaggaccacugguucagccgggagaacuccuacagcggcguggagggggagggccugcacaagcugggauacauccuucgcgauaucuccaaaauccccggcggagccauguacgccgacgauaccgcggggugggacacacggaucacugaggaugacuuacacaacgaagagaagaucacgcagcagauggaccccgaacaccgccagcuggccaacgccaucuucaaacugaccuaucagaauaaggucgugaaggugcagcgcccgacacccaccgguaccgucauggacauuaucucccgcaaggaccaacgaggcuccggccaggugggcacguacgggcuuaauaccuuuacaaacauggaggcccagcugauccgccagauggagggcgagggggugcugagcaaggccgaccucgaaaacccccgccugcccgagaagaagauaacacagugguuggagacgaagggagucgagcgccucaagcggauggcgaucuccggggacgacuguguggugaagccgaucgacgaccgcuucgccaaugcccugcuggcccucaacgacauggggaagguucggaaggacaucccccaguggcagcccucgaaggguuggcacgacuggcaacagguccccuuuugcucccaccacuuccacgaacugaucaugaaggacgggcggaaacugguggucccgugccggccccaggaugagcucaucggccgcgcccggaucagccagggggcgggcuggucacugcgcgagaccgcgugucugggcaaggccuaugcccagauguggagccucauguauuuccaccgccgggaccugcgccucgcguccaacgccaucugcagcgccgugccuguucacugggugcccaccucccggaccacguggagcauccacgcucaccaccaauggaugaccacagaggacaugcucacuguguggaaccgcguauggaucgaggacaacccuuggauggaggacaagacgcccgucaccaccugggagaacgugcccuaccuggggaagcgggaagaucaguggugcgguucucugaucgggcuaacuucccgcgccacgugggcgcagaacauucccaccgccauccagcaggucagaagccugaucggcaacgaagaguuccuggacuacaugccguccaugaagcgguuucguaaggaagaggagagcgagggggccaucugguga

SEQ ID NO: 26077 - RNA, 9873 nt, Artificial Sequence
  derived and/or modified CDS sequence (opt11) from DENV-3__KF955479__SS-prME
acuucacuuugccucaugaugauacuccccgcggccuuagcguuccacuugaccagccgggacggagaaccccgcaugauuguggggaagaacgaaagggggaaaagccuacuauucaagacagcaagcgggaucaacaugugcacgcuuaucgcaauggacuugggggaaaugugcgacgacacaguaacauacaaaugcccacacaucacagaaguugaaccagaagacauugacugcugguguaauuugaccuccaccuggguaacauauggaacgugcaaccaagccggugaacaucgaagggacaagcggaguguagcacucgccccacacguugguaugggacucgacacgagaacacaaacguggaugagcgcagaaggcgccuggaggcaaguagagaaaguggagacaugggccuuaaggcacccagguuuuaccaucuuagcacucuuccuugcucacuauaucggaacuucccuaacucaaaaaguggugaucuucauauugcuaauguuagucacuccuuccaugacaaugaggugcguaggcgucggcaacagggacuuuguagaaggccuaagcggggcaaccugggucgauguugugcuagaacacgggggaugcguaacgacaauggcuaagaacaagccuacccuugauauagagcuacaaaagacagaggccacucaacuggccacucuucgcaaguugugcaucgaaggcaagaucacaaacaucacgaccgauagucgaugccccacucaaggugaggcagugcugccagaggaacaagaccagaacuauguauguaagcacacauauguagacagggguuggggcaacggaugcggccuauucggaaaaggcagcuugguaacaugcgcuaaauuccagugucuagaacccauagaaggcaaggucguccaauaugaaaaucugaaguacaccgugauuauaacaguucacacgggcgaccaacaccagguaggaaacgagacgcaaggaguaacagcugagauaacaccccaagccucuaccacagaggcuauccuacccgaguacgggacccuuggacuggagugcucgcccagaacaggccuggauuucaacgaaaugauacucuuaacuaugaaaaacaaggcuuggaugguacaccgccagugguuuuucgaccuaccucuucccuggacgaguggggcgaccacggaaacgccuacguggaaccgaaaggaguuauuagucacguucaaaaacgcacaugcaaagaaacaagaagucgugguacuagguagccaagagggcgcaaugcacacggcgcucaccggggccaccgaaauucagaacagcgggggcacaucuauuuuugccggccaccucaagugucgccuaaaaauggauaaacuagaauugaaagguaugagcuacgcuauguguacgaacacuuucguacucaagaaagagguaagcgaaacacaacacggaacaauauugauuaaagucgaauauaaaggcgaagacguaccgugcaaaaucccuuucuccacagaggacggccaaggcaaggcgcacaacggccgauuaauaacugcaaaucccguggugaccaaaaaggaggaaccagucaacaucgaggcggagccacccuucggcgagucuaacauaguaauagguauaggagacaaugcgcuaaagaucaacugguacaagaaaggaucaagcauaggcaagauguuugaagcgacggccagaggcgccaggcggauggccauccugggcgacaccgcgugggacuucggcagcguagguggaguucuaaacucacuagggaagaugguacaccaaaucuucgggagugcauauacagcccuguucagugguguaucauggguaaugaagaucgggaucgggguccugcuaacauggaucggacucaacucuaaaaauacgagcaugucguuuucuugcaucgcgaucggaaucaucacguuauaccuaggcgcuguaguacaggccgauaugggaugcgugauaaacuggaaaggcaaagagcuaaagugcgguucgggaaucuucgucacaaacgagguccauacauggaccgaacaguacaaauuccaagccgacagcccgaaaagacuugcaacggcuaucgccggcgccugggagaacggaguaugcggaauacgaagcacaaccagaauggagaaccuauuauggaagcagaucgccaacgagcugaacuacauauuaugggaaaauaacauuaagcuaaccguagucguaggcgacaucauaggaguucucgaacaaggaaaacgaacccugaccccgcaaccaauggaacugaaauacucauggaagacuuggggaaaggcuaagaucgugacagcugagacccaaaacaguucauucauuauagacggccccaacaccccggagugccccuccgccucccgggccuggaacgucugggaaguagaagacuacggauucggcguuuucaccaccaacaucuggcuuaaauuacgcgaagucuauacccaauugugugaccacaggcucaugagcgccgcggugaaagaugagcgcgccgugcacgcagacaugggcuauuggauagagucgcagaaaaaugguaguuggaagcuagaaaaagccucguucauugaggugaagaccugcacguggccaaagucucauacgcuuuggagcaauggcguacuagaguccgacaugauaauaccgaagucccuggcaggacccaucucccaacauaauuaccguccaggcuaccacacacaaacggcagggccauggcaccuaggcaagcuagaacuggacuuuaacuauugcgaagggacgaccgugguaauuacggaaaauugcggcacuaggggaccaucgcuacgaacaacgacuguauccggcaaguuaauacacgaauggugcugccguaguugcacgcuuccacccuuaagauauaugggcgaagacggaugcugguacggaauggagauucgccccaucagugaaaaggaggaaaacauggugaaaagccuggucucagccgggagcggugagguagauaacuucaccaugggaguccugugucucgcaauucucuucgaggaggugaugcgaggcaaauucgguaagaaacacaugauagcaggaguauucuucacauucguacuacuccuuuccgggcagauaacguggagagauauggcccauacccucaucaugauuggaucuaaugcaucggaccgcauggguauggggguaacguaccucgcacucaucgccacauucaagauccaacccuuccucgcacugggauucuuucuaagaaaacuaacgucgagagagaacuuacuacucggcgucgggcuugcgauggcaacaacccuacaacuccccgaagacaucgaacaaauggccaacggcauagcgcuaggacucauggcacuaaagcuaauaacucaguuugagacuuaccagcuauggaccgcguugaucucguuaacaugcuccaauaccauauucacccuaacgguagccuggcgcaccgcuacauuaauccuggcgggcguaucacugcugccuguuugccaauccuccuccaugcgcaaaacagauuggcuccccaugaccguugccgcaaugggcguaccgccauugccgcuauucaucuucuccuuaaaggauacucuaaaaaggaggucauggccuuugaacgaggggguaauggcugucgggcuuguaagcauucucgccucuucccugcugcgaaacgacguaccaauggccggcccccuaguggcgggugggcuacuuaucgcgugcuacgugauuacagguacaagcgcggaccugacuguggaaaaggcagccgaugucacaugggaagaagaggcggaacaaacgggcguuagucacaaccugaugaucacagucgaugacgacgguacaaugcgcauaaaggacgacgaaacggaaaauauccucacgguacuacucaagacugcccuacuaauaguaaguggaaucuucccguauaguauccccgcuacccuccugguauggcacacuuggcaaaaacaaacacaacggagcgggguacucugggauguacccagcccgccagaaacacaaaaagcagaacuagaagagggcgucuaccgaauaaaacaacaggggauauucggcaagacacaaguuggaguaggaguacagaaagaagggguauuccacacgauguggcauguaacaaggggugcaguacuaacauacaacgggaaacgacuagagccgaacugggccagcgucaagaaagaccuuauaaguuauggcggcggauggcgacuaucggcgcaauggcagaaaggcgaagagguacagguaaucgcaguggaaccggggaaaaaucccaagaacuuccagacuaugcccgguacauuccagaccacgacaggagagauaggcgccauugcucucgacuucaaaccaggaaccagcggcagcccaauuauuaauagagaggggaaaguaguaggccucuauggaaacggagucguaacuaagaauggaggcuacgugagcggcaucgcccagacuaacgcggaaccagaugggccaacaccagagcucgaagaagaaauguucaaaaagaggaaucuuacaaucauggaccuacacccagggucaggcaaaacucgaaaguaccucccagcuaucguccgggaggcgauaaaacgcaggcugagaacccugauacuggcacccacgcgaguggucgcggcagaaauggaagaagcccugaaaggccucccgauacgcuaccaaacaaccgccaccaaaucagaacauacaggacgggagaucguugaucucaugugccacgccaccuucaccaugcggcugcuauccccaguacgcgugcccaacuauaaucugauaauaauggaugaagcccacuuuacagacccggccucaauugcggcccgaggcuacauaucgacccgggucggcaugggagaggcggcagccauauucaugacagcuacaccgcccgggacagccgacgccuucccccagagcaacgcccccauccaggacgaggagagggacaucccagaacgcucauggaacagcgggaacgaguggauaacagauuuugccggcaaaacuguaugguucguacccagcauaaaagcugggaaugacauagcaaacugucuacguaaaaacggcaagaaggucauacaacuaagccguaagaccuucgacacagaauaccagaaaacuaaacucaacgacugggacuucguagucaccacagauauaucagagaugggugcgaacuucaaagcagaccgggucauagacccacgccggugccucaagccaguaauucugacugacggaccggaacggguaauccucgccgggccaaugcccgucaccgcggccuccgccgcacagaggcggggaagggucggacggaauccccaaaaggaaaacgaccaauacauauucacaggacagccucucaacaaugacgaagaccacgcccauuggaccgaggccaaaaugcuccucgacaauaucaacacaccagaaggcauaaucccggcccuauucgagccagagagggaaaagucagcggcaauagacggagaauaccggcuaaagggugaaagcagaaagaccuucguagaacuuaugagacggggcgaucuccccguaugguuagcgcacaaaguggcgagcgaaggcauaaaauacacggaccggaaauggugcuucgauggacagagaaacaaccagauauuagaagaaaauauggaugucgaaauauggacaaaggagggggaaaagaagaaauuaagaccaagauggcuugacgcccggaccuauucugaccccuuagcgcucaaagaguucaaggauuucgccgcggggcggaaaucgauugcgcuagaucuuguaacagagauagggagaguacccagucaccuagcccaccgaacaaggaacgcacuagacaaccuagucaugcugcacacuagcgaacacgggggcaaagcauacagacacgcaguggaggagcuaccugaaaccauggagacgcuccuucuacugggacuuaugauccuacucaccgggggagcuaugcuauuccucaucagcgggaaagggaucggcaagaccucaauaggauuaauaugcgugaucgcgaguagcgggauguuauggauggcggaaauuccacuacaauggaucgcguccgccauaguccuggaguucuucaugauggucuugcuaauaccagaaccagagaaacaacggacaccgcaggacaaccaacucgcuuauguaguaauagguauacuaacgcucgccgccaucaucgcugcaaaugagaugggacuccuugaaacaacuaagagagaccucggaaugaguaaggagccaggcgugguaucgccgacaagcuacuuagacguggaucuacacccagccagugcauggacacuauacgccguggccaccaccgucaucacucccaugcuaagacacacuauagagaacagcacggcaaauguaagccuagcugcgauagcgaaccaagcggucguccuuauggggcuggacaaaggauggccaaucagcaagauggaccuaggcgugccacuguuagcgcucgggugcuauucucaggugaacccauuaacacugacggccgcaguacuccuccuaaucacccacuacgcgaucaucggucccggacuccaagcaaaggccacacgggaagcccagaagcgcaccgcagccggcauuaugaagaaccccacaguagauggaauaaugacaauagacuuagacccgguuaucuaugacagcaaauucgagaagcagcugggacagguuaugcuccucguacucugcgcaguacaacuccuauuaaugagaacgagcugggcgcucugugaggcgcugacccucgcuacgggacccauaaccacauugugggaggguagcccgggcaaauucuggaacacuaccaucgccguaagcauggccaacauuuuccgagggagcuaccuugcaggagcaggcuuagccuucagcauaaugaagucaguaggaaccggaaagcgcgggacuggaagccaaggcgaaacccuuggggaaaaguggaagaagaaacuuaaccagcucucgagaaaagaguucgaccuguacaagaaaucuggaaucaccgaagucgacagaacagaagccaaagaaggacuaaaacggggagaaauaacucaucaugcggugaguagggggucagcgaaacuccaaugguuuguugaacgaaacauggucauccccgagggccgcguaaucgaccuaggaugcggaagaggaggcugguccuauuacugugcuggacuaaagaaagucaccgaaguaaggggauauacgaaaggcgggccagggcacgaggagccaguaccaaugagcacuuacggcuggaauauaguaaaacucaugucgggcaaagacgucuucuaccuuccacccgagaagugcgacacacugcugugcgacaucggagaaucaucaccaagcccaacgguggaagaaucccgcacaauccgaguucugaagauggucgagcccuggcucaagaauaaccaauucuguauaaaaguccuaaaccccuauaugccgacaguaaucgagcaccuugaaaggcugcaacggaaacacgggggaaugcuagugcggaauccucuaagucggaacaguacccaugagauguauuggaucagcaaugggaccggaaacauaguagcaagcgucaacauggucucacgauuauuauuaaaucgcuucacuaugacgcaucguagaccgacuauagagaaagacguggaccucggagccggaacuaggcacgugaacgcggaaccagagacucccaauauggauguaauaggagagcgaauuaaacgaauaaaagaggagcacaacuccacauggcacuacgacgaugagaaucccuacaaaacaugggcguaccaugggaguuacgagguuaaggcaacggguucggcaucuagcaugaucaacggagugguaaaguuacugacaaagcccugggacguggucccaauagugacccagauggcgaugacagacacaacgccguuuggccagcaacgcguguucaaggaaaagguagauacucggacaccgagaucuaugccuggcacgcgcagggucaugggaauuacggcagaauggcuauggcggacacuugggagaaacaaaaagcccagacucuguaccagagaggaguucaccaaaaaggugcgaaccaacgcggcaaugggggcugucuuuaccgaagagaaucaaugggacagcgcaaaggcggcaguggaggacgaagacuucuggaagcuagucgaccgggagagagaacuacacaaacuuggcaaaugcggauccugcguguacaauaugaugggaaagagggagaaaaagcuaggcgaguuugguaaggccaaaggaucacgagcuauaugguauauguggcuaggugcaagguaccucgaguucgaggcccucggguucuuaaacgaggaccacugguuuagucgagagaacagcuacagcggcguagagggcgaagggcugcauaaguuaggcuacauacugagggacaucagcaaaauaccaggcggugcgauguacgcagacgacacagccggaugggacacgcggauaacggaagacgaccuccacaacgaagagaaaauaacacaacaaauggacccagaacaccgucagcuagccaacgcuaucuucaaguuaaccuaccaaaauaaaguagucaagguccagcggccuacgccaacgggaacagugauggauauaauaucacggaaggaccagcgcggauccgggcaagugggcaccuacgggcucaacaccuucaccaauauggaggcgcaacuaauucgucagauggagggagaaggcguauuaagcaaagcagaccuugagaauccacaucuaccagagaagaagauaacacaguggcucgagacaaaaggcguagaacgucuaaaacgcauggcaauaucgggggacgacugcguggugaagccgaucgacgaccgcuucgcaaaugcccugcuagcccuuaacgacauggggaaagugagaaaagacaucccccaguggcaacccuccaaaggauggcaugacuggcaacaaguucccuucugcagccaucauuuccaugagcuuaucaugaaagacgggagaaaacugguggucccuuguaggccgcaagacgagcugauagggcgcgcacgcauaucucaaggagcaggcuggagcuuacgggaaacggcgugccuaggcaaggccuaugcgcaaauguggucccuaauguacuuccacagaagagacuugcgccuagcgucuaacgcaauaugcagcgcaguaccuguccacugggugccuaccucccgcacaacauggucuauccacgcccaccaucaauggaugaccacagaagacaugcucacgguauggaacagagucuggaucgaagauaacccuuggauggaagacaaaacacccguaaccacgugggaaaauguaccauacuuagguaaaagagaagaucaauggugcgggucccucauaggacuaaccagccgggcgacgugggcccaaaacaucccuaccgcaauccagcaagugagaucguuaauagguaacgaggaguuccucgacuacaugcccucaaugaaacgguucaggaaagaagaggaaagcgagggggccauaugguga

SEQ ID NO: 26078 - RNA, 9873 nt, Artificial Sequence
  derived and/or modified CDS sequence (opt11) from DENV-3__FJ850109__SS-prME
acgaguuuaugucucaugaugauucugcccgccgcccuggcauuccaccucacgucacgggacggcgagccccguaugaucguggggaagaaugaaagaggcaagaguuuguuguucaagaccgcaucaggcaucaacaugugcacccucaucgcuauggaccucggagagaugugcgaugauaccgugaccuacaagugcccccacauaaccgaggucgagcccgaggacaucgacuguuggugcaaccugaccagcaccugggugacguacgggaccugcaaccaggccggcgagcaccgucgcgacaagcggucggucgcccucgccccccacgugggcauggggcuggauacccgcacccagaccuggaugagcgcagagggcgccuggcgccagguggagaagguugagacgugggcccugcgccacccgggguucacgauccuugcguuauuccuggcacacuacaccggcaccagccucacucagaagguggugaucuucauucuguugaugcucgucacccccagcaugaccaugcggugugugggggugggcaaccgcgacuucgucgagggacuguccggggccacauggguggacgugguacuggagcacggcgguugcguaacgaccauggcgaagaacaaaccuacccucgacaucgagcuacagaagaccgaggccacacaacuggcuacauugcggaagcugugcaucgagggcaagaucaccaacaucaccacggauagccgcugcccaacccaaggcgaggccguucugccagaagagcaggaccagaacuacgucugcaaacacaccuacguugaccggggguggggaaaugggugcggccuuuucgggaagggcucccuggugaccugcgccaaguuccaaugccuggagccgauugagggaaaggucgugcaauacgagaaccucaaguacacgguuaucaucaccguccacaccggggaccaacaccaagugggcaacgaaacccagggcgucacugccgagaucacaccacaggcgagcacuaccgaggcaaucuuacccgaguauggcacgcugggccucgagugcuccccucggaccggccuggauuucaaugagaugauacugcuaaccaugaagaacaaggccuggauggugcacagacagugguucuucgaucugccucugcccuggaccagcggagccaccaccgagaccccgacguggaacaggaaggaacuccuggugacauuuaagaacgcccacgccaagaaacaagaggucguggugcuggggagucaggagggcgcgaugcauacggcucucaccggugccacugagauccagaauucaggcgggaccucaauauucgccggacacuuaaaaugucggcugaagauggacaagcucgaguuaaaaggaaugagcuacgccaugugcacgaauaccuucguccuuaagaaggagguauccgagacccagcacggcacaauccucaucaagguggaguacaagggcgaggacgucccgugcaagauccccuucagcacggaggacggucagggcaaggcgcacaauggcagacugaucaccgcuaaucccgucgugaccaagaaggaggagccggucaacauugaggcggagccacccuucggcgagagcaacauagugauaggcaucggugacaacagucugaaaaucaacugguacaagaagggcucguccauugggaagauguucgaggccaccgcgcggggcgcucgccggauggcuauccugggcgacacggccugggauuucgggucuguaggagggguccucaacucgcuggguaagauggugcaccagauuuucggcagcgccuacaccgcguuguuuaguggagugucgugggucaugaagauaggcaucggaguacuccugaccuggaucggccuuaacuccaaaaacacgagcaugucauucagcugcaucgcuaucgggaucauuacguuguaccugggcgccgugguccaggccgacacggggugcgugauaaauuggaagggcaaagagcugaaguguggaucagggaucuuugugaccaacgagguccacaccuggacggagcaguacaaguuccaagccgauagccccaaacgccucgcgacugccaucgccggggccugggagaacggggugugcgguauccgcagcacuaccagaauggaaaaccuccuguggaagcaaauagcgaacgaacuuaacuacauccugugggagaacaacauuaagcugacgguggucguuggagauaucaucggcguccucgaacagggcaaacgcacccugacgccccaaccgauggagcugaaguacucauggaagaccugggguaaggcucggaucgucacggccgagacccagaacagcucguucaucaucgacggccccaacaccccagagugccccaacaccagccgcgccuggaacgugugggaaguggaggacuacggguucggcgucuucaccacgaacaucuggcucaagcugcgugagguguacacccaacugugcgaccauaggcucaugagcgccgcggugaaagaugagcgggccgugcacgcagacaugggcuacuggaucgagagccagaaaaacggguccuggaagcuggagaaggccagccucaucgaggugaaaacuugcaccuggccgaagucccacacgcuuuggagcaacggggugcuagaaagugacaugaucauccccaagucguuggcgggucccaucucccagcacaacuaucgccccggcuaccacacgcaaaccgcggggcccuggcaccugggcaagcuggagcuggacuucaacuacugugaggggaccacgguagugaucaccgagaauugcgggacuagaggccccagccuccgcaccacuaccguguccgggaagcugauccacgaguggugcugccggagcugcacccuucccccgcugcgcuacaugggcgaggauggguguugguauggcauggaaauccguccaaucuccgagaaggaggagaacauggucaagagccuugugucugccggcaguggcgagguggauaacuucacaaugggaguccugugucuagcaauccuguucgaagaggugaugcgugguaaguucggcaaaaagcacaugaucgccggaguguucuucacguucguccuguuguuauccggacagauaaccuggcgugacauggcccacaccuugauuaugaucggcucuaacgcgacugaccggauggggaugggcgugaccuaccucgcccugaucgcuaccuucaaaauccagccauuccuggcccucgguuucuuucugcggaagcuaaccucccgcgagaauuuacugcugggcgugggccuugccauggcgaccacgcugcaacuuccggaagacaucgaacaaauggcaaacgggaucgccuugggccugauggcccugaagcucauaacgcaguucgagaccuaccaauuauggaccgcucugaucucacucacgugcagcaacacgaucuucacccugaccguggcuuggcggacggccacccucauccucgccggggugucccugcugccgguaugucagagcaguagcaugcgcaagaccgacuggcuucccaugaccguggccgcgaugggcguaccgccccucccguuguucaucuucagccucaaggacacgcugaagcggcgcagcuggccccugaaugagggagucauggccgugggccucgucuccauccuggccucauccuuauugcgaaacgacgucccaauggccggccccuugguugccggaggccuccucaucgcaugcuacgugaucacggggaccagcgccgacuugaccguugagaaggcggccgacgugaccugggaggaagaggcggaacagacgggcgugucccacaaucugaugauaaccgucgacgacgacgggacaaugcggaucaaggaugacgagaccgagaacauccucacggugcugcugaagaccgcgcuccugaucgugagcggcauauucccguauucaaucccagccacacuguugguguggcacacguggcaaaagcagacccaacgcucaggcgugcugugggacguucccucaccgcccgagacccagaaggccgaguuagaggagggggucuaccgaaucaagcagcaggggaucuucgggaaaacccaggucggcguagggguccagaaggagggcguguuucacaccauguggcacgugacgcgcggagccguacucaccuacaacggcaaacggcuagaacccaacugggccagcgugaagaaggacuugaucucauacggcgggggauggcgcuuaucagcgcaguggcagaagggggaggaggugcaggucaucgccgucgagccggguaaaaaucccaagaacuuccagaccaugcccggcaccuuccaaacgaccaccggggagaucggcgccauagcauuagauuuuaagcccggaacuagcggcucccccaucauuaaccgagagggcaagguggucgggcuguauggcaacggggugguuacgaaaaacggcggguacgugagcggcauugcgcagacuaacgccgaaccggacggccccacccccgagcuagaggaggagauguucaagaagaggaacuugaccaucauggaccugcaccccgguuccggcaagacgcggaaguaccugccggccaucgugcgcgaggccaucaagaggcgccuacggacccuaaucuuagcacccacccgcgucgucgcggccgagauggaggaggcacucaagggacuccccauccgguaccagaccaccgccacuaagagcgagcauacgggccgcgaaaucguugaucugaugugccacgcuaccuuuacgaugcggcuccugucccccguucgcgucccgaacuacaaucugaucauaauggaugaggcgcacuuuaccgaccccgccucgauugccgcgcggggcuacaucuccacccgcgugggcaugggcgaggcggcggccauuuucaugacugccacgccgcccgggacugccgacgcguuuccucaaagcaacgcacccauccaggacgaggagcgcgacauccccgagagguccuggaacagcggcaaugaauggauaaccgacuucgcggggaagaccgugugguucguccccuccaucaaggccggcaaugauaucgcgaacugccuccgcaagaacgggaagaaggugauccagcugagccguaagacguuugacaccgaguaucagaaaaccaagcugaacgacugggacuucguugugaccacagacaucuccgagaugggcgcgaacuucaaggccgaucgcgugaucgacccacggaggugccucaagcccguaauccugacggacggccccgagcgggucaucuuggccggcccgaugccgguaaccgccgccagcgcggcccagcgacggggucgcgugggacggaauccacagaaggagaacgaccaguacaucuuuaccgggcagcccuuaaauaacgacgaggaccacgcccacuggaccgaagcaaagauguuacuggacaauaucaacacucccgaggggaucauccccgcucucuucgagccugagcgcgaaaaguccgcggcaaucgauggcgaauacagacucaagggcgagagccgcaagaccuucgucgagcugaugcggagaggggaccuccccguguggcuggcccacaaggucgccuccgagggcaucaaauacaccgaucggaaguggugcuucgacggacagagaaacaaccagauccuggaggagaauauggacguggagauauggaccaaggaaggcgagaagaagaagcuccggccucgcuggcuggacgcgcgcacguacagcgacccgcuggcccucaaagaguuuaaggauuucgccgccggccggaagaguaucgcccuggaccuggucaccgagauugggcggguccccacccaccucgcgcaccggacucgaaacgcccuugacaaccuggugaugcuucacaccagugaacacggcggaaaggccuaccgccaugccguggaagaacuucccgagaccauggagacucuacuccugcucggccucaugauccugcuuaccgggggcgccaugcuguuucugaucuccgggaagggcaucggcaagacguccaucgggcugaucugcguuaucgcguccuccggcaugcuuuggauggccgagauuccgcugcaguggaucgccagcgccaucguacuggaguucuucaugauggugcuccugaucccggagccagagaaacagcgcacaccccaggacaaccagcuggccuacgucgugaucgguauccucaccuuggcagcaaucaucgccgccaacgagaugggccugcuggagaccacgaagcgugauuuaggcaugaguaaggagccaggaguggucagccccaccuccuaccuagacguggaucuccaucccgcgagcgcguggacucuguacgccguggccacgacggucauaacccccaugcuacgccauaccauugagaacuccaccgcgaacgugagccuugcggcaaucgcaaaccaggccgugguccuaaugggccuggacaagggguggccgaucaguaagauggaccucggggugccucugcuggcccucggauguuacagccaggugaacccccuuacgcuaaccgcggcagugcucuuacuaauuacacacuacgccaucaucggccccggccuccaggccaaggcaacccgggaggcgcagaagcgcacggcugccgguaucaugaagaaccccaccguugacggaaucaugaccaucgaccuggaccccgugauuuacgacuccaaguucgagaaacagcugggacaggucaugcuccucgucuugugugccgugcagcuccugcugaugcguacaagcugggcgcucugcgaagcguuaacacuggccaccgggcccauuaccacccugugggagggaucaccggguaaguucuggaacaccaccauagccguaaguauggccaacauuuuccgcggcucguaucuugcgggggcuggccuggccuucucgaucaugaaguccguugggaccgguaagcggggcacugggagccaaggagagacccucggggagaaguggaagaagaaacugaaccagcugucccgcaaggaauucgaccucuacaagaaguccggcaucacggagguagaucggacagaggccaaggaagggcugaaacgcggcgaaaucacgcaccacgccgucagucggggcucagccaaguuacagugguuuguggaacgcaacauggugaucccggaggggagagucaucgaccucggcugugggcgcggcggguggucguacuacugugccggccugaagaaggugaccgaagugcggggauacacgaagggcgggcccggacaugaggagcccguccccauguccaccuacggcuggaacaucgugaaguugaugagcgggaaggacguuuucuaccucccgcccgagaagugugacacccugcugugugacauuggcgagagcagccccucucccacagucgaggagagccgcacgauucgcgucuuaaagaugguggaaccguggcuaaaaaauaaucaguuuugcauuaaaguccucaaucccuauaugcccgccguuauagagcaccuggagcgucuccagcgcaaacacggggggauguuggugaggaacccccugucucgcaacagcacucacgagauguacuggaucuccaacggcaccggaaacaucgucgccaguguuaacauggugucccgacuccugcugaaccgauuuaccaugacgcaccggaggccgaccaucgagaaggacgucgaccucggagccggcacccgucaugucaacgcggaaccugagacccccaauauggaugugauuggagagcgcaucaagcggaucaaggaggagcacaacagcacauggcacuacgacgacgaaaacccguacaaaacaugggccuaccacggcuccuacgaggucaaagccacaggguccgccagcagcaugaucaacggcgucgucaagcugcuuaccaagcccugggacguggugcccauggucauucagauggcaaugacggacaccacucccuucggucagcagcguguauuuaaagagaagguggacacccggacgccgcgcuccaugcccgggacccggcgcguuauggaaauaaccgcagaguggcucuggcggacccugggccggaacaagaagccccggcugugcacgcgcgaggaauucaccaagaaagugcggaccaaugccgccaugggugccguguucaccgaggagaaccagugggauagcgcgaaagccgcugucgaggacgaagacuucuggaaacucguggaccgagagcgcgagcugcacaaacugggaaagugcggcagcuguguguauaacaugaugggcaagcgggagaagaagcucggggaauucggcaaggccaagggcucccgcgcaaucugguacauguggcugggcgcccgguaucuggaguuugaggcccucggcuuucugaaugaagaccacugguucagccgcgagaacuccuacagcggggucgagggcgaagggcugcauaagcucggguauauccugcgggacaucuccaagauccccggcggugcgauguacgccgacgacacggccgggugggacacccguaucaccgaggacgaucugcacaacgaggaaaagauaacucaacagauggacccggagcaccggcaacucgcgaacgcgaucuucaaacuuacauaccagaacaagguggugaaggugcagaggcccacgcccaccgggaccgugauggacaucaucucccggaaggaccaacgaggcuccggccagguggggaccuaugggcuuaacacguucacuaacauggaggcccagcucauucggcagauggagggggagggcguucucagcaaagccgaccuggagaacccgcauuugccugagaagaagaucacacaguggcucgagaccaaggggguugagcgccugaaacggauggcgauaagcggcgaugacugcguaguaaagccuaucgacgaccgguucgcgaacgcccugcuggcccugaacgauaugggaaaggugcggaaggacaucccgcaauggcaaccuagcaagggguggcacgauuggcagcaggucccguucugcucccaucacuuccaugagcucaucaugaaggacggccgcaaacuggucgugccgugucguccgcaagaugagcugaucgggcgcgcccggaucagccagggagccgggugguccuuacgugagacggcuugucugggcaaggcguacgcacagauguggaguuuaauguacuuccauaggcgggaccucaggcuggcguccaacgcgaucugcagcgcugugcccguucacugggugccaaccuccagaaccaccuggaguauccaugcccaccaccaguggaugaccaccgaagauaugcugaccguauggaaucgcgucuggauugaggacaaccccuggauggaggauaagacccccgugacgaccugggagaaugugccguaccucgguaagcgggaggaucaguggugcgggucacugaucggccugacuagccgcgcgaccugggcccagaacauaccgacggcaauccagcagguccggagucuaauugggaacgaagaguuccuggacuacaugccguccaugaagcgcuuccggaaggaggaggaaagcgagggcgcaauuugguga

SEQ ID NO: 26079 - RNA, 9873 nt, Artificial Sequence
  derived and/or modified CDS sequence (opt11) from DENV-3__GQ868586__SS-prME
accagcuuaugccucaugaugaucuugcccgccgccuuggcguuucaucucaccagccgagacggagaaccgcgaaugaucguggggaaaaaugaacggggcaaaucgcuucuguucaaaaccgcgucaggcaucaacaugugcacgcucaucgccauggaucugggcgagaugugugacgacacugugaccuacaagugcccccacauaacugagguggagcccgaggacaucgacugcuggugcaaccuuaccucuaccugggugaccuaugggacuugcaaucaggccggcgagcaccggcgcgacaagcgguccguggcccucgcaccccacguggguauggggcuggacacccgaacccagaccuggaugucggccgagggcgccuggagacagguggagaaggucgaaacuugggcccugaggcauccgggguucaccauccucgcccuguuucucgcccauuauaucgggaccucccucacccagaaaguggugaucuucauucugcugaugcucgucacccccucaaugaccaugcgaugcguggggguugggaaccgcgacuucgucgagggccuguccggggccacgugggucgacguaguccucgagcacggcgggugcgugacuacgauggcaaagaacaagcccacccucgacaucgaacugcaaaagaccgaggcgacccagcuggcgacgcuccggaagcugugcauagagggcaagaucaccaauauaacgacugacagccgcugccccacgcagggcgaggccgugcugcccgaggagcaggaccagaacuacgucugcaagcacacauauguggaccguggguggggcaaugggugcggccucuucgggaagggcucccuggugaccugugccaaauuucagugcuuagagcccauugagggcaagguagugcaguacgagaaucuuaaguauaccguaaucaucacgguccacaccggagaccagcaccaggugggcaacgagacccaggggguuaccgcagaaaucacgccccaggccucgaccaccgaggcgauuuuacccgaguauggcacucuggggcucgagugcagcccgcgcaccggacuggacuucaacgagaugauccugcucacaaugaagaacaaagccuggaugguucaccggcagugguucuucgaccugccacugcccuggaccagcggcgccaccaccgagacgcccaccuggaaccgcaaggaacuccucgugaccuucaaaaacgcccacgccaagaagcaagaggucguggugcuggggucccaggagggcgcgaugcacaccgcccucacgggggccaccgagauccagaacagcggcggcaccuccauauucgccggccacuuaaagugucggcugaagauggacaagcucgaguugaagggcaugucauacgcuaugugcacgaacacguucguccugaagaaggagguguccgagacccagcacgggaccauccucauuaagguggacuacaagggggaggacgucccguguaagauucccuuuagcaccgaagacgggcagggcaaagcucacaacggccgccugauuaccgccaaccccguggugaccaagaaggaggagcccgucaauaucgaagccgaaccacccuucggggaaucaaacauugugaucggcaucggcgacaacgcacugaagaucaauugguauaagaagggguccagcaucgguaagauguucgaggcgacagcccggggcgcccgccggauggcgaucuugggugauaccgcaugggacuucggguccgugggagggguccucaauucucugggcaagauggugcaccagaucuucggguccgcguauacggcacuauucucaggcgugagcugggucaugaagaucggcaucggugugcuccuuaccuggauuggccugaacagcaagaauacuuccaugagcuucuccugcaucgccaucgggauuaucacccucuacuuaggcgccgugguccaggccgacacgggaugcgugauaaacuggaagggcaaggagcugaagugcggaucugguaucuucgugaccaacgagguccacaccuggacagagcaguacaaguuccaggcggacucccccaagcgccuagccacggcaaucgccggagccugggaaaacggggugugcgguauccgcaguacaacacguauggaaaaucuacuuuggaagcagaucgcgaacgagcucaacuacauuuugugggagaacaacaucaagcugaccguagucguaggggacauaaucggcgugcucgaacagggcaaacgcacucugacuccccagcccauggagcugaaguacuccuggaagaccugggguaaggccaaaaucgucacagccgagacgcagaauagcuccuucaucauugacggccccaacacccccgagugccccagcgccucccgggcguggaacguaugggagguugaggacuacggguuugggguuuucaccaccaacauauggcuuaagcuccgugagguguauacccagcagugcgaccaucggcugaugucagccgccgugaaggacgagcgcgccguccacgccgacaugggauauuggaucgaaagccagaagaacgggucguggaagcucgagaaggcgucccugaucgaaguuaagacgugcaccuggccgaagucccauacccuguggagcaauggcgugcucgagucugacaugaucauccccaagagccuggccggucccaucucccagcauaacuaccggccgggauaccacacucagacggccgggcccuggcaucuggggaagcucgaguuggacuuuaacuacugcgagggcacgaccgucgugauuacagagaacugcggaacgcgcggccccagucuacgaaccaccaccguguccggaaaguuaauucacgaguggugcugccgguccugcacgcugcccccgcugcgguacaugggcgaggauggaugcugguacggcauggagauccgucccauuucagagaaggaggagaacauggugaaaagccucguguccgccggcagcggggaaguggacaauuuuacgauggguguccuaugccucgcgauccucuucgaggaggugaugcgggggaaguucggcaagaaacacaugaucgcugggguguucuuuaccuucguccugcugcucuccggccagaucaccuggcgcgauauggcacacacgcuaaucaugaucggcagcaacgccucagaucggauggggaugggcgugaccuaccuggcauugauagccaccuucaagauccaaccguuccuagcacugggguucuuucuucgcaagcugaccagccgggagaaucugcuccugggagugggccuggcgauggccacgacccuccagcugcccgaggacauagagcagauggcaaacgggauagcgcugggccucauggcccugaagcugaucacccaguucgaaacuuaccagcucuggacggcccugauaagccuaaccugcucuaauaccaucuucacccucaccgucgccuggcgcaccgccacccugaucuuagcgggggucagccuucugccggucugccaguccucguccaugcggaagaccgacuggcuucccaugacgguggcugccaugggcgugccaccccuuccgcuguucauuuucagccucaaggauacccucaagcgccguuccuggcccuugaacgaggggguaauggccgugggccugguaagcauauuagccucgagccuacugcggaacgacguccccauggcuggcccccucguggcagggggccugcugaucgccugcuacgugauuacggggaccuccgccgaccucacgguugaaaaggccgccgacgugaccugggaggaggaggcugagcagacaggugugucccacaaccugaugaucaccgucgacgacgaugguaccaugcgcaucaaggacgacgagacggagaacauccugaccgugcuucuuaagaccgcucuguugaucgugucuggaaucuucccguacucuauucccgccacccugcuugucuggcacacuuggcagaagcagacgcagcgguccggcguguuaugggaugugcccaguccacccgagacccaaaaagccgagcucgaggagggggucuaccguaucaagcagcagggcaucuucgguaagacccaaguggggguugggguccagaaggaggggguguuccacacgauguggcacgugacgcgcggugcgguacuuaccuacaacggcaagcgucuagagcccaacugggccuccgugaaaaaggaccugauuagcuacggcggggguuggcggcuguccgcccaguggcagaagggcgaagaggugcaggucaucgccguggaacccggcaagaaucccaaaaacuuccagaccaugcccggcacguuccagaccaccacuggggagaucggcgcgaucgcucucgacuucaagcccggcacgagcggcucccccauuaucaaccgagaggggaagguuguggggcuauacggaaacggggugguaaccaaaaacggcggguaugucucaggcaucgcucagacgaacgccgagccggacggccccacccccgaguuggaggaggagauguuuaagaaacggaaccugacgaucauggaccuccaccccgggagcggcaagacccggaaguaccugccggccaucgugcgggaagcgauaaagcgccggcugcgaaccuuaauccuggcucccacccgggugguggccgcagagauggaggaggcgcugaagggguuacccauccgcuaucaaaccaccgcgacaaaauccgagcacaccggccgugagaucguggaccuaaugugccacgccacguuuacuaugcgccugcucagcccuguacgggucccgaacuauaaucuaaucaucauggacgaagcccacuucacugaccccgcguccaucgcggcgcgcggguauaucagcacucggguggguaugggcgaagccgcggccaucuucaugacggcuacaccgcccggcaccgccgacgcguucccgcagagcaacgcccccauacaggacgaggaacgcgacauacccgagcgcagcuggaacuccggcaacgaguggaucacagauuucgccgggaagacggugugguucguacccucgaucaaggcgggcaaugacauugccaacugucuacggaaaaacgggaagaaagugauccaguuauccagaaagaccuucgacacugaguaccaaaagaccaagcugaaugacugggacuuuguuguaacgaccgacauaagcgaaaugggcgccaacuucaaggcggaucguguaaucgaccccaggcggugccugaagcccgugauccucaccgacgguccugagcgcgucauuuuagccggucccaugccugugaccgcggccuccgcugcacagcgacgggggcggguuggacggaacccccaaaaggaaaacgaccaguacaucuuuacgggccagccccugaacaacgacgaggaccaugcccacuggacggaggcaaaaaugcuccuggacaacaucaacacccccgaggggaucaucccggcucuguuugagcccgagcgggagaaguccgccgcuaucgacggugaguaucgcuuaaagggagaaucccggaagaccuuugucgaacugaugcgccgcggagaccugcccguguggcuagcgcauaaggucgcgagugagggcauuaaguacaccgaccgaaaauggugcuucgauggacagcgcaacaaucagauccuagaggagaacauggacgucgagaucuggacgaaggagggcgagaagaagaagcugcggccucgguggcucgacgcacguacauacucugacccacucgcucugaaggaguuuaaggacuuugcagcggggcgcaagagcaucgcccucgacuuggugacagaaauugggagaguccccucccaccuggcccaccgcacccggaacgcccuggacaaccuggugaugcugcacacgagcgagcacggcgggaaggccuaccggcacgcaguagaggagcuacccgagacuauggaaacacuccuccucuugggccugaugauccuguugaccgggggcgcaaugcuauuucucaucagcggcaaggggaucggcaagacgucaaucgggcucaucugcguuaucgcgagcucggggaugcuguggauggccgagaucccgcuccaguggaucgccagcgccaucgugcuggaguucuucaugaugguucugcugauccccgaacccgagaagcagcggacgccccaggacaaccagcuggccuacgucgugaucgggauccugacucucgccgcgauaaucgccgcgaacgagaugggccugcuggagaccacgaagcgcgaccucggcaugagcaaggagccgggggucgucucuccgaccuccuaccuggauguggaccugcaccccgcguccgccuggacgcucuacgccguggcgaccaccgucaucacccccaugcuaaggcauaccaucgagaacucuacugcaaacgugucgcuggccgcaaucgcaaaucaggccguggugcucaugggccuggacaagggguggccgauauccaagauggaccuggguguacccuuacuggcccuggggugcuacagccagguaaacccccuaacguugacggcagccguccuacuauuaaucacccauuacgccaucaucggcccgggucuacaagcgaaggccacccgcgaggcccagaagcgaacugcugccgggauaaugaaaaacccgaccguggacggcaucaugaccaucgaccucgacccggucaucuacgacuccaaauucgaaaagcagcuggggcagguuaugcugcuagugcugugcgcggugcaguuacuccugaugagaacgagcugggcccugugcgaggcccuaacgcuggccaccggccccaucacaacccugugggagggaucccccgggaaguucuggaacacuaccauugcggucuccauggccaacaucuuccggggauccuaccucgccggagccggcuuagccuucaguaucaugaagucaguggggacaggcaagagaggcacagggucgcagggcgagacccugggggaaaaguggaagaagaagcucaaccagcugagccggaaggaguucgacuuguacaagaaauccggcaucacggagguggaccgcaccgaggcgaaggaggggcucaagagaggggaggucacccaucacgccgugagccguggcuccgccaagcugcagugguucguggagaggaacauggucauccccgaggggcgcgugaucgaccuaggcugcgggcggggcggguggagcuacuacugcgccggccuuaagaaagugacugagguccgcggcuauacgaagggugggccaggacacgaggagccggugcccauguccaccuacggguggaacaucgugaagcugaugagugggaaggacgucuucuaccucccgcccgagaagugugacacacuccugugcgacaucggcgaguccagccccucccccaccguggaagagagccggacgauucgcgugcugaagauggucgagccguggcucaagaacaaccaauucugcaucaaggugcucaaccccuacaugcccaccgucaucgagcaccucgagcgccuacagcggaagcacggcggaaugcucguccgcaacccccuguccagaaacucuacccaugagauguacuggaucucuaacggcaccgggaauaucguugccagugugaacauggucucccgccuccuccugaaucgauuuacgaugacccaccgccggccgaccaucgagaaggacguagacuugggggcgggcacccgccacguaaacgccgagcccgagacgccuaacauggacguuaucggcgagcggaucaagcgcaucaaagaggagcacaacagcaccuggcacuacgacgacgagaacccguacaagacaugggccuaccacggcaguuaugaggugaaggcaacuggcagcgccuccagcaugaucaacggcguagugaaguuguuaacgaaacccugggacguagucccuauggugacccagauggcgaugaccgauaccacgcccuuugggcaacagcgggucuucaaggagaaggucgacacccggacaccccggagcaugcccggcacccgacgggugaugggcaucacggccgagugguuguggcgcacgcucggacggaacaaaaagccccgacugugcacccgggaggaguucaccaagaaggugcguacgaacgccgcgaugggugcagucuucacugaagaaaaccagugggacagcgccaaggccgccguggaggacgaggacuucuggaaacuuguggagcgcgaaagagagcuccauaagcuggggaagugcggcaguugcgucuauaacaugauggggaagcgcgaaaagaagcugggcgaauuuggcaaggccaaaggaucccgagcgaucugguacauguggcucggagcccguuaucuggaguucgaggcccuaggguuccucaacgaggaucauugguucagccgggagaacucuuacagcggaguggagggggaaggccugcacaaauuaggguauauccuccgugauaucuccaagauacccgggggcgccauguacgccgacgacaccgcggggugggacacccggauaacggaggacgaccugcacaaugaagagaagaucacgcagcagauggacccggagcacaagcagcuggcuaacgccauauucaaguuaacauaccaaaacaagguggucaaggugcagcgccccacaccgacuggcacggugauggacaucaucagccggaaggaccagcgcggcuccgggcaggucggcaccuacgggcugaauacguucacgaacauggaggcccagcugauucggcagauggagggcgaaggggugcucucgaaagccgacuuagagaacccccacuuacccgagaaaaagauuacgcaguggcuggagaccaagggcguugagcgcuugaagcgcauggcaaucucuggcgaugacugcguggugaagcccaucgacgaccgcuuugcgaacgcccugcuagcccugaacgauaugggaaaggugcgaaaagacaucccccaauggcagccaagcaaggguuggcacgacuggcagcaggucccauucuguagucaccacuuccacgaacugauaaugaaggacggucguaagcucguggugcccugucggccccaggaugagcugaucggccgcgcccggaucagccagggggccggauggucccugagagaaacggccugccucgcuaaggcuuacgcccagauguggagcuugauguacuuccaccggcgcgacuuacggcuggcuuccaacgccaucugcagcgccguaccggugcacugggugccgaccucccggacgaccuggagcauacacgcccaccaccaauggaugacgaccgaagacaugcugacggucuggaaccgugucuggaucgaggacaauccuuggauggaggacaagacccccgugacuaccugggagaacguccccuaccugggcaagcgggaggaucaguggugcgguagccucaucggccugacgucccgugcgaccugggcccagaacauccccacugcuauacaacaggugcggagccuuaucgggaacgaggaguuccucgacuacaugccuaguaugaagcgauuucggaaggaggaggagucagagggugccaucugguga

SEQ ID NO: 26080 - RNA, 9873 nt, Artificial Sequence
  derived and/or modified CDS sequence (opt11) from DENV-3__FJ850110__SS-prME
acaagccucuguuugaugaugauacucccggcugcccuggccuuccaccucacgucacgggacggugaaccccgcaugaucgucgguaaaaaugaaagaggaaaaucgcuguuauucaaaaccgccuccggcauaaacaugugcacguuaauugcaauggaccucggagaaaugugugacgacacagucacuuacaaguguccacacaucacagaggucgaacccgaagauauagacugcuggugcaacuugacuucuacaugggucaccuacggcacgugcaaucaggcgggagaacaccgacgcgauaagagaucugucgcauuagcgccucacguggggaugggauuagauacaagaacacaaacguggaugucggcagaaggagccuggcgacaagucgagaaaguggaaacgugggcacucagacacccgggauuuacaauacucgcucuauuccuagcccacuacaucggaaccucacucacucaaaaggugguaauauuuauucuacugaugcucgugacacccagcaugacaaugcgcuguguaggaguugggaacagagacuucguagagggacugagcggugcaacauggguggacgucguacuggaacacggcggcugcgucacaacaauggccaaaaacaaacccacccuagacauagaacugcaaaagacugaggccacgcaacuagcuacgcuacggaagcuaugcauagagggaaaaauaacaaacaucacaaccgacucacggugcccaacacaaggagaggcaguacuaccagaagaacaagaccaaaacuacguauguaaacacacguauguggauagagggugggggaacggcuguggacucuucggaaaggguagcuugguaaccugcgcgaaauuccaaugcuuggaaccuauagaagggaaagucgugcaguacgagaaucuaaaauacaccgucauaauaacuguccacacgggggaccaacaucaaguggguaaugagacccaagggguuacugcggagauaacgccacaggccagcacaacggaggcgauccuacccgaguacggaacacuaggacuagaaugcagcccacgcacagggcuggacuucaacgaaaugauacuccucaccaugaaaaauaaggccuggaugguacaccgccaaugguucuucgaccuaccgcucccguggacgagcggggcuacaacagaaaccccgacguggaaucgaaaagaacuacuggucacguucaaaaacgcgcacgcaaagaagcaagaagucguggucuugggaagccaggagggcgcaaugcauaccgcguuaacaggugcgaccgaaauccaaaacagcggaggcacauccauauuugcaggccaccucaagugcagacuaaagauggacaaguuagagcugaaggggaugaguuacgcuaugugcacuaacaccuucguacuaaagaaagaggugucugagacccagcauggaaccauccuaaucaagguagaguacaagggagaagauguucccugcaaaaucccauucucaacagaagacgggcaaggcaaagcgcacaacggccggcucauuacagcaaaccccguagugacgaagaaggaagaaccgguaaacaucgaagccgagccaccguuuggugagaguaacauugucauaggcauuggggacaacgcccuaaagaucaacugguacaagaaaggaucaucaauagggaaaauguucgaggcaaccgcacgcggggcgcggaggauggccauacuuggcgauaccgcaugggacuucggaucaguaggcgggguguugaacucgcuggggaaaaugguccaccaaaucuucgggagcgccuacacagcauuauucuccggagucuccuggguaaugaaaauugguauaggcguacuacucaccuggauuggacucaacuccaaaaacaccagcaugagcuucaguugcaucgcgauaggaauaauaacgcuguaccucggcgcggucgugcaagcagacacuggcugcgugaucaauuggaaaggcaaagagcugaagugcggcagcggaauauucguaaccaaugagguccauacuuggacagagcaguauaaauuccaagcggacuccccgaaaagacuagcgacugcaauugccggcgcaugggaaaacggcgucugcggaaucaggagcacaacgcgcauggagaaccugcuauggaaacaaauugcgaaugaauugaauuacauccucugggaaaauaauaucaaauugacggucguaguaggagauaucauuggggugcuggaacaggguaaacggacacugacaccccagccgauggagcucaaauauagcuggaaaaccugggggaaagccaggauaguaaccgcugaaacucaaaacucauccuuuaucaucgauggcccaaauacgccagaaugccccaacacuucacgggcauggaacgucugggaaguagaggacuacggcuucggcguguucaccacuaacauauggcucaaacuucgagaagucuacacacagcugugugaucaucgacucaugagugcagcggugaaagacgaaagggcaguucacgccgacaugggcuauuggauagagagucagaaaaacggaagcuggaagcuggagaaggcuagccugaucgaaguaaaaaccugcacauggccaaaaagccauacccuauggucgaacggcguccuggagucugacaugauaauaccaaagucauuggcgggaccuauaucgcaacacaauuacaggcccggauaccauacccagacagcagggccauggcaucugggcaaacuugagcuggacuucaacuacugcgaagggacaacggugguaaucacggagaacugcgggacucggggaccaagccuucgaacaacaaccgugucuggaaaacuaauacacgaaugguguugcaggagcugcacccuaccaccacuaagauacaugggagaggacggcugcugguacggaauggaaaucagacccauuaacgaaaaagaggaaaacaugguuaaaucccucgucagugcaggcucgggagaaguugacaacuuuacaaugggcguacuaugccuagccauacuauuugaggagguaaugcgggguaaguucgggaagaaacacaugaucgcgggcguguucuucacguucgugcuccuguugagcggccaaauaaccuggcgggacauggcacacacccuaauaaugaucggguccaacgccacagaucgcauggggauggguguaaccuaccuagcacuaauagcuacuuucaaaauucagcccuuccuagcacugggauucuuccugcgcaaauuaacuuccagagagaaucuacuacuagguguugggcuagcgauggcgacaacgcugcaacuucccgaagacauagagcagauggcaaacggaaucgcacuagggcucauggcacucaaacucauaacacaauucgaaaccuaccagcucuggacugcacucauuagccuaacaugcucuaacacgauauucacgcuaaccgucgcauggcguaccgcuacucuuauccuagcaggggucucccuucugcccgucugccaaaguucgucaaugcgaaagacggauuggcugccaaugaccguggcggccaugggaguaccaccccucccccucuucaucuucucucucaaagauacgcugaaaagaaggagcuggccucucaacgagggugucauggcagucgggcuagugagcauccuagcgagcagcuugcugcgaaacgauguaccaauggccggcccguuagucgccgggggcuuauuaauagccuguuacguaaucacgggaacgagcgcugaccuaacaguggagaaagcagcugaugucacaugggaagaggaggcagaacagacaggcguaagccacaacuugaugauaaccgucgacgacgaugggaccaugcgaauaaaagaugacgagacggaaaauauauuaacaguacuacugaagacugcacuucugauagucucaggcauauucccauauucgauacccgccacucugcucguauggcacacuuggcagaagcagacacaaagguccggcgugcuaugggacguccccaguccgccugagacacagaaagcggaauuagaggaaggagucuaucgcaucaagcaacagggcauauucgggaaaacgcaggucggggucggggugcagaaggaggggguauuccacaccauguggcauguaacacggggcgccguacugacauacaauggcaaaagacuagaaccgaacugggcuuccgugaagaaagaccucauuucauauggaggcgguuggcgacucagcgcacaguggcagaagggagaggaaguccagguuauugcaguggagccgggcaaaaaccccaagaauuuccagacaaugccgggaacauuccaaacaacaacaggcgagauaggagcaaucgcgcuggacuucaaaccaggcacaagcggaucaccaauuaucaaccgggaggggaaggucguaggacuguacgggaacggcgucguaaccaaaaauggcggguacgugucuggaaucgcacaaacgaaugcggagccagacggaccaacucccgaauuggaggaagaaauguucaagaaaaggaaccucacaaucauggaucugcacccaggcucggguaagacaaggaaguaucuacccgcuauaguuagggaagcgauaaagcgacgccuaaggacauuaauccuagccccaacgcgagucgucgcugccgagauggaagaagcccucaaaggucuaccgauacgguaccaaacaaccgcaacgaaaucagaacacaccggcagagagauaguggaucugaugugucacgcuacuuuuacgaugagauuacuaucucccguacgugugcccaauuacaauuugauaauaauggaugaagcacacuucaccgacccugccagcaucgcagccagaggcuacauaucaacaagaguaggcaugggcgaagcggcagcgauuuucaugacggcuaccccgccuggaacggcggacgcguuuccccagagcaacgcucccauccaggacgaggaaagagauauccccgagcggucauggaacagcgguaacgaguggaucacagacuucgcagggaaaaccguuugguucguccccagcauuaaggccgggaaugacauagcgaacugccucaggaaaaacggaaagaaagucauccaauuaagccgaaagaccuucgacaccgaauaccaaaagacaaaacugaaugacugggacuuugugguaacgacggacaucucggagaugggcgcgaauuucaaagcagacagaguaauagacccccgaaggugccuuaagccaguaauacucaccgauggacccgagaggguaauccuagccgggccaaugccggucacggcagcaucugcggcacagaggaggggacgggugggacgcaacccucaaaaagaaaaugaccaguacaucuucacgggacagccacucaauaacgacgaggaccacgcccauuggacugaggccaaaaugcuucuagacaauaucaacacacccgagggaaucaucccagcucuguucgaaccggagagagagaaaagcgcggcgauagacggcgaguaccgucugaagggagaaucccguaaaacauuugucgaacuaaugaggagaggagaccugccuguauggcucgcccacaaagucgcguccgaaggcauaaaauacacggauagaaaguggugcuuugacggccaacguaauaaccagauccuggaagaaaauauggaugucgaaaucuggacgaaggaaggggagaaaaagaaacuucgaccccgguggcuagacgcaaggacauacucagacccacucgcccugaaagaguucaaggauuucgcugccgggagaaaaucgaucgcccuagacuuggugacggaaaucgggcgcguccccacacaucucgcucauagaacgagaaacgcucuggacaaccuagucaugcuacauaccagcgaacacggaggaaaagcauaucgacacgccguggaagaguugccugagacuauggagacgcuacugcugcuuggacugaugauucuacucacagggggagcaaugcuauuccucauaagcgguaaagggauagguaaaaccagcauaggacugauaugcgucauagcaagcagugggaugcuguggauggccgaaauaccacuacaguggauugcgucagcuaucguccucgaguucuucaugaugguccuacuuaucccugagccggaaaaacaacgcacgccccaggacaaucaacucgcauauguggucauaggaauccuuacgcucgccgcgauaauagcagccaacgaaaugggccuacuggaaacaaccaagagggaccuaggcaugucaaaagaaccagggguaguauccccgaccuccuaccucgauguagaccugcacccagccagugcguggacgcuauacgcgguggcgaccaccgugaucacaccaaugcuccgccauacuauagaaaauucaaccgccaauguaagccuugcggcaauagcaaaucaagccguuguacuaaugggacucgacaagggauggcccauaucgaaaauggaucuuggggucccucuguuagcgcucgggugcuacucccaagucaacccauuaacgcuaacggccgcaguacuccugcugaucacacauuacgcgaucauaggucccggccuccaagccaaagccacacgcgaagcacaaaagagaacggcagcagggauaaugaagaaccccacaguggacgggaucaugacgauugauuuagacccaguaauauacgauagcaaauucgaaaaacaacuagggcaaguuaugcuccucguacugugcgcaguccagcuguugcuuaugcgcacaucgugggcacuaugcgaagcacugacuuuggcaacgggacccauaacaacccuaugggagggcucaccagggaaauucuggaauacaacgauagcaguaagcauggcaaacauauucagagguuccuaccuagccggcgcaggauuggcguuuucgauaaugaagucugugggaacggguaaacgaggaaccgggagccagggcgagacccucggcgagaaauggaaaaagaaauugaaccaacucucgcgaaaggaguucgaccuauacaagaaaucagggauuaccgaaguagaucgcaccgaggcaaaagaaggauugaaacggggagagaucacgcaccacgcaguaucacgugggagugcaaagcuccagugguuuguggagagaaacauggugauaccggaagggagaguaauagaccuggggugcgguagggguggcuggagcuacuacugcgcuggccuaaagaaaguaaccgaggucaggggauacacuaaagggggacccggacaugaggagcccgugcccaugucgacguacggcuggaauauagugaaacuuaugucaggcaaggauguauucuaccucccaccugagaaaugcgacacuuuauuaugugacauaggggaaaguagucccagcccgacaguagaggagucacguacaauccgcguucucaaaaugguagaaccguggcugaagaacaaccaauucugcaucaaggugcugaauccauacaugcccgccguuaucgagcaccuagagcgguuacaacgaaagcauggaggaaugcuaguccgaaacccccucucgagaaacagcacccacgaaauguacuggaucagcaacggcaccgguaauaucguagccucaguaaacauggucagucgauuacuuuuaaaccgcuucaccaugacucauagaagaccaacaauugaaaaagacgucgacuugggagccggaacccgccacgugaacgccgagcccgagacccccaacauggauguuauaggagaacgaauaaaacguauuaaagaagaacacaacagcaccuggcacuacgacgaugagaacccauacaaaaccugggccuaccacggaucauacgagguaaaagccacgggcucagcgagcuccaugauaaauggaguagugaaacuccugaccaagcccugggauguagucccuauggucacacaaauggccaugaccgacacaaccccuuucggucagcagagaguauucaaagaaaaaguagacacucggacaccacguucaaugccaggaaccaggcgggugauggaaaucacugcagaauggcuauggcggacucuaggacggaacaagaaacccagacuaugcaccagagaagaguucacaaagaaagugcgaacaaacgcggcaaugggagccguauucacggaagagaaccagugggacucggccaaagcggcagucgaagacgaagacuuuuggaaauugguagacagagagcgcgaacuacauaagcuaggaaaaugcgggaguugcguguacaacaugaugggaaaacgcgagaagaagcucggcgaguucgguaaggcgaaagggagcagagcaauuugguacauguggcucggcgcccgguaccuggaguucgaggcccucggauuucuaaaugaggaccacugguucagcagagagaacagcuacucgggcgucgaaggggaggggcuacacaagcucgguuacauacuacgagauaucucgaaaauaccugguggugccauguaugcagacgacacggcaggaugggacacacguauaaccgaagacgaucuacauaacgaagagaagauaacccagcagauggaccccgaacacagacagcucgcaaacgcgaucuucaagcuaacguaccagaauaaagucguaaagguccaacgacccaccccgacggggacaguuauggauaucaucaguagaaaagaccagcgcggaaguggacagguugguacuuauggucucaacacuuucacaaacauggaggcccagcucauccgucaaauggaaggcgagggcguacuuucgaaagcugaucuggagaacccgcaucugccugagaagaaaauaacacaauggcuggaaacaaaaggaguugagagacugaaacggauggcaauaagcggagaugacugugucgugaaaccgaucgacgaccgauucgcgaacgcacuacuagcacucaaugacauggguaaaguccggaaagauauaccacaauggcagccuucaaaaggcuggcacgacuggcaacaagucccauuuuguagucaccacuuccacgagcucauaaugaaagacgggagaaaacuggugguacccugccggccucaagacgaacugauugggcgagcgcguauuagccagggggcaggcuggucccugagagaaacugccugcuugggaaaagcauacgcccaaauguggucuuuaauguacuuucaucgccgggaucuacgccucgcuucuaacgcuauuugcuccgccguaccaguccauuggguaccaacaagucgaaccacguggucaauacacgcgcaccaucaauggaugaccaccgaagauaugcuuacuguauggaaccgcguguggauugaggacaauccauggauggaggacaaaacacccgucacaacuugggaaaacgugcccuaucuagggaagcgugaagaucaauggugcgggagcuugaucgggcugacuucaagggccacgugggcacaaaauauccccacagcuauacaacaaguuagaucgcuuauagguaacgaagaauuucucgacuacaugcccucaaugaaacgcuuucgaaaggaagaagaaagcgaaggggccauaugguga

SEQ ID NO: 26081 - RNA, 9873 nt, Artificial Sequence
  derived and/or modified CDS sequence (opt11) from DENV-3__FJ850111__SS-prME
acgagccucugccucaugaugauccugcccgccgccuuggcguuccaccuuaccagccgggacggcgagccccggaugaucguggggaagaacgaacgcggcaagucgcugcuguuuaaaacagccuccgggaucaacaugugcacguugauugccauggaccucggcgagaugugcgacgacacugucaccuacaaguguccccauaucaccgaaguugagcccgaggacaucgacugcuggugcaaccugaccagcaccuggguuaccuacgggacgugcaaccaggcgggcgaacaucggcgagacaagcguuccgucgccuuagcgccccacgugggaauggggcuggacacacguacacaaaccuggaugucagccgagggugccuggcgccaaguggagaagguggaaacuugggcccugcgccacccgggauucaccauuuuagcacuguuucuggcccacuacaucgguacgucccuaacccagaaggugguaaucuucauccuacugauguuaguaacgcccagcaugaccaugcgcugcguggggguggguaaccgcgacuucgucgagggccuguccggggccacuugggucgaugugguccuggagcauggagggugugugaccacgauggccaagaacaagcccacccuggacaucgaguuacagaagaccgaggcaacgcaacuggcgacgcuccggaaacugugcauagaaggcaagaucaccaauaucacgaccgacucuaggugccccacgcagggcgaggcagugcugccggaggagcaggaccaaaauuacgucugcaagcauacuuacguggaccggggauggggcaaugggugcggccucuucgggaagggcucccuugugacuugcgcgaaauuucagugccuggagccuaucgagggcaaagucgugcaguacgagaaccuaaaguacacagugauaaucaccguccacacuggggaccagcaucaggugggcaacgagacccagggggucaccgcugagauaaccccgcaggcuucuaccacagaggcgauccugcccgaguacggcacacuggggcucgaguguuccccgaggaccgggcuggacuucaacgaaaugauccuucucacaaugaagaacaaagccuggauggugcacagacagugguucuucgaccugcccuuacccuggaccucuggcgccaccacagaaacgcccaccuggaauaggaaggaacugcuggugaccuucaagaacgcacaugcgaagaagcaggaagucguggugcuggguucccaggagggcgcgaugcacacggcgcuuacgggggccaccgagauccagaacaguggcgguaccucuaucuucgcgggccaccugaagugccgacugaagauggauaaacuagagcucaagggcauguccuacgcuaugugcaccaacacuuucguacugaagaaggaggugucggagacccagcacgggaccauccucaucaagguagaguacaagggcgaggacgucccgugcaagauacccuucagcacugaggacgggcagggcaaagcgcacaacggccgccugaucacggccaaccccgugguuacgaagaaggaggagccagucaacaucgaggccgagccacccuuuggggagagcaacaucgugaucggcaucggagacaacucacugaagaucaacugguacaagaaggggucaucuauugggaagauguuugaggccaccgcucggggcgcccgccggauggccauccugggcgauacggccugggacuucggcucugugggcgggguccucaacuccuuaggaaagauggugcaccaaaucuucgggagcgccuacacggcguuauuuuccggcguaagcugggucaugaagaucggcaucggagugcuccugaccuggaucggacugaacuccaagaacaccagcaugucguucucgugcauagccauagggauuaucacucucuaccugggcgccguuguucaggccgacacggggugcgugaucaacuggaagggcaaggagcugaagugcggcuccgguaucuuugugaccaacgagguccacaccuggacggagcaguacaaauuucaggcagacagccccaagcgccucgcgacggcgaucgccggcgccugggaaaauggcguguguggcauucguuccaccaccagaauggaaaaccugcuguggaagcagaucgccaacgagcucaauuacaucuugugggagaacaacaucaagcugaccguggucgugggggauaucaucggcgugcucgaacagggcaagcgcacucucacgccccagccgauggaguugaaguacagcuggaaaaccugggggaaagcgcggaucgugaccgccgagacgcagaacucuagcuuuaucaucgacggcccaaauacccccgagugccccaacaccucccgugccuggaacgugugggagguggaggacuacggguucggcgucuucacuaccaacaucuggcuuaaacuucgcgagguguacacgcagcugugcgaccaccgccuuaugagcgcagccgugaaggacgagcgagccguccacgccgacaugggcuauuggaucgagagccagaagaacggguccuggaagcuggagaaggcgagccugaucgagguaaagaccugcaccuggccaaagucccacacccucuggagcaacggcgugcuggaguccgauaugaucaucccgaaaagccuggcagggcccaucucccagcauaacuaccgaccgggauaccacacgcagaccgcggggcccuggcacuuaggcaaacuugagcuggacuucaauuacugugaggguaccaccguugugaucacggagaacugcggaacccgcggccccagccuccgcacgaccacggucucugggaaacuuauccacgaguggugcuguagaagcugcacccugccuccacuacgcuacaugggcgaagacgggugcugguauggcauggagauccgaccuaucucugagaaagaggagaacaugguaaagagccuggugucggccgguagcggggaagucgacaacuucaccaugggaguucugugucucgccauacucuucgaggaggucaugcgcggcaaauuugguaagaagcacaugaucgccgggguguucuuuacguucguccuguugcuguccggacaaaucacguggcgagacauggcccacacccuaaucaugaucggcagcaacgcgaccgaccgcauggggaugggcgugaccuaccucgcccugaucgccacauucaagauccagcccuuucucgcccugggguucuuccugcggaaguuaaccucucgcgagaaccuccugcugggugugggccucgccauggcgacaacacugcagcugcccgaggacaucgagcaaauggccaacgggaucgcgcuaggccugauggcgcugaagcuaaucacucaguucgagaccuaucaguuauggaccgcgcugaucucuuuaaccugcagcaauacaauauucacccugaccgucgccuggcggacagccacgcugauccucgccggggugucccuccugccggucugucagagcuccucgaugaggaagaccgacuggcuccccaugacuguggcugcgaugggcgugccgccucucccguuguucaucuuuucccucaaggacaccuuaaaacgccgcagcuggcccuuaaacgaaggggucauggcugugggccucguguccauccuggcgagcagcuugcuacgcaacgacgugccuauggccggcccgcugguggcuggaggccugcucaucgcguguuacgugaucacgggcaccuccgcggacuuaaccgucgagaaggcggccgacgugaccugggaggaggaggcagagcagacuggcgugucccacaaccugaugauuaccgucgacgaugacgggacaaugcggaucaaggacgaugagacggagaauauauugaccgugcuacugaagacggcucuccugaucgugaguggcaucuucccguacuccauacccgccaccuugcucgucuggcacaccuggcagaagcagacccagcgcagcggcguauuaugggaugugcccagcccaccggagacgcagaaggccgagcuggaggaagguguguaccggauuaaacagcagggcaucuucggaaaaacccaagugggcgugggcguccaaaaagaaggcguguuccacacuauguggcacgugacccggggugccguccuuaccuacaacgggaagcggcuggagcccaacugggccagcgugaagaaggacuugaucuccuacggaggaggcuggcgccucagcgcgcaauggcagaagggggaggaggugcaagucaucgcgguggagcccggcaaaaaccccaagaacuuccaaaccaugcccggcacguuucaaaccacuacuggagaaaucggggcuaucgcucuggacuuuaagcccgggacgucagggagcccgaucauaaaccgggagggcaagguugucggccuguacggcaacggggugguaaccaagaauggcggguaugucucaggcaucgcacagacgaacgccgagccggacggccccacccccgagcuggaggaggagauguuuaagaagcgaaaccucaccauuauggaccugcaucccggcagcgggaagacccgaaaguacuugccggcuauugugcgcgaggcgaucaagaggcgacuccggacgcugauucuggcccccacccgcguugucgcggcggagauggaagaggcccucaaggggcugcccaucagguaccagaccaccgccaccaaguccgaacacaccggccgcgagauaguggaccugaugugccacgccaccuucaccaugcggcuccugucccccgugcgcguaccgaacuacaacuuaauaauaauggaugaggcccacuuuacggaccccgccagcaucgccgcccgggguuacaucuccacccgcguaggcaugggcgaggccgcggcgaucuucaugaccgccacgccacccggcacggcggaugcguucccgcaguccaacgcccccauacaggacgaggaacgcgacaucccugagcggaguuggaacucuggcaaugaguggauaaccgacuucgcagggaagacugugugguucgucccuuccaucaaggcaggcaacgacaucgccaauugccuccgcaagaauggaaagaaggugauccaacugagccggaaaaccuucgacacagaguaccaaaagaccaagcugaacgacugggacuucgugguuaccaccgacaucucagagaugggcgcgaacuucaaggccgacagggugauugacccucggcgcugccucaagccggugauccugaccgacggcccagagcggguuauccuggcggggccuaugccugugacggcggcaucagcggcccagcgccgggggcgcguggggcggaacccucaaaaggaaaacgaccaguacaucuuuaccggccagccccucaacaaugacgaggaccacgcucacuggaccgaggcuaagaugcugcuagacaacauaaacacgccggaagggaucaucccggcccuguucgagccagaacgcgagaagagugcugccaucgacggagaguaccgccuuaagggagaaagccgcaagaccuucguugaguuaaugcggcgcggggaucuucccguguggcuggcccauaagguggcauccgagggcauuaaauauacagacagaaaguggugcuucgacgggcagagaaacaaccagauccuagaagagaauauggacguggagaucuggaccaaggagggcgagaagaaaaaguuacguccgcgcuggcuggacgcgcgcaccuacucugacccguuggcccucaaagaguucaaagacuuugccgcagggaggaagucaaucgcccuggaccugguuacggaaaucgggagagucccaacucaccuagcgcaccggacccgcaacgcccuggauaauuuggucaugcuccacacuagcgaacacggcgggaaggccuaccggcacgccguagaggaacugccagagacgauggagacccugcuccugcucggacucaugauccugcugaccgggggcgccaugcuguuccucauuaguggcaaggggaucggcaagaccucuaucgggcugaucugcgucaucgcgagcuccggcaugcucuggauggcagagaucccgcugcaguggaucgcaucagccaucguguuagaguucuucaugauggugcuccugaucccugagcccgagaagcagcgcacgccucaggacaaccaacuggccuacguggugauaggaauccucacccuggcggccaucaucgccgcgaacgagaugggccugcucgagacuaccaagcgcgaccugggcauguccaaagagccagggguggucucccccacguccuaccuugacguggaccugcaucccgccagcgcguggacccuguacgccguagcuacaacagucauaacgccgaugcugcgccacacgaucgagaacuccaccgccaaugugagccucgcggccaucgcgaaccaggcugugguccugaugggccuggauaaggguuggccgaucuccaagauggaucucggggugccccuguuggcccucggguguuacagccaggugaacccccuuaccuuaacggcggccguccuccugcugaucacacacuacgcgauaauugggcccggacuccaggccaaggccacccgggaagcgcaaaagcgcacggccgccgggaucaugaagaacccgacgguagacgggauaaugaccauagaucuggacccagucaucuacgacucgaaauuugagaagcaguuggggcaggucaugcucuugguccuaugcgccgugcaacugcugcugaugcggaccucaugggcacucugcgaggcgcugacacuugccaccggccccaucaccacccucugggagggcucccccgggaaguucuggaacacaacuauugcugucaguauggccaacaucuuccgcggcagcuaucuggcgggggcaggccuggccuucagcauuaugaaaucaguggggacgggcaagcgcggcaccgggagccagggcgagacccucggggagaaguggaagaaaaagcugaaccagcugucccgcaaggaguucgaccucuacaagaaguccggcaucacugagguagaccggacggaggccaaagagggucugaagcgcggcgagaucacccaccacgccgugagccggggauccgcgaagcugcagugguucguggagcgcaacauggugaucccggaggggagagucaucgaucucggcugugggagaggcggguggagcuacuacugugcgggcuugaagaaggugacggaggugcggggguacacaaagggcggccccgggcacgaggagccgguaccuauguccacuuacggcuggaacaucgugaaguuaaugagcggaaaagacguauuuuaccucccgcccgagaagugcgauacccuucugugcgauaucggcgagaguagccccucccccacuguugaggaaagucgcaccauccgcguacugaaaaugguggaacccuggcugaaaaacaaucaguucugcaucaagguccugaaccccuacaugccggcggugaucgaacaccuggagcgucuccaacgcaagcacggcgggaugcugguacggaacccgcugucuagaaacagcacgcacgagauguacuggaucucaaacggcaccgggaacauagucgccucggugaacauggugucccgacuccuguugaaccgauucaccaugacgcaucggcgcccgacgaucgagaaggauguugaccucggcgcaggcacucggcaugugaacgcggagcccgagacccccaacauggacgugauaggggagagaaucaagaggaucaaggaggagcacaacagcaccuggcacuacgacgacgagaauccguacaaaacgugggccuaccacggcuccuacgaggucaaagccacuggguccgccuccagcaugaucaacggcguggucaagcugcugaccaagccgugggacgucgugcccauggucauacagauggcuaugaccgacacuaccccauucggccaacaacgcguguuuaaggagaaaguggacaccagaaccccgcgcuccaugcccggaaccaggcgcgucauggagaucaccgcggaauggcucuggagaacgcucggccgcaacaaaaagccccggcugugcacccgcgaggaguucacgaagaaggugcgcacgaacgccgccaugggggccguguucaccgaagagaaccagugggacagcgcaaaggcagccgucgaagacgaggacuuuuggaaacucguggaccgggagcgcgaauuacacaagcugggcaaaugugguagcuguguauacaacaugauggguaagcgggagaagaagcucggggaguuuggcaaggcuaagggcaguagggccaucugguacauguggcugggggcgcgguaccuggaguuugaggcacucggcuuccugaacgaagaucacugguucagccgggaaaauuccuauagcggggucgagggcgaagguuugcacaaacuuggcuacauacuucgggacaucuccaagauccccggcggggccauguacgccgacgacaccgcaggcugggauacgcguaucaccgaagacgaccugcacaacgaggagaaaauaacccagcagauggacccggaacaucggcaguuggcgaaugccauauucaaacugaccuaccaaaacaagguggugaaagugcaaagaccaacacccacugguaccgugauggacauaaucagccggaaagaccagcgcggcuccggucaggucgggaccuacggccugaacaccuuuacgaacauggaggcgcagcugauaagacaaauggaaggggaaggcguacugagcaaggccgaccucgagaauccccaccucccggagaagaaaaucacccaguggcuggagaccaagggcguggagcgacugaagcggauggcuaucaguggcgacgacugcguggucaagcccaucgacgacagauuugcgaacgcccuucuggcccugaacgacaugggaaaggugcguaaggacauuccgcaguggcagcccagcaagggcuggcacgacuggcaacaggucccguucugcucccaccacuuccacgagcuaaucaugaaggacggccgcaagcuggucgugccauguagaccccaggacgagcugaucggccgcgcgcggaucagccagggggcgggguggucccuccgcgagacagccugccugggcaaggcuuacgcccaaauguggagucugauguacuuccaccgccgggaccuccgccuagccuccaaugcgauaugcagcgccgugcccguccacugggugccgacgucucggaccaccuggagcauacaugcccaucaucaauggaugaccacggaggacaugcugaccguguggaaccgugucuggauugaggacaaccccuggauggaggacaaaacgcccgugaccacuugggagaacgugcccuaccucggcaagcgggaggaccaguggugcgggucccugaucggccuaaccucucgcgccaccugggcccagaacaucccaaccgcgauucagcagguccggagcuuaauuggcaacgaagaguuccuggacuacaugccguccaugaagcgcuuucggaaggaggaagagagugagggcgccauuugguga

SEQ ID NO: 26082 - RNA, 9873 nt, Artificial Sequence
  derived and/or modified CDS sequence (opt11) from DENV-3__KF955486__SS-prME
accagccucugccucaugaugauccugccggccgcccuggcguuccaccucacuagccgugacggcgagccccggaugaucguaggaaaaaacgaaaggggcaaaagcuugcuguuuaaaacugccucugggaucaacauguguacccucauugccauggaccugggcgaaaugugcgacgacaccguaaccuacaaauguccacacauuacggaaguggagccggaagacaucgauugcuggugcaauuuaaccagcacuugggugacauaugggacaugcaaccaggcaggcgagcaucggcgcgauaagcggagcgucgcccuugcgccacacgugggcauggggcucgauacccgcacccagaccuggaugucggccgagggcgccuggcgccagguggagaaggucgagacgugggcacugcgacacccgggguucaccauccucgcacuguuucuggcccauuacauaggcacuucuuugacgcagaagguggucauuuucacgcugcugaugcuugucacccccuccaugaccaugcggugugucggggucgguaaccgcgacuucguggagggucuuuccggggccacuuggguggacguaguccuggagcacggcgggugcgugacgacgauggcuaaaaacaagcccacccucgacaucgaacugcaaaaaaccgaggcgacgcagcuggcgacccuccgaaagcuuugcaucgaagggaagaucaccaacauaacaacggacagccgcugccccacccagggagaggccgugcugccugaggagcaagaucagaauuacgucugcaagcauaccuacguggaccggggguggggcaauggcugcggccucuucgggaagggcucccuggugaccugcgcuaaguuccaguguuuagagcccaucgagggcaaggucguacaauacgagaaccucaaguacacggucaucaucaccguccacaccggggaccagcaccagguagguaacgagacucaaggggucaccgccgagauaacgccccaagcuagcacgaccgaagcgauccugccugaguacggcacacugggguuggagugcagcccgcggacuggccuggacuuuaaugagaugauccuucucaccaugaagaacaaagcguggaugguacaucggcagugguucuucgaccugccccugccauggacgagcggcgccaccaccgagacgcccaccuggaaucgcaaagagcuccugguaacauuuaaaaacgcccacgcgaaaaagcaggaggucgucgugcuggguucgcaagagggcgcgaugcauacggcgcuuaccggcgccaccgagauccagaacagcggugggaccuccauauucgccgggcacuugaagugcaggcuaaagauggacaagcuugaacugaagggcaugagcuacgccaugugcacgaacacauucguccugaaaaaagaaguaagcgagacccaacacgguaccauccuaaucaaaguggaguauaagggcgaggaugucccguguaagauacccuucaguacggaggacgggcaaggcaaggcccacaacggccgccugaucacagccaaccccgugguaaccaagaaggaagagcccgucaacaucgaggccgagccgcccuucggggaaucgaacaucgugaucggcaucggagacaacgcgcucaaaaucaauugguacaagaagggcuccucgaucgggaagauguuugaagcgacugcccggggcgcccgcaggauggccauccucggcgacacggcuugggacuucggguccgucggcggagucuuaaauagcuugggcaaaauggugcaccaaaucuucggguccgcguacacggcccuguuuagcggcgucuccuggguuaugaagaucggcaucgggguacugcugacguggaucggucugaacagcaagaacaccuccaugucauucuccugcaucgccaucggcauaauaacgcucuaccucggcgccguuguccaagccgacaugggaugcgugaucaacuggaaagggaaggagcugaaguguggcagcgggaucuucgugacaaacgagguccacaccuggaccgagcaguacaaguuucaggcggacucccccaaacgccucgccacggcaaucgccggugccugggagaacggugucugcgggauccgcaguacuacucggauggaaaaccugcuguggaagcagauugcgaaugaguugaauuauauucugugggagaacaacaucaagcugaccguggucguuggcgacaucauuggcgugcucgagcagggcaaacgcacguugacgccucagccaauggagcugaaguacuccuggaagacgugggggaaggccaagaucgucacugcggagacgcaaaacagcucguucaucauugacgguccuaacacccccgaaugccccucggcgagcagggcauggaacgugugggagguggaggacuauggcuucggcgucuucacaacuaauaucuggcuuaagcugcgggaaguguacacacagcuuugcgaccacagacucaugagugccgccgugaaggacgagcgcgccguccacgccgacaugggcuauuggauugaaucgcagaagaauggguccuggaagcuggagaaggcgucacugauugaggucaaaacgugcacguggccgaaaucgcacaccuuguggagcaacggggugcuggaguccgauaugaucauaccaaaguccuuagccggcccgaucucccagcauaacuaccguccgggcuaccauacucaaacggcugggcccuggcaccucggcaagcuggaacucgacuucaacuauugugagggcaccacuguugugaucacagagaacugcgggacccgcggacccucccuccggacgaccacgguguccggcaaauugauccacgaauggugcugcagaucuugcacguugcccccguuacgguacaugggcgaggacgggugcugguauggaauggagauccgccccaucagcgagaaggaggaaaauauggucaaaagccuuguauccgccggcagcggggagguggacaacuuuacaaugggcguacuuugccucgccauccuguucgaggaaguuaugcggggcaaguucgggaagaaacacaugaucgcagggguuuucuucaccuucguucuccuccucucagggcagaucaccuggagggacauggcccacacucugauaaugaucggcagcaacgccucggaucggauggggaugggugugacguaccucgcgcucaucgccacuuucaagauccagccauuccuugcguugggguucuuccucaggaaacugaccucuagggaaaaccuacuacucggcguaggccucgccauggcuaccacccugcaacugcccgaggacauagagcagauggcgaacgggauagcgcucggccugauggccuuaaagcucaucacccaauucgagacauaccagcuguggacugcccuaaucagccugaccugcucuaacaccaucuucacgcugacuguagccuggcgaaccgcaacacugauccucgcgggugugagccuucugcccgucugccaguccucauccaugcgaaaaaccgacuggcuccccaugacgguggccgcuaugggcgugccgccccucccgcuguuuauuuuuagcuugaaagacacccugaagcgcagguccuggcccuugaacgagggggucauggcagugggcuuagugucgauauuggccuccucccucuuacguaacgacgucccaauggcgggcccgcugguagccgggggacugcucaucgcgugcuacgugaucacgggcaccuccgccgacuuaacggucgagaaagccgcugacgugaccugggaggaagaggcagagcagaccggagugagccauaaccugaugaucaccgucgacgacgacgggacgaugcgcauuaaagaugaugagacggagaacauccucaccgugcucuugaagaccgcccugcuuauaguguccgggaucuucccguacagcauccccgccacccuguuaguauggcauacuuggcagaagcagacccagcgguccggcgugcuuugggaugugcccagcccacccgagacccagaaggccgagcuggaggaggggguauaccgcaucaagcaacagggaaucuuugggaagacucagguggguguggggguccagaaggaggguguguuccauacgauguggcaugugacccgaggcgccgucuuaaccuacaacgggaaaaggcuggagcccaacugggccucuguuaagaaagacuugaucagcuacggcgggggcuggcggcucagugcccaguggcagaagggggaagaggugcaggucaucgcaguggaacccggcaagaaucccaaaaacuuccagaccaugcccggcacguuccagaccaccaccggagagauaggcgcuaucgcgcuggauuucaagccugggacgagcggcaguccuaucaucaacagggaggguaagguggucggucuguacggcaacggggucgugacgaagaacggcggguacguauccggcaucgcgcagaccaacgccgaaccggacggccccaccccugaguuagaggaggagauguucaaaaagcggaaccucacgaucauggaccuucauccaggaucgggcaagaccaggaaguacuuaccggccaucgugcgggaagcgauaaaacgccgccugcgcacccugauccuggcgccgacccggguagucgccgccgaaauggaggaagccuugaaagggcuccccauccguuaccagaccaccgcgacaaaguccgagcacacaggccgggagaucguggaccugaugugccacgccaccuucaccaugcgacucuugucuccagugcgggucccuaacuacaaccucaucaucauggacgaggcccacuucaccgaccccgcgucaaucgccgcgcgggguuacaucagcacccgggugggcaugggcgaggccgcagcuaucuucaugacggcgacuccgcccgggacggccgacgccuucccgcaguccaacgcccccauccaggacgaggaaaaggauauccccgagcgaagcuggaacuccgggaacgaguggaucaccgauuucgcagggaaaacggugugguuugucccaucgaucaaggcggggaacgacaucgccaacugccuccgcaaaaacgggaagaaggugauccagcugucccggaagacauucgacacugaguaccagaaaaccaagcugaaugacugggacuucguugugacgaccgacaucagcgagaugggagcaaacuucaaggcggaccgcgugaucgacccgcggcgcugccucaaacccgugauccugaccgauggccccgagcgggucauacuggccggccccaugccggugaccgcggccagcgccgcccaacguagaggucgcguagggagaaacccccaaaaggagaacgaccaguacaucuucaccggccagccccucaacaacgaugaggaccacgcgcacuggacggaggcgaagaugcuccuggacaacauuaacaccccugaggggauuauccccgcacucuucgagcccgagagggagaaguccgccgcgauagacggcgaauaccggcuuaagggagaguccagaaagaccuucguugaacuaaugagacgcggggacuuacccguguggcucgcgcacaaggucgccagcgagggcaucaaguauaccgacagaaagugguguuucgacggacagcgaaacaaccagauacucgaggagaacauggacguggagaucuggacgaaggagggcgagaagaagaagcuccggccgcgcuggcuggacgcaaggacauacuccgacccgcuggcacuuaaggaguucaaggacuucgcagcgggccgcaaaagcaucgcccuggaccugguuaccgagaucggccgcgucccuacccaccuagcgcaccggacgcgcaaugcauuagacaaccuggugaugcuccacacguccgagcauggcgguaaggccuaccggcacgcuguagaggaguugcccgagaccauggagacccugcuccugcucggccuuaugauccugcugaccgguggggcaaugcuguuccugaucuccgggaaggggaucggcaaaacuuccaucgggcugauuugcgucauugcguccagcggcaugcuauggauggcggagaucccgcugcaauggaucgcguccgcgaucgugcuggaguuuuuuaugauggugcuucugauccccgagccagagaagcagcgcacgccacaggauaaccagcuggccuacgucgugaucgggauccuuacgcucgccgccaucauagcggcgaacgagaugggccuccucgaaacgaccaaacgggaucugggcaugucgaaagaaccggggguaguaucgccgacuagcuaccuagacguggaccugcacccagcuuccgccuggacccuguacgccguugccaccaccgucaucacccccaugcuacgccacaccaucgagaacuccaccgcuaacguuucguuggcagcuauagccaaccaggcgguaguccugauggggcuggauaaaggguggccaaucuccaaaauggaccucggcgugccccugcuggcucucgguugcuauucccagguaaacccccugacauugaccgccgccguccuccugcugaucacgcacuacgccaucaucggccccggccugcaagcgaaggcaacgagagaggcccagaagcgcaccgcugcugggaucaugaagaacccgacuguggacggcauaaugacaauugacuuagaccccgugaucuacgacucgaaguucgagaagcagcuagggcaggucaugcuccuggugcugugcgcggugcaauugcuucugaugcggacguccugggcccucugugaggcccucacccuggccaccggacccaucaccacgcugugggagggcucccccgggaaguuuuggaacaccaccaucgcggucuccauggccaacaucuuccgggguaguuaccuggcaggggccggguuggccuucuccaucaugaaguccguggggaccggcaagcggggcacugggucccaaggagagacgcucggugaaaaauggaagaagaagcugaaucagcuuagccgcaaagaguuugaccucuacaagaaguccgggaucaccgaaguggaucggaccgaggcgaaggaagggcugaagaggggggaaauaacccaccacgccgucucccggggaagcgccaaguugcagugguuuguggagaggaacaugguaauccccgaggggcgggucaucgaccuuggcugcgggcgcggcgggugguccuacuacugugccggccugaagaaggucacggaggugagaggcuacacaaagggcgggcccgggcacgaagagcccguccccaugagcacuuauggauggaauaucgugaagcugauguccgggaaggacguauucuaccucccgcccgagaagugcgacacccugcugugcgacaucggcgagucgagcccgagccccacgguagaggagucacgaaccauccgggugcugaaaaugguggagccguggcucaagaacaaucaguuuuguauaaagguccugaaccccuacaugcccaccgugaucgagcaccuggagcgcuuacagagaaagcacggcgggaugcuggugcguaacccccuuagccgaaauuccacgcaugagauguacuggaucagcaacgguaccgggaauaucguggccucaguaaacauggucagccggcuccucuugaaccgcuucaccaugacucaccggcgcccgacgauagaaaaggauguugaccucggcgcaggcacacgucacgugaacgccgagcccgaaaccccuaacauggacgugauaggggaacgcauuaagcguaucaaggaggagcacaacucaaccuggcacuaugacgaugagaacccauauaagaccugggccuaccaugguagcuacgaggucaaggcuacgggguccgccagcuccaugaucaacggcguggucaagcugcugaccaagcccugggacguggugcccauggucacccagauggccaugaccgacacgacucccuucgggcagcagcgcguguucaaggagaaaguggauacacgcaccccgcgcagcaugcccggcacccgccgggucaugggcaucaccgcggaguggcucuggcggacacucgggcgcaacaagaagccccgguugugcacccgcgaggaguucaccaagaaggugagaaccaaugccgccaugggcgcuguguucacggaggagaaccagugggauagcgcgaaggcggccguugaggaugaagauuuuuggaagcucguagaccgcgagcgggaguuacacaagcuggguaaaugcgguuccugcguguacaacaugaugggaaagcgggagaagaagcucggcgaguucgguaaggccaagggaagcagggcgaucugguauauguggcugggcgcccgguaucuggaguucgaagcccugggcuuccugaacgaggaccacugguucucccgggaaaauagcuacuccggagucgaaggagagggccugcauaagcucggcuacauucuuagggacauuagcaagauacccggaggcgccauguaugccgaugacaccgcggggugggacacgcggaucaccgaggaugaccugcacaacgaggagaagaucacccaacagauggauccggagcaccggcagcuagccaacgccaucuuuaagcugaccuaccagaacaaggugguaaagguccagcgccccacucccacuggcaccgugauggacauuaucucccguaaggaccagcgcggcucgggacaggugggcaccuacgggcucaacaccuuuacuaacauggaggcccagcugauccggcagauggagggcgagggggucuuaucuaaggcggacuuagagaacccccaucucccggagaagaaaaucacacagugguuagagacgaaaggcguggagcgcuuaaagcggauggcgaucagcggcgacgauugcguggugaagcccaucgaugaccgcuuugccaacgcccuccuggcccugaacgacauggguaaggugcggaaggacaucccccaguggcagcccucaaagggcuggcacgacuggcagcagguccccuucugcagccaccacuuccacgagcucaucaugaaggacgggcgcaaacuggucgugcccugucggccccaagacgaacugauaggucgcgcucgaauaucccagggagcgggguggucgcuacgcgagaccgcuugccugggcaaggccuaugcccagauguggagucugauguacuuccacagacgcgaccuacgccuggcgucaaacgccaucuguuccgccgugccgguccacugggucccgacaagccggaccacgugguccauccacgcccaucaucaauggaugacaacggaggacauguugaccguauggaaccgcgucuggaucgaggacaaccccuggauggaggacaaaaccccgguuaccacgugggaaaacgugccguaccucgggaagcgggaggaccaauggugcggcagccugauaggccugaccucccgcgccacaugggcgcaaaacaucccgacggccauccagcagguacggucuuugaucgggaacgaggaauuccuggacuacaugccaagcaugaagcgcuuccguaaggaggaggaauccgagggugccauuugguag

SEQ ID NO: 26083 - RNA, 9873 nt, Artificial Sequence
  derived and/or modified CDS sequence (opt11) from DENV-3__FJ898468__SS-prME
accagcuugugccucaugaugauccugccagccgcccuagcauuccacuugacuucccgggacggggaaccccgaaugaucguggggaagaacgagcgcggcaagucucugcuguuuaaaacggccuccgggaucaacaugugcacccucaucgccauggauuugggagagaugugugacgacacugugaccuacaagugcccccacaucacggaaguggaacccgaagauaucgacuguuggugcaaucugaccagcaccugggugacauacggaacgugcaaucaggccggcgagcaucggagggacaagcguuccguggccuuagcgccccacgugggcaugggguuggacacacgcacccagaccuggaugagcgccgagggcgccuggcgccaaguagagaagguggagacaugggcccugcgccauccgggcuucaccauccucgcacuguuccuggcccacuacauaggcacaucccucacccagaagguugugaucuucauccuccugaugcucgucacccccucaaugaccaugcggugcguaggggugggcaaccgcgacuucguagagggcuuguccggggccaccuggguggacgugguccuggagcacggcgggugugugacgacgauggccaagaauaagccaacccucgacaucgagcugcagaagaccgaggccacccagcuggcuacccugcgcaagcugugcaucgagggcaagauaacaaauauuaccaccgacagccgcugccccacacaaggugaggccguccugccggaggaacaagaccagaacuacgucugcaagcacacauacguggaccggggguggggaaacgggugcggucuauuugggaaaggcucacuggugaccugcgcuaaguuccaaugccuagagcccauagagggcaagguagugcaauaugagaaccucaaauacaccgucaucaucacggugcacaccggggaccagcaccaggugggcaacgagacgcaagguguuaccgccgagaucacgccacaggccucaacaaccgaagccauccugcccgaauacggcacccuggggcucgaguguuccccgcguaccggccuggauuucaacgaaaugauccuguugacgaugaagaacaaggccuggauggugcaccgacagugguucuucgaccugccacugcccuggaccagcggcgcaaccaccgagacccccacuuggaaccgcaaggaauugcuggugaccuuuaagaacgcccacgccaagaagcaggaggucguugugcuggggucccaggagggcgcgaugcacaccgcgcucacgggggccaccgagauccaaaauucaggggggaccaguaucuuugccggccaccugaagugccgacuuaagauggacaaacucgaacugaagggcaugagcuacgccauguguaccaacacguucguccugaagaaggagguguccgagacccagcacgggaccauacucaucaagguggaauacaagggcgaggacgucccgugcaagauccccuucucgaccgaggaugggcaaggcaaggcgcacaacggccgcuuaauuacggcaaaucccgucguuaccaagaaagaggaacccgucaacaucgaggccgagccgccauucggugaaucgaacaucgugaucggcauuggagauaacgcccuaaagauuaacugguauaagaaaggcuccagcaucgggaaaauguucgaagcgaccgcccggggagcccgccgaauggccauccugggcgacaccgccugggacuucggauccgugggcggggucuuaaauucacugggaaagauggugcaccagaucuuuggguccgcguacacggcccuguucuccggcgucaguugggucaugaagaucggcauagggguauuacugacguggaucggccugaacagcaagaacacaucaaugucauucuccuguaucgcaaucgggaucauaaccuuauaccugggggcggugguccaggccgauauggggugcguuauuaauuggaagggcaaggagcuuaagugugggagcgggaucuucgucacgaacgagguccacacguggaccgagcaguacaaauuccaagcagacucccccaaacgucucgccaccgccaucgccggcgccugggaaaacggggugugcggaauccgcagcacgacccggauggaaaacuugcuguggaagcagaucgcgaacgaguuaaacuacauccugugggaaaacaacaucaagcugaccguagucguuggggacguaaucggcgucuuagagcaaggcaagcgcacccugacgccccagccgauggaguugaaguacuccuggaagacauggggaaaggccaagaucgucaccgcggagacccagaacagcucguucaucauagacgggcccaacacgcccgagugccccagcgccucacgagccuggaacguuugggaggucgaggacuauggguuuggagucuucacuaccaacauauggcuuaaauuacgcgagguguacacccagcuuugcgaucacaggcucaugagcgcugcagucaaggacgagcgcgccgugcaugccgauaugggcuauuggauugagagccagaagaaugggucuuggaaacuggaaaaggcgagccugaucgaggugaagaccugcacuuggccgaagucccacacgcucuggucaaauggcgugcuggaauccgacaugaucauacccaagagcuuagccggacccauuucacaacacaauuaccggcccggcuaccacacucagacggccgggcccuggcacuugggcaaguuggaauuggacuucaacuacugugaaggaacgaccgugguaaucaccgagaauugcgguacgcgcggccccagcuugcggacaacaaccgucuccgggaaguugauccacgagugguguugccgcagcugcaccuuaccaccgcuacgguacaugggcgaggaugggugcugguacggcauggagauccgcccuaucuccgagaaggaagagaacauggucaagagccuuguguccgccggcucuggcgaggucgacaacuucacgaugggcgugcugugccuagcuauccuguucgaggaggugaugcgggggaaguucggcaagaagcacaugaucgcgggcguauucuucaccuucguacugcuccuguccggccagaucaccuggcgcgacauggcccacacacucaucaugaucggaagcaacgccuccgaccgaauggggaugggcgugacguaccuugcccugaucgccaccuucaagauccagcccuuccuugcgcucggguucuuucuacgcaagcugaccagucgggaaaaccuccugcugggcgucggucucgccauggcgaccacucugcagcugcccgaagacaucgagcagauggccaacggcaucgcguuaggcuuaauggcucugaagcucaucacccaguucgaaaccuaccagcuguggaccgcccugaucagccugaccugcuccaacaccaucuucacccugacugucgccuggcgcacggccacccugauccucgcugggguaagucugcugccggugugucaguccagcucaaugcgaaaaaccgacuggcuccccaugaccguugccgccaugggcgugccgcccuugccgcuguucaucuuuagccucaaggacacgcuaaagcggcguucuuggccacugaacgaggguguuauggccguaggccucgugagcauccuugccuccucccugcuccggaacgacgugccuauggcgggcccccugguggccgggggccugcucaucgccugcuacgucauaaccggaacaagugccgauuugaccguggagaaagccgcggacgugacaugggaggaggaggccgagcagaccggcgucagccacaaccugaugaucaccguggacgacgacgggaccaugagaaucaaggacgaugagaccgaaaacauucucaccguucuuuuaaagaccgcccuccugauaguauccgggaucuucccguauagcaucccagccacucugcucguuuggcacaccuggcagaagcagacgcagcgguccgggguacugugggacguccccagcccgcccgagacccagaaggccgagcuggaagaagggguguaccguaucaaacagcaggggaucuucgguaagacacagguuggagucgggguccagaaagagggcguauuccacaccauguggcacguaacgcggggcgcggugcucaccuacaauggaaagcgccucgagccuaacugggccucugugaagaaggaccugaucucauacggugggggcuggcggcucuccgcucaguggcagaaaggggaggaaguccaggugaucgcgguggaacccggcaagaacccgaagaacuuccagaccaugcccgggaccuuccagaccaccaccggggagaucggcgcgauagcccuggacuucaagcccgggacuagcggcagccccaucaucaaccgcgagggcaaggucguugggcuguacggaaacgggguggucacgaagaacggcggguacguguccgggaucgcccagacuaaugccgagccagauggccccacccccgaacuggaggaggagauguucaagaagcguaaccucaccauuauggaccugcaccccgggucaggcaagacgaggaaguaccugcccgcuaucguucgcgaggcgaucaaacgccgccuccgcacccugauccuggcccccacgcggguagucgcugcugagauggaagaggcccucaagggccugccgaucagguaccaaacuacggcgaccaaguccgagcacaccggccgggagauaguggaccuaaugugccacgccacguucacgaugcggcuccugagcccaguccgggugccgaacuacaaccugauaauuauggacgaggcccacuuuaccgaccccgccuccaucgccgcgcgcggguauaucagcacccgggugggcaugggcgaggccgcugccauuuuuaugaccgcgaccccgcccgggaccgcugacgccuuuccgcaguccaacgcccccauccaggacgaggagcgagacauucccgaacgcagcuggaacuccggcaacgaguggauaaccgauuucgccggaaagacagucugguucgugcccagcaucaaggcgggcaacgacaucgccaacugccuccggaagaacgggaagaaggugauacagcugucccgcaagacguucgacaccgaguaucagaagacuaagcugaacgacugggacuucgucguaacaacggacaucagcgaaaugggggccaacuuuaaggcagaccgugugaucgacccgcgccgcugccucaagccagucauacugacugacggccccgagcgggugauccuggcaggaccaaugccggugaccgcggccagugccgcccagaggaggggccggguggggcgcaacccgcagaaggaaaacgaccaguacaucuucacuggccagccacuaaacaacgacgaggaccacgcccacuggacggaggcgaagaugcugcuugacaacauuaacaccccugaagggauaauuccggcucucuucgagcccgaacgggagaaaagcgccgcuaucgacggcgaguaccgccugaaaggcgaaagucggaagacauucguggaguugaugcggcgcggggaccuccccgucuggcuggcgcacaaaguggccuccgaggguauaaaauacacagaccgcaagugguguuucgauggacagcggaacaaccagauccuggaagaaaacauggauguugaaaucuggaccaaggagggcgagaagaaaaaacuccgcccccgcuggcuggacgcccgaacguauuccgacccguuagccuuaaaggaguuuaaggacuucgccgcgggccgcaagagcaucgcucuggaccuggucaccgagaucggcagaguucccucccaccucgcgcaccgcacccgcaacgcccuagauaaccugguaaugcuccacacaagcgagcacggcgggaaggccuaccgccacgcggucgaagaacuucccgagacgauggaaacccugcuccugcugggacucaugaucuugcugaccgguggcgccaugcuguuccugauuagcggcaaagguaucggcaaaacuuccauaggccucaucugcgugaucgccaguuccggcaugcuauggauggccgagaucccgcuacaguggaucgccagcgcgauagugcuggaguucuucaugaugguccuccugauccccgagccagaaaagcagcggacgccccaggacaaccaacuggccuauguggugaucgggauccucacucuggcggccaucaucgccgcgaaugagaugggucuacuggagaccacgaagagggaucucggcauguccaaggagccgggagucgugagccccacauccuaccuggacguggaccuccaccccgccagcgccuggacccuguacgccgucgccaccacagugaucacgcccaugcugcggcacacuaucgagaacuccaccgcgaacguguccuuagccgcgaucgccaaccaggcuguagugcugaugggcuuggacaagggauggccgaucuccaagauggaccucggcgugcccuugcuggcccucgggugcuacucccaggucaauccacugacccugacggcugccguacuuuuguugauaacccacuacgccaucaucggcccgggguugcaggcaaaggccaccagagaggcccaaaaacgaacggcugcggggaucaugaaaaauccgacgguggacggcaucaugaccaucgaccuggaccccgucaucuacgacuccaaguucgagaaacaguuaggccagguaaugcuucuggugcugugcgcgguccagcuccugcugaugagaacuagcugggcccuaugcgaggcccuuacccuggccacgggucccaucacuacuuuaugggagggauccccagggaaguucuggaacacuacgauagcggugucgauggccaacauuuuccggggguccuaccuggcuggggccgggcuggccuuuaguaucaugaagagcguggggaccggaaagagagggacugggagccagggcgagacacuaggggagaaguggaagaagaagcuuaaucaguuaagccggaaggaguucgaccuuuacaagaaguccggcaucacagagguggacagaacggaggcgaaggaggggcugaagcggggugagauaacccaccacgccgugagccggggcagugcuaagcugcaaugguuuguggagagaaacauggucaucccggaagggcgcgugaucgacuugggaugcgggcgggguggguggagcuauuacugcgcgggccugaagaaggugacggaaguccgcggcuauaccaagggcggccccgggcacgaggagcccgugcccauguccacguacggcuggaacauagugaagcucaugagcgggaaggacguguucuaccucccacccgaaaagugcgauacccugcugugcgacauaggggagaguucccccucaccgaccguggaggagucgcggacaauccgcguucugaagauggucgaacccuggcuaaagaacaaccaguucugcaucaaagugcugaacccguacaugccuacggucgucgagcaucucgagagacuccagcggaagcacggcggaaugcuggugagaaacccucugucccggaacagcacccacgaaauguacuggauaucaaauggcaccgggaauauaguagccagcgucaacauggugucccgccuguugcuaaaccgguucaccaugacccaccgccggccgacuauagagaaggacguggaccucggcgccggcacccgccacguaaacgcagagccagagaccccaaacauggacgugaucggugagcggaucaagagaaucaaggaagagcauaauucaacguggcauuacgacgacgagaacccauacaagaccugggccuaccacggcuccuacgagguuaaggccaccgggucagcuuccucaaugaucaauggcguggugaagcugcugaccaaaccgugggaugugguccccauggugacccagauggcgaugaccgacaccacccccuucggucagcagcggguuuucaaggagaagguggauacucgcaccccccguagcaugcccggcacccgccgggugaugggcauaaccgccgaguggcucuggcgcacgcucgggcggaacaagaagccccgcuugugcacccgggaagaguucaccaagaaaguccgcacgaacgccgcaaugggagcgguguucacggaggaaaaccaaugggacuccgcuaaagccgcgguggaggacgaggacuucuggaagcucgucgaccgcgaacgggagcugcauaagcugggaaaaugcggcagcugcguguacaauaugauggggaagcgcgagaagaagcugggcgaguucggcaaagccaaggggucccgggcgauaugguauauguggcugggugcccgcuacuuagaauucgaggcccucggguucuugaacgaggaccacugguucagccgggagaacuccuacaguggcguggagggggagggccugcacaagcucgguuacauccugcgugacaucucuaagaucccggguggcgccauguacgcugacgauaccgcggggugggacacgcggaucaccgaggacgauuuacauaacgaggagaagaucacgcagcagauggacccggagcaccgccagcucgcuaacgccaucuucaagcugaccuaucagaacaagguggugaaaguucagcggcccacccccacaggcaccgucauggacaucaucagccgcaaagaccagcggggcuccggccaaguggggacguacgggcugaacaccuuuaccaauauggaggcacagcucauccgacagauggagggcgaaggcguauuaucaaaggccgaccuggagaacccccgccucccggagaagaagauaacccaguggcuggagacgaagggcgucgaacgccugaagcggauggccaucuccggcgacgauugcgugguaaagccaaucgacgaccgcuucgccaaugcccuccuggcccugaacgauaugggaaagguccggaaggacauaccacaauggcagcccagcaagggcuggcaugauuggcagcaagucccguuuugcucccaucauuuccacgagcucaucaugaaggacgggcgcaagcuggugguccccugccggccccaggacgaacugaucggcagagcccgaaucagccagggagcuggcuggucccuccgggagaccgccugccuggggaaggccuacgcccagauguggaguuugauguacuuccaccgccgcgaccuccgccuggcaucuaacgcgaucugcagcgcugugcccguccacugggucccgacaucccggacgacguggagcauccaugcccaccaucaguggaugaccacggaggacaugcugaccguguggaaucgcguguggaucgaggacaacccauggauggaggacaagacgcccgugaccaccugggagaacgugcccuaccucggcaagcgcgaggaccaguggugcggcagcuugaucgggcugaccucacgcgcgacgugggcccaaaacaucccgacugcaauccagcaaguccggucacucauaggcaacgaggaguuccuggacuacaugcccucuaugaagagauuccggaaggaagaagaaagcgagggggccaucugguag

SEQ ID NO: 26084 - RNA, 9873 nt, Artificial Sequence
  derived and/or modified CDS sequence (opt11) from DENV-3__FJ898469__SS-prME
accagucugugccucaugaugauccugcccgccgcccuagcauuccaccucacgucucgggauggggagccacguaugaucguggggaagaacgagcggggcaaaagccuguuauucaagaccgccagcgggaucaacaugugcacccucauagcgauggauuugggcgagaugugcgacgacaccgucaccuacaagugcccccacaucacggagguggagccagaggacaucgacugcuggugcaacuugaccagcacuugggugacguacgguacgugcaaucaagccggcgagcaccggcgugacaagcggagcgucgcccucgcaccccacgugggcaugggguuggauacccgcacccagaccuggaugagcgccgagggcgccuggcgccaggucgagaaggucgagacgugggcuuuacgccacccgggguucaccauccucgcucuguuccuggcgcacuacauaggcaccagucuaacccagaaagugguaaucuuuauccugcugauguuagugacgcccagcaugaccaugcggugcguggguguaggcaacagggacuucgucgagggccugaguggugccaccuggguggacgugguccuggaacacggcgggugcgucaccacgauggccaaaaacaagcccacccucgacaucgagcugcaaaagacagaggccacacagcucgcaacgcucaggaagcugugcaucgaggggaagauuaccaacauuaccaccgauagccggugucccacgcagggggaggccgugcugccggaggagcaggaccagaacuacgucuguaagcacacauacguggaccggggguggggcaaugggugcggccuguucgggaagggcucccuggucaccugugccaaauuucagugccuggagcccauagagggcaaggucgugcaguacgagaaccucaaguauaccguaaucaucacggugcacaccggagaccagcaccaggugggcaacgagacucaaggggucacggccgagaucacuccacaggccaguaccaccgaggcgauccuccccgaauacgguacacuagggcucgaguguuccccgcgcaccggccuggacuuuaaugagaugauccugcucaccaugaagaauaaggcuuggauggugcaccggcagugguuuuucgacuugccucugcccuggacaagcggcgccaccacugagacgcccaccuggaaccgcaaggaacuacugguuacuuuuaagaacgcccacgccaagaaacaggaggucgucgugcucgggagucaagagggugccaugcacaccgcccucacgggggccaccgagauacagaauagcggcggaacuuccaucuuugccggccaccugaagugccggcugaagauggauaagcucgagcugaagggcauguccuacgccaugugcacgaacacguucguccugaaaaaggagguauccgagacccagcaugggacaauccucaucaaagucgaguacaagggggaggacguaccuugcaagaucccguuuagcacggaagacgggcagggcaaggcgcacaauggccgccugaucaccgccaaucccguggugacaaagaaagaagaacccgucaacaucgaagcagagccgcccuucggggaaagcaacaucgugaucggaaucggugacaacgccuugaagaucaacugguacaagaaaggcuccagcauagggaagauguucgaagcgacggcccggggcgcccgccggauggcaauucugggcgacaccgcaugggacuuuggguccguaggagggguccuuaacucccugggcaagauggugcaccagaucuucggguccgcguacacggcccuguuuagcggcguuucgugggucaugaagaucggcauuggcgugcucuugaccuggauuggacugaacagcaagaacaccuccaugagcuucuccugcauugccaucgggauuaucacgcucuaccugggggccgugguccaagccgacauggggugcgugauaaacuggaagggcaaggaguuaaagugcgguuccgggauuuuuguuacgaacgaaguccacaccuggaccgagcaguacaaauuccaggcggauucccccaagcgccucgccaccgccaucgccggcgccugggagaacggggugugcgguauccggagcacgacccggauggagaaucuucuuuggaagcaaaucgcgaacgagcuaaauuacauccuaugggagaacaacauuaaacugaccguugucgugggggacaucauuggcgugcucgagcagggcaagcgcacccugacuccccagcccauggagcugaaguacuccuggaagaccugggggaaggcgaagaucgucaccgccgagacccagaauagcucuuucaucaucgauggccccaacacuccugagugccccagcgccucccgcgcguggaacgugugggagguggaagacuacgguuucggcgucuuuaccaccaauaucuggcuaaagcugcgcgagguauacacccaacugugcgaccaucgucucauguccgcggccgugaaggacgagcgcgccguccacgccgauaugggauacuggaucgagagccagaagaacggguccuggaagcuggagaaggccagccugaucgaggucaaaaccuguacguggccuaagucccacacccucuggagcaacggaguccuggagucggacaugaucauaccgaaaagccuggccgggccaaucagucagcacaacuaccggccggguuaucauacgcaaaccgccgggcccuggcaccucggcaaacuggaguuggacuucaacuacugcgaaggcacgaccguaguuaucaccgagaauugugggacgagagggccuucccuccgaacgacgacuguuucagggaaauugauccaugagugguguugucgaagcugcacccugccgccgcuccgguacaugggcgaggacgggugcugguacggcauggagauccgccccaucucagagaaggaagaaaacauggucaagucacugguguccgcaggaagcggugaggucgacaacuucacuaugggcguccugugucucgccauccuguucgaggaaguuaugcggggcaaguucggcaagaagcacaugauugcgggaguguuuuucaccuucguccuguuauugucuggccagaucacauggcgcgacauggcccacacccucaucaugaucggcaguaacgccagcgaccgcauggguaugggcgugacguaccucgcccugaucgccaccuucaaaauccagcccuuuuuggcgcucggguucuuucugcguaagcugaccagccgggagaaccuccugcuggggguagggcucgccauggcaaccacgcugcaguugcccgaagacaucgagcagauggcuaaugggaucgcgcucggccugauggcucugaagcugaucacucaauucgagaccuaccagcuguggaccgccuuaaucucucucacaugcuccaacaccauauucacccugacgguggccuggcgcacggcaacccugauccuagcgggggugagucuccugcccgucugccagucaagcuccaugcggaagaccgacuggcuccccaugaccguggccgccaugggcgugccgccccucccguuauucaucuucagccucaaagacacuuugaagcgccggucauggccccugaacgagggagucauggccgucggccuagugagcauccuggccuccucccugcuuaggaaugacguucccauggcgggcccccugguggccggagggcuccugaucgcaugcuauguuaucacagggaccuccgcagaccugaccgucgagaaagccgcggacgugaccugggaggaggaagccgaacagacuggcgugagccacaaucugaugaucaccgucgacgacgacgggacgaugcgcaucaaggaugacgagacagagaacauccucacggugcugcugaaaacggcgcucuuaaucguguccggcaucuucccguacagcaucccugccacccugcucgucuggcacaccuggcaaaaacagacgcagcgguccggcgugcugugggacguccccagcccgcccgagacccaaaaggccgagcuggaggagggggucuaccgaaucaagcagcagggaauauucgggaagacccaggugggcguggggguccagaaggaggguguguuucacaccauguggcacguaacgcggggcgcgguccucaccuauaacgggaagcgccuagagccuaacugggcguccgugaagaaggaccugaucuccuacggcgggggauggcggcucagugcgcaguggcaaaagggugaggaagugcaggucaucgccguggagccuggcaagaaucccaaaaacuuccagaccaugccgggcaccuuucagacaacgacuggcgagaucggcgcaauagcccuggacuuuaagcccgggaccucgggcagccccaucaucaaccgcgagggcaaagugguaggacuauacgguaaugggguugugacaaagaauggcgguuacgucuccggcaucgcccagaccaaugccgaaccggacggccccacccccgagcuggaagaggaaauguucaagaagagaaacuuaacgauaauggaccuccaccccgggaguggcaagacaagaaaguacuuaccggccaucgugcgggaggcaauuaagcgcagauuacgcacccuaauccuugcccccacccgggugguagcagccgaaauggaggaagcccuaaagggguugcccauucgcuaucagaccaccgcgacaaaguccgaacacaccggccgcgagaucguggaccugaugugucacgcgacauucacgaugcgccucuugucacccgugaggguaccgaacuacaaccugaucauuauggacgaggcccacuucaccgaccccgccuccaucgccgcucgcggguacauuagcacccgggugggcaugggcgaggccgccgccaucuucaugaccgcgacgccgccagggacggccgacgccuucccgcaguccaacgcuccuauccaagaugaagaacgcgacaucccugagcgcagcuggaacuccggcaacgaguggaucaccgacuucgcaggaaagaccgugugguuuguccccagcaucaaggcugggaacgauauugcgaacugucuccguaagaacgggaaaaaggugauccaacuuucccggaaaacauucgacaccgaguaccagaagaccaagcugaacgacugggacuucgucgucacuacggacaucagcgagaugggcgccaacuucaaagccgaccggguuaucgacccgcgccggugucuuaagcccgugauucugacugacggccccgagcgcgucauccuggccgggcccaugcccgugaccgcggccucagccgcucagcggcgcggccgugugggacgcaacccacagaaagaaaacgaccaauauauuuucacuggccaaccccucaacaaugacgaggaccacgcccacuggacagaggcgaaaaugcugcuggacaauaucaacacaccagaggggauuaucccggcccucuucgagccagagcgggagaaguccgccgccaucgacggcgaguaucgccugaagggcgagucccggaagacuuucguggagcuaaugcgacgcggcgaccuacccguguggcuggcgcauaagguggccagugagggaaucaaguauacugaucgcaaguggugcuucgacgggcagcggaacaaccagauucuggaggagaacauggacguggagaucuggaccaaagagggcgagaagaagaagcuccgcccccgguggcuggacgcccgcacguacuccgauccguuagcccucaaggaguucaaagacuucgccgcgggccgcaagagcaucgcacuggaccuggugaccgagauugggcggguccccacacaucucgcccaucgcacccggaacgcccuggacaaccuugugaugcuccauacguccgagcacggcgggaaggccuaccgccacgcuguggaggagcugcccgagaccauggagacgcugcuccuguuaggccucaugauacugcugacagggggcgccaugcuguuccugaucagcggcaaggggauuggaaagacguccaucgguuugauaugcguuauagccuccucaggcaugcuguggauggccgagauccccuugcaguggaucgcuuccgcgaucguacuggaguucuucaugauggugcuccugauccccgagcccgaaaaacagcguacgccccaggauaaucagcuggccuaugucgugaucgggauccucacccuagccgccauaaucgccgccaacgagaugggucugcucgagaccacuaagagagaccucgggaugucuaaggagccggggguagucuccccaacaagcuaccuggacguugaccuccaccccgcauccgccuggacccucuacgccguagcgacuacugucaucacccccaugcugagacauaccaucgagaacagcaccgccaaugugucccuugccgcuaucgcaaaccaagcgguuguccuaaugggccuggacaaaggguggccgaucagcaagauggaccucggggugccccugcuggcccuggggugcuacucccaggugaauccccugacgcugaccgccgccguccuccugcugaucacccauuacgccaucaucggacccggacuccaagcuaaagcgacccgcgaggcacagaagcggacagccgccgggaucaugaagaaccccaccguagacggcaucaugaccaucgaccuggaccccgugaucuacgacagcaaguucgagaagcagcuggggcaggucaugcuccuuguucugugcgcggugcagcucuugcugaugcgcaccuccugggcccugugcgaggcccugacacuggcuaccggccccaucaccacgcucugggagggaucccccgggaaguucuggaacacgaccaucgcagucuccauggccaacaucuuucggggaagcuaccuagccggcgcgggucuggccuucuccaucaugaaguccgucggaaccgggaagcgaggcacugggcuucagggcgagacccugggcgaaaaguggaaaaagaagcugaaucagcucagucgcaaggaguucgaccuauacaagaaauccggcaucacggagguggacagaaccgaggcaaaggagggguugaagcggggcgaaaucacgcaucacgcugucagccggggcuccgccaagcuccagugguucguggagcggaacauggugaucccggaaggacgcgucaucgaucugggcugcgggcggggcggcuggagcuacuacugugccggacugaagaaggugacugaggugcgcggcuacaccaaaggcgggccugggcacgaggagcccguuccaauguccaccuauggcuggaacauugucaagcucaugagcgggaaagacguguucuaccugccgcccgagaagugugauacccuacugugcgacaucggcgaguccagccccucccccaccguugaggagagccggacgaucagggugcucaagaugguggaaccguggcugaagaacaaucaguucugcaucaagguccugaauccauacaugcccaccgugaucgagcaccuugagaggcugcagaggaagcacggagggaugcuggugcgcaacccgcucucccggaauagcacccacgagauguacuggaucuccaacggcacugggaacaucguagccaguguaaacaugguuucccgccugcugcucaaccguuucacgaugacucaccgccggccuaccaucgagaaggacgucgacuuaggcgcgggcacccgccaugugaacgccgagcccgaaacucccaacauggacgugaucggggagcggauaaaacgcaucaaggaagaacauaacagcaccuggcacuacgacgacgagaaccccuacaagacgugggcguaccacggauccuacgagguaaaggcuaccgggagcgcauccagcaugaucaacggcguugucaaacuuuuaacgaagcccugggacguggugcccauggucacccagauggccaugaccgacacgacgcccuucgggcagcagcggguguucaaggagaaggucgacacccgcaccccgcggagcaugccgggcacgcgcagggucaugggcaucaccgccgaguggcucuggcggacccuggggcggaacaagaagccucgcuuaugcacccgggaggaguucacuaagaaagugaggacgaacgccgcaaugggcgcgguguucaccgaggagaaccagugggacagcgccaaggccgccgucgaagacgaagacuuuuggaagcuaguggaucgcgaacgugagcugcauaagcucgggaagugcgggagcuguguguauaacaugauggggaagcgggagaagaaacugggcgaguucggaaaggccaaggggucccgggcgaucugguacauguggcugggcgcccgcuaccucgaguucgaggcccugggguucuugaacgaggaccacugguucucccgggaaaacuccuacagcggcgucgaaggugagggccuccacaagcugggcuacauccugcgagacaucucuaagauccccgggggcgcaauguacgcagacgacaccgcggggugggacaccaggaucacggaggacgaccuacacaacgaggagaaaaucacccagcaaauggacccggagcaccgacaacuggcuaacgccaucuucaaacuuaccuaucagaacaaggugguuaagguucagcggcccacccccacgggcacgguaauggacauuauuagccguaaggaccagcggggcucgggccaggugggcaccuaugggcucaacaccuucaccaauauggaagcccaacugauccgccagauggagggggaagggguacugucaaaggccgaccucgagaauccccaccucccggagaagaagauuacgcaguggcuggagaccaaggguguggagcggcugaagcgaauggcgaucucgggcgacgacugcgucguuaagcccaucgacgaucgguucgcuaacgcccugcuggcccucaacgauauggggaaggugcgcaaggacaucccccaguggcagccgagcaagggcuggcacgauuggcaacagguuccguucuguucccaccacuuccaugagcugaucaugaaggaugggcggaagcucguugugcccugcaggccccaggacgagcuaaucggccgggccaggauaagccagggggcgggcuggucccugcgcgagaccgccugucugggcaaggccuacgcccagauguggagccuuauguacuuccaccgucgcgaucuaaggcuugcaagcaacgccaucugcagcgccgugcccguccacuggguucccaccuccaggacgaccuggaguauucacgcccaccaucaguggaugaccaccgaggauaugcucaccguguggaaucgggucuggaucgaggacaacccuuggauggaggacaagacccccguuacaaccugggaaaaugugcccuaccuggggaagagagaggaccaguggugcggcucccugaucgggcucacguccagggccacgugggcgcagaacauaccgaccgccauccaacaggugcgcagccugaucggcaacgaggaauuucuggacuauaugcccuccaugaagcgauuccgcaaggaggaggaaagcgagggggccaucugguaa

SEQ ID NO: 26085 - RNA, 9873 nt, Artificial Sequence
  derived and/or modified CDS sequence (opt11) from DENV-3__FJ898470__SS-prME
acgucccugugccugaugaugauacuaccagcagcacucgcauuucaccuaaccagccgcgacggggaaccacggaugauuguaggcaaaaacgaacgcggaaaaucccuucucuuuaaaaccgcuucaggcauaaauaugugcacucugaucgcuauggaccuuggcgaaaugugcgacgacacggucacuuacaaaugcccacacaucacggaaguggaacccgaagacauagacugcuggugcaaccucaccagcacguggguaacauacggaacgugcaaccaggcaggcgagcacagacgcgacaaacggucgguagcccuagcgccccacgucggaaugggucuagacacacgcacgcaaacguggauguccgcugagggagccuggagacaagucgagaaaguggagaccugggcacuacgccacccuggcuuuaccauccuggcgcuguuccuagcacacuauaucggaacaagccuaacacagaaagucgucauauuuauucuucuaaugcucguaacccccagcaugacgaugaggugcgugggagucggaaaccgagacuuugucgaaggacucucuggcgccacauggguagacguugugcuagaacaugggggcugcgucacgacaauggccaaaaacaaaccaacacuggacauugaacuucagaaaacugaggccacccaacucgcaacguuacgcaaacuauguauagaaggcaaaauuacaaauauaacgacagacucacgaugcccgacgcaaggagaggccguacucccugaggagcaggaucagaacuacguauguaaacauacauauguagaccgaggauggggaaacgggugcgggcuguucgguaaaggaucgcucguaacaugcgcuaaauuccagugccuggagcccauagaagggaaaguaguacaauacgagaaucucaaauacaccguaauaaucacaguacacacaggcgaucagcaccaaguaggaaacgaaacacaaggcgucacggcugagauaaccccacaagcgucaaccaccgaggcaauucuacccgaauacggaacucuaggacuagaaugcagcccacgcacagguuuagacuucaaugagaugaucuuguugacuaugaaaaacaaagcguggaugguccaccgccaaugguuuuucgaccuaccccuccccuggaccuccggggcaaccaccgagacccccacauggaaccggaaagagcucuuggugacguuuaaaaaugcacacgcuaagaaacaagagguaguaguucucggaagccaagaaggggccaugcauacggcgcucacuggagcuacagagauccagaacucaggaggcacaucaauauuugccggacacuuaaaaugucggcuaaaaauggacaaguuagagcugaaaggcaugucauaugccauguguacuaacacuuucguucucaagaaagaggucucagagacacaacacggcacaauccugaucaagguggaguauaagggggaagacguucccugcaaaaucccguucucgacagaggauggacaaggaaaagcacacaacgggcggcugaucacagcaaaccccgugguaacgaagaaagaggagccagugaacauagaagcugagccgcccuucggcgaaagcaacauugugauagguaucggcgauaacgcguugaagauaaacugguacaagaaagggucaucgauagggaagauguucgaggcuaccgcaaggggagcucgucgaauggcgauucuaggcgauacagccugggacuucgguagcguuggagguguccuaaacagucuggguaagaugguccaucaaauauucggaagcgcuuauacagcccuauucuccggaguguccugggucaugaaaauaggcauaggaguacuccucacauggauaggacucaauucuaaaaacacaagcaugucauucagcugcaucgccaucggaauaauaacccucuaccucggagccgucguacaggccgauaugggcugcguaaucaacuggaaaggcaaggaacucaaaugcgguucaggcaucuucguaaccaacgaggugcacacguggaccgaacaguauaaauuccaagcugauucacccaagcgccucgcaaccgccaucgccggugccugggaaaauggagugugcggcauccgaucuaccacucggauggagaaccuacuuuggaagcaaauugccaacgaauugaacuacauccuaugggaaaacaacauuaaacuuaccgugguagucggugauaucaucggcguacucgagcaggggaaaaggacccucacgccacagccaauggaacuaaaauacuccuggaaaaccuggggcaaggccaaaauaguaacagcagaaacucaaaacucguccuucauaauagacgguccaaauacaccugaauguccaagcgccucccgagcguggaacguaugggaggucgaagacuacggguuuggaguauuuacuacgaacauaugguuaaagcuccgggaaguauacacacaacuaugcgaccaccgccuaaugagugcggcagucaaagaugaaagagcaguacaugccgacaugggauacuggaucgaaucccagaaaaacggaagcuggaaauuggaaaaagccucccucauagaggugaagacgugcaccuggccgaaaagucacacgcuaugguccaaugguguacuggaaucagacaugauaaucccgaaaagccuggccggacccaucucgcagcacaacuaccgaccgggguaccacacucaaacggccgggccauggcaccuaggcaaacuagagcuugacuuuaacuacugugaagggacuacagucgucauuacggaaaacugcggcacacgagggccgagccucagaaccacaaccgucagcggcaagcuaauccaugaauggugcugcagaaguugcacacuaccaccacugcgcuacaugggggaagauggaugcugguacgguauggagaucagaccaaucagcgaaaaagaagagaacaugguaaagagccuaguaagcgcgggcuccggcgaagucgauaacuuuacaaugggcgugcucugccucgcgauauuguucgaggagguaaugcgaggcaaauucggaaagaaacacaugauugcaggcguauucuucacuuuuguucuucuccucucaggucagauaacauggcgagacauggcccauacccuaaucaugauagguagcaacgcaagugacagaauggggaugggcgucaccuaucuugcguuaauugccacguucaaaauccaacccuuccuagcccuaggauucuuccucagaaaauugacaucacgggaaaaccuccuacuaggaguuggccucgcaauggccacgacccuacaauugcccgaagauaucgaacagauggcaaacgguaucgcacuaggauugauggcccugaaacucauaacccaauuugagacuuaccaauuauggacggcccuaauaucauugacaugcagcaauaccaucuucacgcuaaccgucgcguggcgcacagcuacacuaaucuuagcaggaguaucucuacucccggugugccagucaagcagcaugcgcaagacugacugguuaccuaugaccgucgcggcaaugggaguuccaccucucccacuguuuauauucucgcuaaaagauacccucaagcgccgaucauggccuuugaaugaaggcguaauggccgucggacuugucagcauucuugccaguagccuucugagaaaugacguaccaauggccgggccccuagucgcagggggccuauuaauagcaugcuaugucaucacagggacuagcgcugaccucacgguugagaaagcggccgacgucacgugggaggaagaggcagaacaaaccggugucucacacaaccucaugauaacuguggacgaugacggcacuaugcguauuaaagaugacgaaacagagaacauauuaaccguguuauuaaagaccgcacuccuuaucgugagugguaucuuccccuauuccauucccgccacacuccuaguguggcauacuuggcaaaaacaaacgcaacgcuccgguguacuaugggacgugcccucacccccggagacgcaaaaagcagaacuggaagaagguguguacagaaucaaacagcagggaauauucggaaagacacaagucggcgucgguguccaaaaggaaggcgucuuccacaccauguggcauguaacccggggcgcaguucuuaccuauaacggcaagcgucuggaaccaaacugggcgucagugaagaaagauuugaucucguacggcggcggcuggcgccuuagugcacaguggcagaagggggaagaaguccagguaaucgccguagagccuggaaagaaccccaaaaacuuccaaaccaugcccgggacguuucagacgacgaccggggaaauaggagccauagccuuagacuucaaaccaggcaccuccggaucccccauuauaaaucgggaaggaaaggucgucgggcuguacgguaauggugugguaacuaaaaacggaggcuacguauccggcaucgcccaaacgaacgcugagccggauggucccacacccgagcucgaggaagagauguucaagaaacgcaaucuuacaaucauggaccuccaucccggcucgggaaagaccaggaaguaccugcccgcuauuguaagggaggccauaaaaaggcgacucaggacgcugaucuuggcccccacccgcguaguggcggccgaaauggaggaagcacuaaaagggcuaccaauacgauaucaaacaaccgcgaccaaauccgaacauacuggacgggaaauaguagaccuuaugugccacgcuaccuuuaccaugcgccuacuaucgcccguacgagucccgaauuacaaccuaauaauaauggacgaggcacacuuuacagacccagccuccaucgcagcccgcggcuacaucucaacacggguuggcaugggagaagcagcggcaauuuuuaugacagcgaccccaccuggaacugccgacgcauucccgcagaguaacgcccccauccaggacgaagaacgggacauaccggaacgcucauggaauagcgguaacgaauggauaaccgacuucgccgggaaaacagucugguuuguaccaaguauaaaggccggaaacgauaucgccaacugccuccgaaagaauggcaagaaaguaauacagcucagccgcaagacauucgacacagaauaucagaaaaccaaacugaacgacugggacuuugucguaacuacggacauauccgaaaugggagcgaacuuuaaggccgacagaguaauagacccccgccggugccuaaaacccguaauccuaacggacggcccagaacgugucaucuuagcaggcccuaugccaguuaccgcagcaucagcagcacagcggaggggacggguuggacggaacccacagaaagaaaacgaccaguacauuuuuacaggccaaccacuaaacaacgacgaggaccaugcucauuggacagaagcgaagauguuauuggacaacaucaacacaccggagggcaucauaccagcgcuuuucgagcccgaacgugaaaaauccgcagcaaucgacggcgaguaccgccuuaaaggagagucgcgaaaaacauucguagagcuaaugcgcaggggagacuuacccgucuggcuggcccauaaaguagccuccgaaggcaucaaauacaccgaccggaaauggugcuucgacggccagagaaauaaccagauacucgaagaaaauauggauguggagaucuggacaaaagaaggcgagaagaagaaacuccgcccucgcuggcucgacgcaaggacguacagugauccccuugcucuaaaagaguucaaggauuuugccgcgggacggaaaucaaucgcacuagaccugguaacugagaucggacggguaccaacgcaccuagcucauaggacaagaaacgcgcuagauaaccuaguaaugcuacacaccagcgagcacggcgggaaagccuaucggcacgcaguagaagaauuacccgaaacgauggaaacccugcuguuacuaggccugaugauacuguuaacaggaggcgccaugcuauucuuaauauccggaaaaggcauuggaaaaacuucaauuggguuaaucugcgugaucgcuagcagcgguauguuauggauggccgaaauaccucugcaauggauugcgucagcuauaguacuugaguucuucaugaugguacugcugauaccggaaccugagaagcagcgaacaccccaagacaaccaauuagcguacguuguaaucgggauucucacccuagccgcaauaaucgccgcaaaugaaaugggucuacucgaaacgacaaaaagggaccuaggcaugucaaaggaacccggcguggucagucccacgagcuauuuagacguugacuuacacccggcaagcgcguggacacuuuacgcaguggcuacgacugucauaacgccgaugcugagacacaccaucgaaaacucuacagcaaacguaucucuggccgccaucgccaaccaggccgucguguuaaugggguuagauaaagguuggccuauaucaaaaauggauuuaggcgugccucuguuagcacuaggaugcuacagucaagucaauccccuaacgcuaacggcagccgugcuccugcucauaacgcacuacgccaucaucgguccaggacugcaggcaaaagccacccgcgaggcccaaaagcguaccgcggcugguaucaugaagaacccgacugucgauggcaucaugaccauagaucuagacccaguaauauacgacucgaaauuugaaaagcaauuaggccaagucaugcugcucguccucugcgcgguacaacugcuucuaaugcguaccucgugggcgcuuugcgaagcccuuacccuugccaccgggccgauaacgacacugugggaagggucacccggcaaauucuggaauaccacuaucgccgugucgauggcuaacaucuuccgagguucguacuuagcuggagcgggccuugccuucuccaucaugaaaucaguagggacaggcaaaagagguaccgggucucaaggcgaaacucucggcgagaaauggaagaagaaauuaaaccaacugucacguaaggaauuugacuuauacaagaaaucaggaaucacugaagucgaucgaaccgaagcgaaggaaggccugaaaagaggcgaaauuacacaccacgcaguauccagaggcucugcuaaauuacaaugguuuguagaacgaaacauggugauaccggagggaagagucaucgaucucgggugcggcagaggaggcuggagcuacuacugcgcgggccuaaagaaaguuaccgaggucagaggauacacgaagggcgggccagggcacgaagaaccuguacccaugucaaccuacggguggaacaucguaaaacuuaugucuggcaaagauguuuucuaccuaccgccagaaaagugugacacccuacugugcgacaucggagaaaguagcccgucuccuacaguugaagaaagcagaacaauacgagugcuaaaaaugguagaacccuggcuaaagaacaaccaauucugcauaaaaguacucaauccguacaugccaacagucaucgaacaucucgaaaggcuccaaaggaaacacggcggcaugcucguacgaaacccacuuagcagaaacagcacucacgaaauguacuggauaucuaacggcacuggcaacaucguugcaagcgucaacauggugucgcgguugcuucuaaaccgcuucacaaugacgcauagacgcccaacaauugagaaggacguggaccugggggcugguacccgccaugucaaugcggaacccgaaacaccaaacauggacgugaucggagaaagaauaaagaggauuaaagaagaacauaacucaacauggcacuacgaugacgagaaucccuacaaaacgugggcauaccauggaucguaugagguaaaagcuaccggcagugcuuccucgaugauuaacggaguggucaaacucuugacuaagcccugggacgucguuccgauggugacccaaauggcgaugacagacaccaccccguucggacaacagagggucuucaaagaaaaaguugauacccguaccccgcgcucgaugcccgggacccgccgaguuauggguauaaccgcugagugguuauggagaacauuaggaaggaauaagaagccgaggcuuugcacgcgagaagaguucacuaagaaagugagaacaaaugcagcaaugggggcagucuucaccgaggaaaaccaaugggauagugcaaaagcggcggucgaagacgaggacuucuggaaacucgucgauagggaacgugaauugcauaaacuggggaaaugugggucaugcguauacaacaugauggguaagagggaaaagaaguuaggcgaguuugggaaagccaagggcagcagagccaucugguacaugugguuaggcgcccgcuacuuagaguucgaggcacucggauuucucaacgaagaucacugguucagccgcgagaacuccuacagcggaguagagggcgaaggacuacacaaacucgguuauauacucagggacauaagcaagauaccaggaggggcaauguaugccgacgacacugcgggaugggauacaagaauaacggaggacgaucuacacaaugaagagaaaaucacgcaacagauggaccccgaacaccgacagcuggcaaaugccauauuuaaacucaccuaucagaauaaagucguaaaggugcaacgcccaacgcccgcuggaacuguuauggacauaaucucccgaaaagaccaacgaggcucaggccaaguggggacguacggacugaauacauuuaccaauauggaggcucaacugauuaggcagauggagggggagggagugcuaucaaaagcggaucuggaaaacccccaccucccagagaagaaaaucacccaauggcuggaaacaaaaggcgucgaacgcuuaaaacgcauggcgaucucaggcgacgauugugucguaaaaccaauagacgacagguucgccaacgcgcuucuagcccuuaaugacaugggaaaaguucgaaaagauauaccccaguggcaacccuccaaaggauggcacgacuggcaacaagugcccuuuuguagucaccacuuccacgaacugauaaugaaagaugggcgaaagcucguugucccaugucgcccgcaagaugagcucauagguagagcaagaauaucccaaggagcaggguggucccugagagagacggccugccucgggaaggcuuacgcccaaauguggucacucauguauuuccaccgcagggaucuccgccuugcuagcaacgcgaucugcagcgcaguacccguccacugggugccgaccagucguaccacauggagcauacacgcccaucaccaauggaugacgacagaagacaugcuuacgguauggaaucguguguggauagaggacaaccccuggauggaggacaaaacacccgucacgacgugggagaauguccccuaccucggaaagcgagaagaccaauggugugggagcuuaaucggcuugacaucucgagccaccugggcgcaaaacauccccacagccauccagcagguacgcagccugaucggcaaugaggaguuccucgacuacaugcccagcaugaaaagauuucggaaagaagaggaaucugaaggagcaaucugguga

SEQ ID NO: 26086 - RNA, 9873 nt, Artificial Sequence
  derived and/or modified CDS sequence (opt11) from DENV-3__FJ898471__SS-prME
accagccucugccucaugaugauccugcccgccgcucuggcguuccaucucacgagccgggacggggaaccccguaugaucguggggaagaacgagcggggaaagagccugcuauucaagaccgcuagugggaucaacauguguacccucaucgccauggacuugggagagaugugugaugacacagugaccuacaagugcccccacaucaccgagguggaaccugaggacaucgacugcuggugcaaccugaccucaacaugggugaccuacgguaccugcaaccaggccggcgagcaccggcgcgacaagcgguccguugcccucgcaccccacguggguauggggcuggauacccgcacccagaccuggaugagcgccgagggggccuggcggcaggucgagaagguggagaccugggcccugcgccacccgggguucacaauccucgcguuguuccuggcccauuacaucggcacuucccucauccaaaagguagugaucuuuauccugcugaugcuagugacacccagcaugacuaugcggugcgugggggugggcaaucgcgacuucguggagggccuauccggugccaccuggguggacgugguccuggagcacggcgggugcgugacgaccauggcuaagaacaagcccacgcucgacauagaacugcagaagacagaggccacccagcuggcuacccuccggaagcuaugcaucgagggcaagaucacgaacaucaccaccgacucccgcugcccaacccagggcgaggccguacugcccgaggaacaagaccaaaauuacgucugcaagcacacguacguggaccggggguggggcaacgggugcggcuuauucggcaagggaucacuuguaaccugcgccaaguuccagugcuuagagcccaucgaggguaaggucguucaguacgagaaccugaaguacaccgugauaauaaccguccacacgggcgaccagcaccaggugggcaacgaaacccagggggucaccgccgagaucacgccgcaggccagcacgaccgaggcgauucugcccgaguacggcaccuuggggcucgagugcucgccuagaaccggccuggacuucaacgagaugauccuucucaccaugaagaacaaggccuggauggugcaccggcagugguucuucgaccugccccugcccuggacgagcggcgccaccaccgagacacccacuuggaaccgcaaggaguugcucgugaccuucaagaacgcccaugccaaaaagcaggaggucgucguacuggguucccaggagggugcgaugcacaccgcccucacuggggccacggagauacagaacaguggcggaaccagcaucuucgccggccaccugaagugccggcugaagauggacaagcucgaguuaaaggguaugagcuacgccaugugcaccaacacuuucguccugaagaaggagguuucugagacgcagcacgggaccauccuaaucaagguugaauacaagggcgaggacguccccugcaagauccccuucagcacggaggacgggcaaggaaaggcgcacaacggccgccugaucaccgccaacccaguggugaccaagaaggaggagcccgucaauaucgaggcggaaccgcccuucggugaguccaacaucgugaucggcauuggggacaaugcccugaagauuaauugguauaagaagggcuccuccaucgggaagauguucgaggccaccgcucggggcgcccgccggauggccauccugggcgacacagccugggacuuuggaucagugggcggaguccucaacagccugggcaaaauggugcaccagaucuucgggucggcguacacagcgcuguucagcggcguguccugggucaugaagaucgguaucggggugcuccugacguggaucggccugaacagcaagaacaccuccaugucguucuccugcauagugaucgggaucauuacccucuaccugggggccguagugcaagccgacauggggugcguuaucaacuggaagggcaaggagcuuaaguguggcagcggaaucuucgucaccaaugaggugcacacguggaccgagcaguacaaguuccaggccgauuccccuaagcgcuuagcaaccgccaucgccggggccugggagaacggggugugcggcaucagaagcaccacacggauggaaaaccugcuguggaagcagaucgccaacgagcucaacuacaucuugugggaaaacaacauaaagcucacgguuguggugggggacauuaucggcgucuuagaacagggcaagcgcaccuuaacgccccagccgauggagcugaaguacaguuggaaaacgugggggaaagcgaagaucgugaccgccgagacccaaaauucuagcuucaucaucgacggccccaacacccccgaaugccccagcgccucccgggccuggaacguaugggaggucgaggacuacggguuuggcguuuuuacgaccaacaucuggcucaagcugagggagguguacacccagcugugugaccaccggcugaugagugcugccgucaaggaugagcgcgcggugcacgccgacaugggcuacuggaucgagagccagaagaacggguccuggaagcuggaaaaggcuagcuuaaucgaggugaagaccugcaccuggccgaagucccacacgcuguggagcaacggcguccuggaaagugacaugaucauccccaagagcuuggcggggccuaucucacagcacaacuaccggccgggauaucauacccagaccgcugggcccuggcaccugggcaagcuggagcuggacuucaacuacugcgagggcacaaccguggugaucaccgagaacugcgggacccguggccccagccuccggacaacgaccgucuccgguaagcugauccaugaguggugcugccgcagcuguacccugcccccgcuccgguacaugggcgaggacggguguugguacggcauggagauccgcccuaucuccgagaaggaggagaacaugguaaagagccugguguccgcaggcagcggggaaguagacaacuucaccaugggcgugcugugccuagccauccuguucgaggaggugaugcgggguaaguuugggaagaagcacaugaucgcggggguauucuucacguucgugcugcuacuguccggccagaucaccuggcgcgauauggcgcacacgcuaaucaugaucgguagcaacgccuccgaccgcauggggaugggcguaaccuaccuagcccuaaucgccacauucaagauccaacccuuccuggcccucggguucuuccugcgcaagcugaccagccgggaaaaucuccuccugggcgucggacucgcgauggccaccacacuccagcugcccgaggacauugagcagauggccaacgggauagcgcucggucugauggcguuaaagcucaucacgcaguuugaaaccuaccagcuguggacggcgcuggugagccugaccugcuccaauacgaucuuuaccuuaaccgucgccuggcgcaccgccacgcugauacucgccggugugagcuuacugccggugugccagagcagcuccaugcggaagaccgacuggcuucccaugaccgucgcggccaugggcgugccgccccucccgcuauuuaucuucagccuuaaggacacccugaagcgccgcuccuggccgcugaacgaaggggugauggccgucggccucgugucgaucuuggccuccagccugcuccggaacgacgugcccauggccggcccacuggucgccggcgggcuucucaucgccugcuacguuauaacugggaccuccgcugaccugaccguggagaaagccgcggacgugacaugggaggaggaggccgagcagacgggggugagucacaaccuuaugauuaccguggacgacgaugggaccaugcgcaucaaggacgacgagaccgagaacauccucaccguucuccugaagaccgcccuccugaucguuaguggcauauuuccguauagcauacccgccaccuugcucguguggcacacuuggcagaagcagacccagcgcuccggcguccugugggacgugccaagcccucccgaaacgcaaaaggccgagcuggaggaggggguguaccguaucaagcagcaaggcaucuuugguaagacacaggucggcgugggaguccagaaggagggcguguuccauacgauguggcacgugacccgaggagccgugcucaccuacaaugggaaacgccuggagcccaacugggcguccgucaaaaaggaccugaucagcuacggugggggcuggcggcucagugcccaguggcagaagggggaggagguccaggugaucgccguugagcccggaaagaaccccaagaacuuccagaccaugcccggcaccuuccagacaacgaccggggagaucggugcgauagcgcuggacuucaagcccgggaccagcggcagcccgaucaucaaccgcgagggcaaaguggucgguuuguacggcaauggggucgugaccaagaauggcggguacguguccggcaucgcccagacaaaugccgagccggacggcccgaccccugagcuugaggaggaaauguucaagaagcggaaccuaaccaucauggaccugcaccccgguagcggcaaaacgcgcaaauaccugccggccaucguccgggaggcuaucaaacgccggcuccgcacgcugauccuggcgcccaccaggguuguggccgccgagauggaggaggcccucaagggacuuccuauccgcuaccagaccaccgcgacgaagucagagcacaccggccgggagaucgucgaccugaugugccacgcgacauucacuaugcgccuccugagccccguccgggugccgaacuacaaccuaaucauaauggaugaggcccacuuuacagaccccgccagcaucgccgcccgaggauacauuagcacccgggucgguaugggcgaggcggccgccauuuucaugaccgcaacgccgcccgggacggcggacgcuuucccgcaaucuaacgcccccauccaggacgaagagcgcgacauccccgagcgcagcuggaacuccggcaacgaguggaucaccgacuuugccgggaagaccgugugguucgugccaagcaucaaagccgguaacgacauugcgaacugucuccggaagaacgggaagaagguaauccagcugucccgcaagacuuucgacacggaguaccagaagacuaagcugaacgacugggacuucguggugaccaccgacauauccgagaugggcgccaacuucaaagccgaccgggugaucgauccgcgcagaugccucaaacccgugauacugacggacggacccgagcgcgucauccuggccgggcccaugccggucaccgccgcaucagccgcccaacggcgcggccggguggggcgcaacccccagaaggagaacgaccaguacaucuucacuggucagccccucaacaacgacgaggaccacgcccacuggaccgaggccaagaugcugcuagacaacaucaacacccccgaggggaucauaccggcccucuuugaacccgagagggagaaguccgccgccaucgacggcgaguacagauuaaagggcgagucccggaagacguucgucgagcugaugcgccgcggggaccucccuguguggcuggccuacaaggucgcgucugaaggaaucaaguacaccgaucgcaaauggugcuucgacgggcagcggaacaaccagauccuggaggagaacauggacgucgagaucuggaccaaggagggcgagaagaaaaagcuccgcccccggugguuggacgcccgcaccuacuccgacccgcuggcccucaaggaguucaaggacuucgccgccggccgcaagagcaucgcgcuggaccugguuaccgaaaucgggcgggugcccucccaccucgcccaccgcacccgaaacgcacuugacaaccuggucaugcuccacacaagcgagcacggcgggaaggccuacaggcaugccguggaagagcucccagagacgauggagacgcugcuccugcugggccucaugauccuguuaaccgggggcgcgaugcuguuccugauaagcggcaaggggauuggcaagacuuccaucgggcugauuugcgugauugccagcucaggcaugcucuggauggcugaaaucccacugcaguggaucgcgagcgccaucgucuuggaguuuuucaugauggucuuacugauucccgagccggaaaagcagcgaacgccccaggauaaccaguuggcguauguggucaucgggauccuuacguuggccgccaucauugccgccaacgagaugggccugcucgagaccaccaagcgcgaccucggcauguccaaggagccggggguugugagccccaccuccuaucuggacgucgaucuccauccggcgagcgccuggacgcuauaugccguggccacgaccgucaucacccccauguuacggcacacgaucgagaacuccacggcgaacgucagccucgccgccaucgccaaucaggccgugguccugaugggccuggacaagggguggcccaucucaaagauggaccucggcguaccacuucuggcgcucgggugcuacagccaggugaacccccugacccugacagccgccgugcuccuguugaucacgcauuacgccaucaucgggccaggcuugcaggccaaggcaacccgggaggcccagaagcggaccgccgcugggaucaugaagaacccgaccgucgacggcaucaugacgaucgaccuggaccccguaaucuacgauuccaaguucgagaaacaacugggccaggugaugcuccugguauuaugcgccguccagcuacuuuuaaugcgcaccagcugggcguuaugcgaggcccugacccuggccaccggacccaucaccacccuuugggagggcucaccggggaaauucuggaauacaaccaucgccgucucaauggcgaacaucuucaggggcuccuaccuugcuggggcgggccuggccuucagcaucaugaaauccgucgggacgggcaagcgcggcaccgguucucaaggcgagacucucggagagaaauggaagaagaaacugaaccaacugagcagaaaggaguucgaccucuauaagaaguccggcaucaccgagguggacagaaccgaggccaaggaggggcugaaacggggagagaucacgcaccacgcggugagccgcggguccgccaagcuccagugguuuguugagcggaacaugguuaucccagagggaagggucauagaccucggcugcggaagaggaggguggagcuacuacugcgccggucucaagaaggucaccgaggugcgcggguauaccaagggagggcccgggcacgaagaacccgugcccauguccaccuacggcuggaacaucgucaagcugaugagcgggaaggauguguucuaccuuccgccugagaagugcgacacgcugcuaugcgacaucggcgaguccagccccucccccacaguggaggagagccggaccaucagaguccucaagaugguggaaccuuggcucaaaaacaaccaguucuguauuaaggugcugaacccguacaugcccaccgucauagagcaccuggaacgccuccagcguaagcacggcgggaugcuggugcgaaacccccuguccagaaacagcacgcacgagauguacuggaucucgaacggcaccgggaacaucguggccucggucaacauggugucccgccuacugcucaaccgguucaccaugacacaccgccggccgacgaucgagaaggacguggaccucggcgccgggacccgccacgucaacgcugagcccgagacccccaacauggacgugaucggggagcggaucaagcgcaucaaggaggaacauaacucgacuuggcacuacgacgacgagaauccguacaagacuugggccuaccacgguaguuacgaggugaaggcgaccgguagcgccuccagcaugaucaacggcgugguuaagcugcugaccaagcccugggacgucgugcccauggugacccagauggccaugacggacacaacgccauucggacagcaaagagucuucaaggagaagguggacacccgcacgccgcggagcaugccgggcacccgccgggugaugggcaucaccgcggaguggcucuggcgcacccuggggcggaacaagaagccccgccugugcacacgcgaggaguucaccaaaaagguccgcaccaacgccgccaugggagccguguucaccgaggagaaccagugggacuccgcaaaggccgcaguggaggacgaggacuucuggaagcucgucgaccgcgagcgagagcuucacaagcuggggaaaugcggcagcugcguguacaacaugauggggaagcgcgaaaagaagcucggugaauucggcaaggccaaagggucccgagcgaucugguacauguggcugggcgcgcgcuaccuugaguuugaggcccucggguuccugaacgaggaccacugguucagccgggagaacucauacaguggcguggagggugaaggcuugcacaagcucgguuauauccugcgcgacauuuccaagauccccgggggcgccauguacgcggacgauacggccgggugggacacccggaucaccgaggacgaccugcacaacgaggagaagauaacccagcagauggauccggagcaccgccagcucgcgaacgcuaucuucaaacugacuuaccaaaacaaaguagugaaagugcagcgacccaccccgaccgguacagucauggacaucauaagccguaaggaccagcguggcuccggccaggugggcacguaugggcuaaacacguucacgaacauggaggcccagcucauccgccagauggagggcgagggggugcugagcaaggccgaccuggaaaacccccaccuaccggagaagaagaucacucaguggcuggagaccaaaggcguggagcgguugaagcguauggccauuuccggcgacgacugcgugguaaagcccaucgacgaccgguucgcgaacgcccuccuggcccugaacgacauggggaagguucgcaaggacaucccccaguggcaacccagcaagggcuggcaugacuggcagcaggucccguuuugcucccaccacuuccacgagcucaucaugaaggacgggcggaaguuagugguccccugccgcccccaagacgagcugaucggccgggcccguaucagucagggggccggguggucccuccgggagaccgcgugccuggggaaagccuacgcccagauguggucacugauguauuuccaccgccgcgaccuccggcuggccuccaacgcgaucugcagcgccgugcccgugcacugggucccgaccucccgcaccacauggagcauucacgcccaccaccaguggaugacaaccgaagacaugcugacgguguggaacagaguguggaucgaggacaauccuuggauggaggacaagacccccgucacgaccugggagaaugugcccuaccucgggaagcgcgaggaccaguggugcggcagccugaucgggcugaccucccgggcaacgugggcccagaacaucccgacggcuauccagcagguccgaaguuugauaggcaacgaggaguucuuagauuacaugccauccaugaagcgguuccgcaaggaggaggagagcgagggggccaucugguga

SEQ ID NO: 26087 - RNA, 9873 nt, Artificial Sequence
  derived and/or modified CDS sequence (opt11) from DENV-3__FJ898472__SS-prME
acuucguuaugccugaugaugauccugccggccgcccucgccuuccaccucaccucgcgggauggggagccccggaugaucguggggaagaacgagcggggcaagagccuucuguucaagacggcuuccggaauuaacaugugcacccucaucgcuauggaccuuggagagaugugcgacgacacagugaccuacaagugcccccauaucacagagguggagccagaggauaucgacugcugguguaaccugacuagcaccugggucaccuaugggacgugcaaccaggccggggaacaccgucgcgacaaacgguccgucgcccucgcgccccaugucggcaugggguuggauacccgcacccagaccuggaugagcgccgagggcgcuuggcgacaaguagagaaagucgagacaugggcucugcgccacccagguuucaccauccuggcgcuguuccuggcccauuacaucggcaccucccuaacccagaagguggugaucuucauauuacugaugcucguaacgcccagcaugaccaugcggugcgugggggucggcaauagggacuucgucgagggccuguccggcgcaaccuggguggauguggugcuggagcacggcgggugcgugaccacgauggcaaaaaacaagcccacgcucgacaucgagcugcagaagaccgaagcuacccagcuggcgacccugagaaagcugugcaucgaaggcaagaucaccaacaucaccaccgauagcagaugcccgacgcagggggaggccguguuaccggaggagcaggaucaaaacuacgucuguaagcacaccuacguggaucggggcugggggaauggguguggccucuucgggaagggcucucuggugaccugcgccaaguuccagugucuggagccuauagaaggaaaggucgugcaguacgaaaaccuaaaauacaccguaaucauaacgguccacaccggggaucagcaccagguggggaaugagacccagggggucaccgccgagaucaccccccaggccucaaccacugaggcgauccugcccgaguacgggacccugggcuuagaaugcuccccgcgcaccggccuugacuucaacgagaugauccuacucacgaugaagaacaaggccuggaugguacaccggcagugguucuuugaucugccacugcccuggaccagcggcgcaaccaccgagaccccgaccuggaaccggaaggagcucuuagugaccuuuaagaacgcccaugccaaaaagcaggaggucgugguccuagggagccaggaaggagcgaugcacacggcccucacaggggccaccgagauccaaaacagcggcgggaccucaaucuucgcgggacaccuaaagugccggcuuaaaauggacaaacuugagcugaaggguaugucauacgcaauguguaccaacacguuugucuuaaaaaaggagguauccgagacccagcacgggacgauuuuaauuaagguggaguauaagggcgaggaugucccgugcaaaauccccuucucaaccgaggacgggcagggaaaggcgcauaacggucgccugaucacggccaacccaguggugacgaagaaagaggagcccguaaauaucgaggccgagccgcccuucggggagagcaacaucgucauagguaucggugacaaugcccugaagaucaauugguacaagaaaggcuccagcaucgggaaaauguucgaggcgacagcccggggagcccggcggauggccauacucggcgacaccgcaugggacuucgggagugucggggguguccucaacagccuaggaaaaaugguccaccaaauauucggguccgcguacacagcccuguucagcggcguguccugggucaugaagaucggcaucggggugcuccugacuuggaucggccugaacagcaaaaacaccuccaugucauucuccugcaucgccaucgguaucaucacccucuaucugggcgccguaguccaggccgacaugggaugcguaaucaacuggaaggggaaggagcugaagugcggcagcgggaucuuuguuacgaaugagguccacaccuggacggagcaauacaaguuccaagcggacuccccuaagcgccucgcgaccgccaucgccggagccugggagaacggggugugcgggaucagaagcacgacccggauggagaaccugcuguggaaacagaucgcgaaugaacuaaacuacauacucugggagaacaacaucaagcuuaccguggucgucggggacaucaucggcgugcucgagcaaggcaaaaggacccugacgccacagccgauggagcugaaguacuccuggaagacgugggggaaggcaaagauuguaaccgccgagacccaaaauuccucauucaucauugacggccccaacacgcccgaguguccuucagcgucccgggcauggaacgugugggaaguggaggacuacgguuucggcgucuucaccaccaacaucuggcucaagcugcgcgagguguacacccagcugugugaccacaggcugaugagcgccgccgucaaggacgagcgcgccguccacgccgacaugggguacuggaucgagagccagaaaaacggguccuggaagcuggagaaggcgagccugaucgaggugaagaccugcacguggccgaagucccacacccuguggagcaacggcguguuggaauccgacaugaucauacccaagagccuagccgggcccaucucccagcacaacuacaggccgggguaccacacccaaacagccgggcccuggcaccuaggaaagcuggagcuggauuucaauuauugcgaagguacgaccgucgugaucaccgagaacugcgggacccgcggcccuagccucagaacuaccaccgucuccggcaagcugauccaugaguggugcugucgcagcugcaccuuaccgccgcuccgauacaugggcgaggacgggugcugguaugggauggagauccgccccauaucagaaaaggaggagaacaugguaaagagccugguaucugcaggcagcggggagguggauaauuuuacgaugggcguccuuugccucgccauccuguucgaggaggucaugcgggggaaguucggcaagaaacacaugaucgcggguguguuccugacguuuguccuccuguuauccggccagaucacuuggcgcgacauggcccacaccuuaaucaugaucggcagcaaugcguccgaccggauggggaugggcgugacguaccuggcccugauagccaccuucaaaauccagcccuuccucgcccugggguucuuucugcgcaagcucaccucucgggagaaccugcugcucggagugggcuuggccauggcaacuacgcugcagcucccagaggacauagagcagauggcgaacgggaucgcgcugggucucauggcacucaagcuaaucacccaguucgagacguaucagcuguggacagcccucaucucacuuacgugcuccaauacuauauucacgcugaccguggccuggagaacggccacguuaauccuggccggggugucacuacuccccgucugccaguccucuuccaugcggaagaccgacuggcugcccaugacgguggcagccaugggcgugccgccacugccccuguucaucuucaacuuaaaagacacucugaaaagacguagcuggccccucaaugagggggucauggccgugggccuagugucuauccuggccagcucccuucugaggaacgacgucccgauggcgggcccccucguggcugggggccucuuaaucgccugcuacgugaucacugggacgagcgccgaccugaccgucgagaaagcagcggacgugacgugggaggaggaggccgagcagaccggcgugucccacaacuugaugauaaccguagaugacgacggaaccaugaggaucaaggacgacgaaacggagaacauccugacuguauugcuuaagacagcccugcugaucgugucaggcaucuucccguacuccauaccugccacccucuuaguuuggcacacuuggcagaagcaaacucaacggagcggcgugcugugggaugugcccagcccgcccgagacccagaaggccgagcucgaggaggggguguaucgcauuaagcagcagggcaucuucgggaagacccagguugguguggggguccagaaggaggggguguuccacacuauguggcacguaacgcggggcgcgguucugacauauaacgguaagcgccuagagcccaauugggcgagcguuaagaaggaccuuaucucauacggcgggggcuggcgguuguccgcccaauggcagaagggcgaggaggugcaggucaucgccguggagcccggcaagaaccccaaaaacuuccagaccaugcccggcaccuuccagacgacgaccggcgagauuggggcgaucgcucuggauuucaagcccgggaccuccgggagccccaucaucaaccgcgaaggcaaagugguuggcuuguacggcaacggagugguuacaaagaacggcggauacgucucuggaaucgcccagaccaaugccgagccggacggccccacccccgaguuggaggaagagauguucaagaagcggaacuuaaccaucauggaucugcaccccggguccgguaagacgcgcaaguaccuuccggccaucgugcgggaggcgaucaagcgccgguugcgcacccugauuuuggccccuacacguguggucgccgcugaaauggaggaggcgcugaagggucugccaauccgcuaucagaccacggcgaccaaaagcgagcacacggggcgggagaucguagaccucaugugccaugcgaccuuuacgaugagacuguugagucccguucgggucccgaacuacaaucugaucaucauggaugaagcccauuucaccgaccccgcuagcaucgccgcccgcggguacaucaguacucgggugggcaugggcgaggccgccgccaucuuuaugaccgcgacgccgcccggaaccgcugacgccuucccgcaaagcaacgccccaauccaggaugaggagagagacauccccgaaagaaguuggaacagcggaaacgaguggaucaccgacuucgccggcaagacugugugguuuguccccucuaucaaggcgggcaacgacauugcgaacugccuacggaagaacgggaagaagguaauccagcuaucucggaagacuuucgauaccgaguaccagaagacuaagcugaacgauugggacuucguggucaccacggacaucucggagaugggcgccaacuucaaggccgaucgagugaucgacccacgccgcugucugaagcccgugaucuuaacagacggcccggagcgcguaauacucgccgggcccaugccggugacagcggccagcgcagcucaacggcgcggccgggugggccgcaacccccagaaagagaacgaccaauacaucuucacgggacagccccugaacaacgacgaggaccacgcacacuggaccgaggcuaaaaugcuguuggacaacaucaacacgcccgagggaaucaucccggcauuauucgagcccgagcgggagaaauccgccgccaucgacggggaguaccgccucaagggggagagccgcaagacguucgucgaguuaaugcgcaggggggaucugcccguguggcuggcgcacaaagucgccuccgagggcaucaaauacaccgaucgcaaguggugcuucgaugggcagcgcaauaaccagauccucgaggagaacauggauguagagauuuggacuaaggagggcgagaagaagaagcugcguccccggugguuagaugcccgcacguacagugacccccucgcccugaaggaauucaaggacuucgccgcgggccgcaaguccaucgcucuggaccucgucaccgagaucgggcgaguccccacucaucuugcccaccgaacccggaacgcccuggacaacuuggugaugcugcacacgagcgaacacggcggaaaggcguaucgccaugcgguggaggagcugcccgagaccauggagacccuauugcugcucggccugaugauccugcucacggguggcgccaugcuuuuccugaucuccggaaaagggaucgguaaaacgagcauugggcucaucugcguuauugccucgucuggcauguuauggauggccgaaauuccgcugcaguggaucgccagcgcgaucgugcucgaguuuuucaugauggugcugcugauccccgaacccgaaaaacagcggacgccccaggacaaccagcucgcauacgucgugauagggauccugacccuggcagccauuaucgcggcgaacgagaugggacuccuggaaacaacgaagcgcgaccugggaaugucgaaggagccgggcgucgucagccccaccaguuaccucgacguggaccuccacccggccagcgccuggacacuguacgcuguggcgacaacagucaucaccccgaugcuccggcacaccaucgagaacuccaccgccaacguuucacuggccgccauugccaaccaggcggugguccugaugggucuugacaagggguggcccaucaguaagauggaccugggaguuccgcugcucgcccugggcugcuauucacaggugaacccccuaacgcugaccgccgccgugcugcugcucaucacccacuacgccauaauaggccccggccuccaggcgaaagccacgcgcgaagcccagaagagaaccgccgcugggaucaugaaaaacccgaccguggacggcauaaugaccaucgaccuagauccaguaaucuaugacucuaaguucgagaagcagcucgggcaggucaugcugcuggugcucugcgcgguacagcugcugcucaugcgcacuagcugggcucugugcgaagcccugacucuggccacgggcccgaucacaacgcuaugggaggggucccccgggaaguucuggaacacgaccauugcggucagcauggccaauaucuuccgggggaguuacuuagcaggggccggccucgccuucaguauaaugaaguccguagggaccggaaagcggggcaccgggagccagggggagacccugggggaaaaguggaagaagaaacugaaucaguugagccggaaggaguucgaccuguacaaaaaguccggcauuacugagguggaccgcacugaggcuaaagagggacugaaacggggcgagauuacccaccacgccgucagccgcggcuccgcgaaguuacagugguucguggagagaaacauggugaucccggaggggcgcgugaucgacuugggcugcgggcggggagguuggagcuacuacugcgcgggccugaagaaggugacagaggugagaggcuacacgaagggcgggcccgggcacgaagaacccguccccaugucaaccuacggcuggaacaucguaaaacucaugucggggaaggauguguucuaccugccgccugagaaaugcgacacccugcuaugcgauauuggcgaguccagucccuccccgaccguggaagagucgcggacgaucagggugcuaaagaugguggagcccuggcugaagaacaaccaguucugcaucaagguccugaaccccuacaugcccaccgugaucgaacacuuggagagacugcagcggaagcacggcgggaugcuggugcgcaacccccucucccgcaacagcacccacgagauguacuggauuuccaacggaaccggaaacaucgucgccagcgugaacauggugagccgccuccugcuaaaccgguucacgaugacccaccgccggccgaccaucgagaaggacgucgaucugggcgcggggacccgccacgugaacgccgaacccgaaacgcccaacauggacgugaucggggagcggaucaagcgcaucaaggaagagcacaacucuaccuggcacuacgacgacgagaacccguauaagaccugggcuuaccacggcuccuacgaggucaaggccacuggcagcgccuccuccaugaucaacggcguggucaagcuuuugacgaagcccugggacgugguccccauggucacccagauggcgaugacagacacgacgcccuucgggcagcagcggguguucaaggagaagguggacacccgcaccccgcgguccaugccgggcacccgccgggucaugggcaucacggcggaguggcuauggcgcacacuggggcggaauaagaagccccggcucuguacccgggaggaguucaccaagaagguccgcacgaacgccgcuaugggcgcuguguucaccgaagagaaccagugggacagugccaaggccgccgucgaagacgaggacuucuggaaacucguggaccgagagcgggagcuucacaagcucgggaaaugcggcagcugcguauacaacaugauggggaagcgcgaaaagaagcugggcgaguucggcaaggcaaaggggucacgggcgaucugguacauguggcuuggugcgcgcuaccuagaauuugaggccuugggguuccucaacgaagaccauugguucagccgggagaacaguuauagcggcguugagggggagggacuccacaagcugggcuacauacugcgcgacaucuccaagaucccggggggcgccauguacgccgaugacaccgcggggugggacacccgcaucacggaagacgaccuccacaacgaggagaagaucacccagcaaauggacccagagcaccgucagcuggccaacgccaucuucaagcucaccuaccagaacaagguggucaagguccagcggcccaccccaaccggcacggugauggacaucaucagccgcaaggaccagcggggaaguggccaggugggcacauaugggcuuaacaccuucaccaacauggaggcacagcugauccgccagauggagggcgaggggguccuguccaaagccgacuuggaaaacccccaccuccccgagaagaagaucacgcagugguuagagaccaaaggcguggagcgucucaagcgaauggcaaucucuggcgacgauugcgucgucaagcccaucgacgaccgguucgccaaugcgcuacuggcccucaacgauauggggaaggugcgcaaggacaucccgcaguggcaacccagcaaaggcuggcacgacuggcagcaggucccguuuugcucgcaccauuuccacgagcugaucaugaaggacgggcgcaagcuggucgugcccugccgcccccaggaugaguuaaucggccgggcgcgcaucucgcagggggcuggguggucccugagagagaccgccugucucggcaaggccuacgcccagauguggagccucauguacuuccaccgcagagaccugcguuuagcguccaacgccaucugcucugcggugccuguccacuggguaccgaccagccgcacgacauggaguauccaugcccaucaccaguggaugaccaccgaggacauguugacgguauggaaccggguuuggaucgaggacaauccauggauggaagacaagacaccugucaccaccugggagaacgugcccuaccuggggaaacgcgaagaccaguggugcggcucacugaucgggcuaacgagccgggcgaccugggcucagaacaucccgacugcaauccagcaagucaggucucugaucggcaacgaagaguucuuggauuacaugccuuccaugaagcgguuccguaaagaggaggagagcgaaggugccaucugguga

SEQ ID NO: 26088 - RNA, 9873 nt, Artificial Sequence
  derived and/or modified CDS sequence (opt11) from DENV-3__FJ898474__SS-prME
acgucucugugccucaugaugaucuugcccgccgcccuggcguuccaccucaccagccgggacggcgagccccggaugaucguagggaagaaugagcggggcaagagccuucuguuuaagaccgccuccgguaucaacaugugcacucucaucgcaauggaccucggcgagaugugcgaugacaccgugaccuacaaaugcccccauaucaccgaaguggagcccgaggacaucgacugcuggugcaaucugacuucgaccugggugaccuaugggacauguaaccaggcgggcgagcaccgccgcgacaagcgguccguggcucuugccccgcacgugggcauggggcuggacacccgcacccagaccuggaugagcgcggagggugccuggcgccagguggagaaggucgagacgugggcucugcgccacccuggguucaccauccucgcgcuguuccuugcucauuacauuggaaccucccugacccaaaagguggugaucuucauccugcugaugcucgugacgcccagcaugaccaugcggugcgugggagucggcaaccgcgacuuuguggagggccugucaggggcuaccuggguggacgugguccuggagcacggcgggugcgugacaacaauggccaagaacaagcccacccucgacaucgagcugcagaaaaccgaagccacccagcuggcgacuuugaggaagcugugcaucgagggaaagaucaccaacaucacuaccgacagccguugccccacccagggcgaggccgccuugccggaggagcaggaucagaacuacgugugcaagcacaccuacgucgaccggggguggggcaacgggugcggccucuucgggaagggcagccugguaaccugcgccaaguuccagugccuugagccaauagaaggcaaggugguccaguacgagaauuuaaaguacaccgugaucauuacggugcacaccggggaccagcaccagguuggaaacgagacucagggugugaccgcggagaucacgccucaggccagcacgaccgaggccauacugcccgaguacggcaccuuaggccucgagugcucaccgcgcacaggccuggacuuuaacgagaugauccugcugacgaugaagaauaaggccuggauggugcacagacagugguucuucgaccugcccuugcccuggacuucuggcgcaaccaccgagacucccaccuggaaccgcaaggagcuccuggugaccuuuaaaaacgcccacgcgaagaagcaggaggugguugugcuugggucccaggaaggugcuaugcacacggccuuaacgggagcuaccgagauucaaaacagcggcgggaccuccaucuucgcuggccaccugaagugccggcuaaagauggauaagcuugaacugaagggcaugagcuaugcgaugugcaccaacacauucguucugaagaaggaggucuccgagacccagcacgggaccauccucaucaagguugaguacaagggcgaggacgugccgugcaagauccccuucagcaccgaagacggucagggaaaggcccacaacggccgucugauuacggccaaccccgucgugacaaagaaagaagagcccgucaacauagaggccgagcccccauucggggaaagcaacaucgucauuggcauuggggacaacgcgcugaagauaaacugguacaagaagggauccagcaucgggaagauguucgaggcuacugcccgcggggcccgccggauggcuauccugggcgauacagcgugggacuucgggucggugggaggagugcugaacagccugggaaagaugguccaucagaucuucgggucugccuauacugcccucuucagcggcguguccugggugaugaagauuggcaucggaguccuccugaccuggaucggccugaacagcaagaacaccuccaugagcuucucaugcauugccauugggauuaucacacuauaccugggcgccgugguccaggcagacauggggugcgucaucaacuggaaaggcaaggaguuaaagugcggaagcgggauuuucguuacgaacgagguccacaccuggaccgaacaguacaaguuccaggccgacucacccaaacgccucgccaccgcaaucgcgggcgcgugggagaacgggguuugcggcauccgcagcacgaccagaauggagaauuuacuguggaagcagauugccaacgaacucaacuacauacugugggagaacaauauaaaguugaccguggugguuggagauauaaucggcgucuuagagcagggcaagagaacacugacgccccaaccgauggagcucaaguacucuuggaagaccugggggaaagcaaagaucaugaccgcggaaacccagaacuccaguuucaucaucgacggucccaacacgcccgagugccccucggcgucacgggccuggaacgucugggaagucgaggacuacggguuuggcguauucaccaccaacauuuggcucaaguuacgcgagguguacacgcagcugugcgaccaucgguugaugagcgccgccaucaaggacgagcgcgccgugcacgccgacaugggcuacuggaucgaaagccagaagaacggguccuggaagcuggagaaggccaguuugaucgaggugaaaaccuguacguggccgaagucccacacccucuggagcaacggcgugcuggaguccgauaugaucaucccgaagggccuugccggccccauuagccagcacaaccaccgaccgggguaccacacccaaaccgccggccccuggcaucucggcaagcuggagcuggacuuuaauuacugcgaggggacgaccgucgugaucaccgaaaacugcggcacccgcgggcccucccucaggacgaccaccgugagcggcaagcugauccacgaguggugcugucgcaguugcacgcugccaccacuccgguacaucggggaggacgggugcugguauggcauggaaauccggccgaucagcgagaaggaggagaacauggucaagucgcugguuagugccgggucaggcaaaguggacaacuucacgauggggguccugugccucgcgauccuguuugaggaagugaugagggguaaguucgguaagaagcacaugaucgccggcguguucuucacauucguccugcuacugagcggccagauuaccuggcgcgacauggcccacacgcugaucaugaucggguccaacgccagcgacagaaugggaaugggggugacguacuuagccuuaauugcgaccuucaagauccagcccuuccuggcccucggcuucuuccugcgaaagcugaccucccgggagaauuuauuacugggaguugggcuagcaauggccaccacguuacagcugcccgaggacaucgagcagauggcgaaugguaucgcccucgggcuaauggcccugaagcucaucacccaguucgagaccuaucaacuguggaccgcccugaucagccuuacguguagcaacaccaucuucacccugacggucgccuggcgcacggcgacgcugauucucgccggcgucagucugcucccgguuugccaaagcuccagcaugcggaaaaccgacuggcuccccauggccguugccgccaugggggugccccccuuaccguuguucaucuuuucccucaaggacacccugaagcgccgcagcuggccccugaacgagggcguaauggcggugggccucguauccauccuggccucuucccugcuccggaacgacguccccauggccgggccccugguagcgggcgggcuacucaucgccugcuacgugaucacgggcaccagcgcggaccugaccgucgagaaagcagccgauaucaccugggaggaggaggccgagcaaacgggggucucccacaaccugaugaucaccguagacgaugacggcacgaugcgcauaaaggaugaugagacggagaacauccucaccguccugcugaaaacggcccucuuaauugugucgggcauauuuccguauuccauucccgcgaccuuacucguuuggcacacuuggcaaaagcagacccagcgcagcgggguccugugggacgugcccagcccgcccgagacacagaaagcagagcuagaggaaggcguguaccggaucaagcaacaggggaucuucggcaagacccaggucgggguuggcgugcagaaggaaggugucuuccacacuauguggcauguuacccgcggggcuguguugacguacaacggcaaacgccuugagccaaacugggccagcgucaagaaggaccugaucuccuacggcggcggcuggcgguuaagcgcgcaguggcagaagggcgaggagguccaggugaucgccguugagcccggcaagaacccaaagaacuuccagacgaugcccgggaccuuccagaccaucacgggcgaaaucggggccaucgccuuagacuucaaacccggcaccuccggcagccccaucaucaaccgcgaggggaagguuguaggcuuauacgggaacggcgucgugaccaagaacggggguuacgugucggggaucgcacagacgaacgccgagccggacgggcccacgccagaguuagaagaagagauguucaagaagcggaaucugaccaucauggaccugcaccccggcucgggcaaaacccgcaaguaucugccagcuauaguccgggaggccaucaagcgacggcuccgcaccuuaauccuagcucccacgcgggucguagccgcggagauggaggaggcccucaaaggucugcccaucagguaccagaccacggccaccaagagcgagcacacggggcgggagaucguugaucugaugugccacgccaccuucaccaugagacucuuauccccggugcgggucccgaauuacaaucugaucaucauggacgaagcccacuuuacagaccccgcgagcaucgccgcccgcggauacauauccacgagggucggcaugggggaggccgcggccaucuucaugacugcgacgccacccgguaccgcugaugccuucccgcaauccaacgcacccauccaagacgaggagcgggauauucccgagcgcuccuggaacagcgggaacgaguggauuacugacuucgcgggcaagaccgugugguucgugcccuccaucaaagcugggaacgacaucgccaacugcuuacggaagaauggcaagaaggucauccagcugagccgcaagacuuucgacacggaguaucagaaaacgaagcugaacgacugggauuucguggugacgaccgacaucuccgagaugggagcgaacuucaaagcggaucgcgucauagacccgcgccggugccucaaacccgucaucuuaacagacggcccagagcgcgugauccuagccggcccuaugccggucacggccgccuccgcggcgcagcggcgcgggcggguaggacgcaauccccagaaggagaacgaccaguacaucuucaccgggcaacccuuaaacaacgaugaggaccacgcccacuggaccgaagcgaagaugcuguuggacaacauuaauacccccgaggguaucaucccggcccucuucgagcccgagcgggagaaguccgcggccaucgauggagaguacagacugaagggggagagccggaagaccuucguugagcugaugcgacguggcgaccucccggucugguuggcccacaagguggccuccgaggggauuaaauacacggaucgaaaguggugcuuugacggccagaggaauaaucaaauccuggaggagaacauggacguugagaucuggaccaaggagggagagaagaagaagcuccgcccccggugguuggacgcccgcaccuauucugacccuuuagcgcucaaggaauuuaaggauuucgccgccgggcgcaaguccaucgcgcucgaccugguaacagagaucggccggguccccagccacuuggcccaccgcacgcggaacgcgcuggacaaccuggucaugcuucauaccuccgagcacgggggucgcgccuaccggcaugccguggaagagcugccugaaaccauggagaccuugcucuuacugggccucaugauccugcugacuggaggcgccaugcucuuccugaucagcgggaagggcaucggcaagaccucaauaggccugaucugcguaaucgccuccagcgguaugcucuggauggcggaaaucccacugcaguggauugccuccgccaucguccuggaguucuuuaugaugguccugcuaauucccgagcccgagaagcaaagaacgccccaggacaaccaacuggccuauguggucaucggaauccucacccuggccgcaauaauugccgccaacgagaugggccugcucgagacgaccaagcgugaucuggggaugagcaaagagccggggguagucagucccacgagcuaccuggacguugaccuccaccccgcgagugcauggaccuuguaugccguggccacgacagugaucaccccaaugcugcgccacaccaucgagaacagcacggccaacguuucccucgcagcgaucgccaaccaggccguagugcucaugggccuggacaaaggcuggccgauaucgaagauggaucucggggucccccugcuggcacugggcugcuacucucaggugaauccccugacacugacagcagcagugcuccugcuuaucacucacuacgcaauuaucggccccgggcuacaggcuaaggccacucgggaagcccaaaagcgcaccgcggccggcaucaugaagaauccuaccgucgauggaauuaugaccaucgaccucgaccccgucaucuacgacagcaaguucgagaagcaacugggacaggugaugcuccugguccugugcgccgugcagcugcugcugaugcggacguccugggcccucugcgaggcgcugaccuuagcgacaggccccauaacuacucucugggaggggagccccggcaaguucuggaacaccaccaucgccguguccauggccaacaucuuccgcggguccuaucuggcaggcgcgggacucgcuuucuccaucaugaaguccgucggcaccggaaagcgggggacaggaucacagggugagacgcucggugagaaguggaagaagaagcugaaccaacugucccgcaaggaauucgaucucuacaagaagagcgggauuaccgagguggaccggaccgaggcuaaggaaggccugaagcgcggcgaaaccacgcaccacgccgugucccggggguccgccaagcugcagugguucguagagcgcaacauggucaucccggaggggcgggugaucgacuuggggugcggccgcgguggcuggaguuacuacugcgcgggguugaagaaggucaccgaggugcggggguacaccaagggcgguccgggccaugaggagccagugcccaugagcacguacggguggaacaucguuaagcuuaugucgggaaaagacguguucuaccuaccgcccgagaagugcgacacccugcugugcgacaucggcgaauccucccccagccccaccguugaggagucccgcaccaucagaguccugaagaugguggagccgugguuaaagaacaaucaguuuugcaucaaggugcugaaucccuacaugcccaccgucaucgagcaucuggagcgccugcagcgcaagcauggcggcauguuggugcggaacccccucucccguaauucgacgcacgagauguacuggaucagcaaugggaccggcaacaucguggccucuguuaauauggugagccggcuccugcugaaccgcuucacaaugacccaucggcgccccacaaucgagaaggacguggaucucggcgcagggacccgucacguuaacgcggagcccgagacccccaauauggacgucauuggcgaaagaaucaaacggauuaaggaagaacacaacuccaccuggcauuaugacgacgagaacccguacaaaacgugggccuaccacgggagcuacgaagucaaggcgaccggcuccgcuucuuccaugauuaacgggguugugaaguugcugacuaagcccugggacgugguucccauggugacgcagauggccaugacggacacaacccccuucggccagcagaggguuuucaaggagaaaguggacacccggacgccccgcucgaugcccgggacccggcgcguaauggggaucaccgccgaguggcucuggcgaacccugggccgcaacaaaaagccucggcuaugcacgcgcgaggaguucaccaagaagguucgcaccaaugcggccaugggggccguguucacugaggagaaccagugggacagugccaaggccgcgguggaggacgaggauuucuggaagcucgucgaccgggagcgugaacugcacaagcugggcaaaugcgggagcugcgucuacaacaugaugggcaaacgggaaaagaaacuaggcgaguucgggaaagccaagggcagccgggccaucugguacauguggcugggcgcccgguaccuggaguucgaggcccucgguuuccugaacgaggaccacugguucucccgcgaaaacagcuacuccgggguggagggcgagggcuuacacaaacucggguacauccuacgggacauuagcaagauccccggcggagcgauguacgccgacgacacggccgggugggacacgaggaucaccgaggacgaccugcacaaugaggaaaagaucacacagcagauggaccccgagcaccggcagcucgcuaaugccaucuucaagcuuacguaccaaaacaagguggugaaagugcagcgccccacccccaccggcacugucauggacaucaucuccagaaaagaccagcgcgggagcggucagguaggaacguacggacugaacacguucaccaacauggaggcgcaauuaauccggcaaauggagggagaaggcgucuugaguaaggcugaccuugagagcccccaccucccggagaaaaagaucacccagugguuagagaccaagggaguggagcgccucaagcggauggcuaucuccggggacgacugcguggugaagccaauagacgacagguucgccaacgcguuacuggcguuaaacgacaugggcaaggugcggaaagauaucccccaguggcaaccaagcaaaggguggcaugacuggcagcaagucccguucuguagucaccacuuccacgaacuuauuaugaaggacggccgcaagcuggugguccccugccggccucaggacgagcugaucggccgggcccggaucagccagggcgccggcuggucccuccgcgagacggccugccuggggaaggcuuacgcucagauguggagccuaauguacuuccaccgccgggacuugcgccuggccuccaacgccauaugcucagccgugcccgugcacugggucccuacgucccggaccaccuggagcauacacgcucaucaucaguggaugacgaccgaggacaugcugacuguguggaaucgcguauggaucgaggacaacccguggauggaggauaagacccccgucacgacaugggagaacgugccuuaccucggcaagcgcgaggaucaguggugcggguccuugaucggccugaccagcagagccaccugggcccagaacaucccgacggcgauccagcagguccggagccugaucggcaacgaggaguuccuggacuacaugcccuccaugaagcguuuccggaaggaggaagagagugagggugccaucugguga

SEQ ID NO: 26089 - RNA, 9873 nt, Artificial Sequence
  derived and/or modified CDS sequence (opt11) from DENV-3__EU529688__SS-prME
accucacuaugcuuaaugaugauccugccugccgcccuagcguuccaccuaacuucucgcgacggcgaaccccgcaugauuguagggaaaaacgaacggggcaaaagccuucuauucaaaaccgccuccggaauaaacaugugcaccuugauagccauggaccuaggagaaaugugcgaugauaccgugaccuauaagugcccucauauaacugaaguagaacccgaagacaucgacuguugguguaaccuaaccagcacuuggguuacuuacggaaccugcaaucaagcaggagaacacagacgagauaaacgaucgguggcccuagcaccccaugugggaaugggacucgauacgagaacccaaacauggaugucagcugaaggggcguggcgacaaguagaaaaaguagaaacgugggcacuacgccacccgggauuuaccauacucgcacuuuuccuggcccacuacaucgggaccagccuaacacaaaaagucgugauauucauacuacucaugcuagucaccccgucgaugacaaugagaugcgucggaguaggaaauagagauuucguagaagggcucucgggcgccacauggguagacgugguauuggaacacggaggaugugucacgaccauggcuaaaaacaaacccacacuagacaucgaauuacagaaaacagaagccacgcaacuugccacacuacgaaagcuaugcauagaaggcaaaauuacgaacaucaccaccgacucccguugccccacacaaggggaagccguguugcccgaagaacaagaucagaacuacgucugcaagcacaccuacguagacagaggauggggcaacgggugcggacuguucggaaaaggcucccucgugacgugugcaaaguuucaaugcuuagaaccaaucgaagguaaaguaguccaauacgaaaaccuaaaguacaccgugauaauaacaguacacaccggcgaccagcaccaagucgguaacgagacucaaggcgugacugcggaaaucacaccacaggcgucgacaacagaagcaauucuacccgaauacggcacguuaggacuugagugcucaccacguaccggacuagauuucaaugaaaugauacuacucacgaugaagaacaaggcguggaugguccaccgucaaugguucuuugaucuaccccuuccauggaccagcggcgccacaaccgaaaccccgacguggaaccgaaaagaacuauuaguaacuuuuaaaaacgcgcacgcgaagaaacaggaaguagucgugcuggggagccaggaaggagccaugcauacagcgcugaccggggcaacagaaauacaaaauuccggaggcacaagcauauuugcgggucaccuaaaaugucgccuaaaaauggacaaacuugaacucaaagggaugagcuacgcaaugugcacgaacaccuucgugcucaaaaaggaagugagcgaaacucaacaugggaccauacuaauaaagguggaguacaaaggagaagacgugcccuguaaaauacccuuuaguacagaagacggacaaggcaaggcgcacaacgggagguugaucaccgccaaccccgugguaacgaagaaggaggaaccaguuaacauagaggccgaacccccauucggcgaaucgaacaucgugaucggcauaggcgauaacgcucucaagauuaacugguacaaaaagggcuccagcaucggaaaaauguucgaggccacagcaaggggcgcacgacguauggcgauacuuggcgauaccgcaugggacuucgggucgguaggcggcguccuaaauucccucggcaaaaugguccaccagauuuuuggaagugcguacacugcucuguuuucgggugugagcugggucaugaagauaggcaucggcguacuccucacauggaucgggcucaacagcaaaaacacaagcaugucauuuucauguaucgccaucgguaucauuaccuuauaccuaggcgcaguuguacaagcagauaugggcugcgucauuaacuggaagggcaaggaacucaagugcggaagcggaauuuuuguuacaaacgagguacacaccuggacggagcaguauaaguuccaagccgauucuccaaaacgucuagcgacggccauagccggagcaugggaaaacggcgucugugguauacgaucuaccacgagaauggagaaucuacuguggaagcagauugcaaaugaacugaauuacauccugugggaaaacaacauaaaacuaaccgucgugguuggggacaccaucggcguauuggagcaggggaaacgcacccuaacaccccaacccauggaacucaaauacucauggaagacguggggaaaagccaagauaguuaccgcagaaacccaaaauuccagcuuuauaauagacggcccgaacaccccagaaugcccaagcgcuucccgagcauggaacguaugggaaguagaggacuauggauucgggguuuucacuacaaacaucuggcugaaauugagagaaguauacacacagcuaugcgaucaccgccuuaugagcgcggcgguuaaggacgaacgggcaguccacgcggacaugggguacuggaucgagucacagaaaaauggcucuuggaaacuugaaaaagcgucccucauugagguaaaaacaugcacauggccaaaaucccacacauuguggagcaacggaguccuugaaucggacaugauaaucccuaaaucauuagcaggaccgaucagucaacacaacuaucgcccaggguaccacacacaaacggcgggcccauggcaucuagguaaacucgaacuagacuuuaacuacugcgaagggaccacgguggugauuacugaaaacugcggaacacgggggccaagucucagaaccacaacagucagugggaaacuuauacacgaauggugcugucggagcugcacccuaccaccucugagguacaugggggaagacggcugcugguacggcauggagauccggccgauaucagaaaaagaagaaaacaugguuaagagucuagugucugcaggcucaggcgagguagacaacuucaccauggggguacuaugucucgccauccuauucgaagaagucaugcgcggcaaguucggcaagaaacacaugaucgccggcgucuucuucacguuuguacuacuguuaagcggacaaaucacauggcgcgacauggcccacacccuuauuaugauuggaagcaaugccuccgaccgaaugggaaugggugucacuuaucuagcauugauagccacauucaagauccagccguucuuagcauuaggauuuuuccucagaaaauuaacaucgagagaaaaccuccuccucggcgucggccucgcgauggcaacgacacuccagcucccagaggacauagaacaaauggccaacggaauagcccuggggcuuauggcccuaaagcuaauaacccaauucgaaacauaccaacuauggacagcucucauauccuuaaccuguucaaacacgauauuuaccuuaacgguagccuggcggacggcuacgcucauccuagcaggaguaucccuccugccgguuugucaguccucuucgaugcgaaagacagauuggcucccaaugaccguagccgccauggggguaccaccccuaccucucuucaucuucagccucaaagacacucucaaacgacggagcuggccacucaacgagggagugauggccguaggccucgucucaauccuggccagcucacuuuugcgaaacgacgugcccauggccggcccccucgucgcggguggccuacuuauagcgugcuaugugauuacgggaacguccgccgacuugacuguagaaaaagcggcagacgugacgugggaggaggaggccgagcaaacaggagugucacacaaccugaugauaaccguggacgacgaugggaccaugcgaauuaaggacgacgaaacugaaaacaucuugacuguccuacucaaaacagcgcucuuaauugugagcgggauuuucccguacagcaucccagcaacauugcuagucuggcauaccuggcaaaagcaaacucaacgaucuggaguccuaugggaugugcccaguccacccgagacacaaaaagccgaacucgaagaaggaguuuaccggauaaagcaacagggcauauucggaaaaacacaggugggcgugggaguacaaaaggaaggggucuuucacaccauguggcacgucacgagaggggccgugcucacuuauaacgggaaacgacucgaacccaacugggccucggucaagaaagaccuaauuuccuacggcggaggauggaggcuauccgcacaauggcagaagggugaagaaguccaggucauugcaguugagcccgggaagaaccccaaaaauuuucaaacaaugccgggcacuuuucagacgaccaccggggagaucggcgcgauagcccuagacuuuaagccgggaacgagcgggagcccaauaauuaacagagaagggaagguaguaggucuguacggaaauggcguggugaccaagaacgggggauauguuuccgggaucgcccagacaaacgccgaaccagauggaccaacccccgaacucgaggaagaaauguucaaaaagcgaaaccuaacaauaauggaccuccacccgggcucagggaagacgcgcaaguaccuacccgcaaucguucgcgaggcgaucaaacgccggcuucgaacgcucauacuggccccgacccggguaguagcagcagaaauggaggaggcacuaaagggccucccaaucagauaccaaacgacagccacaaaauccgaacacaccggacgagaaauuguagaucugaugugucacgccaccuuuacuaugcggcuacuuuccccuguucgcguacccaacuacaaccugaucauuauggacgaggcacauuucacagacccggcauccauagcugcgcgggguuacauauccacacgcgucgggaugggugaagccgcugcgauauucaugacagccacaccacccggcacagcugacgccuucccccaguccaacgcgccgauacaggacgaggaacgggacauccccgagcgaaguuggaacagcggaaacgaauggaucacagacuucgcagguaaaaccgucugguucguaccaagcauaaaagccgggaacgacaucgcaaacugccuacgcaaaaacggcaaaaagguaauccaauugagcagaaagacguucgacacugaguaccaaaagacaaaacugaaugauugggacuucguaguaaccaccgauaucagcgaaaugggcgccaacuucaaagcggacagaguaauagacccucgacgaugccuaaaaccagucauccugacugacgggcccgagcgcgugauccuggccggaccaaugccugucacagccgccagcgcugcacaacgucgcggacgagugggaagaaacccccagaaagaaaacgaccaauacauuuuuacugggcagccacucaacaacgacgaggaucacgcacacuggacagaggcgaagauguuacuggacaauauaaauacgcccgagggcauaauuccagcuuuguuugaacccgaacgagaaaaguccgcggcaaucgacggcgaauacaggcugaagggggaaagccggaagaccuucguagaacucaugagacgcggagacuuaccagugugguuggcucauaaaguggccucagaagggaucaaauauacugaucgcaaauggugcuuugacggccagcgcaauaaccagauccuggaggaaaacauggacgucgagaucuggacaaaagaaggcgagaagaagaaacuccgcccgagauggcuggacgccaggaccuacagcgacccgcuugcccuaaaagaguucaaagacuucgcggcgggccgaaaaagcaucgcguuggaccuggucaccgaaauaggccgcguccccucccaccuagcacacagaacccgaaacgcacuugacaacuuagucaugcuccauacaagcgagcacgguggaaaagccuacagacacgccguggaagaacuccccgaaacgauggagacacucuuacuuuuaggguuaaugauccuacugacggguggagcaaugcuguuccuaauaagcgggaaagggauagggaaaacaagcauaggccugaucugcgugauagcaaguucuggcaugcucuggauggccgaaauaccacugcaguggauagcaagcgccaucguguuagaauuuuucaugaugguauuacugauacccgaaccugaaaagcagcggaccccucaagacaaccaacuagcguacgucgucaucggaaucuuaacccuagcagccauaauugcggcuaaugagauggguuuacuggagacaaccaaacgggaccuuggaaugagcaaagaaccuggaguagucagcccaacaucguaccucgaugucgaucuccaccccgccagcgcuuggacacucuaugcaguagcaaccaccguaauaacgcccaugcugcgccacacaaucgaaaauucgacugcgaacgucagcuuagcugcaaucgcaaaccaagcgguuguacuaaugggccuagacaagggcuggcccaucucaaaaauggaucuaggagucccccuccuagcucugggaugcuacucgcaggucaauccguuaacccugaccgccgcuguacuucuacugauuacccauuacgccauaaucggacccggccuccaggcaaaggccacgcgggaggcacagaaaagaacagccgcaggaauuaugaaaaauccaacgguagacggcauaaugacgauagaccuggacccggucaucuacgauaguaaauucgaaaaacaacuggggcagguaaugcuucucgugcugugcgccguacaacuacuuuuaaugaggacgucuugggcccucugugaagcacuaacgcuggcaacaggaccaauaacaacacuaugggagggcagcccagguaaauucuggaacaccaccauagcagucagcauggcgaacaucuucagaggaucauaucucgccggagcgggacuugcuuucucgauuaugaaaaguguggguacgggcaagcgcggaacggguucacaaggagaaacacuaggcgagaaguggaaaaagaaauuaaaucaacucagccguaaagaguucgaccucuauaagaaauccggaauaacggagguagacaggaccgaggcaaaagaggguuuaaaacggggugaaauuacgcaccaugcggugucuagaggcagugcuaaacuacaaugguuuguggaacgaaauauggugaucccagaagggcgagugauagaccuagggugcgggcggggcgguuggagcuacuauugcgcaggacugaaaaaggugaccgaagucagagguuacaccaagggcgguccugggcacgaggaacccguaccgaugucaacuuacggcuggaacaucgugaaacuaaugagugguaaggauguauucuaccuaccacccgagaagugcgauacucucuugugugacauaggagaaaguagcccaucacccacaguagaagagagucguacgauuagaguacuuaaaaugguagaacccuggcuuaagaacaaucaguucuguauaaagguacugaacccguacaugccgacugucauagagcaccuggagcggcuacaacgcaaacacggggguaugcuagugagaaacccucugagucgaaacagcacgcacgagauguacuggaucagcaacggaacagggaacauaguagcaucuguuaacauggucucaaggcugcuacugaacagguucacgaugacccaccgacgccccacgaucgaaaaggacguagaccucggcgcaggcacccgucacgugaacgcagaacccgagacaccaaauauggacgugaucggugagaggaucaaacgcaucaaagaagaacacaacuccaccuggcacuacgacgacgaaaaucccuauaaaacgugggcauaccauggcucauacgaagugaaagcaaccggcucagccucgagcaugauaaacgggguagugaagcuccuaaccaagccgugggacguaguccccauggucacgcagauggcaaugacagacacgaccccguuuggccaacaacgcguguucaaggagaaagucgauacuagaacaccgcggagcaugccugggacacgccgcgucauggggauaaccgcggaauggcuguggaggacccuaggucggaacaaaaagccgagacucugcacacgugaagaguucaccaagaaaguccguacaaaugccgccaugggagcugucuucacggaagagaaccaaugggauagcgcaaaagcggccgucgaggacgaagacuucuggaagcugguggaucgcgagcgcgaacuacacaaacucggaaagugcggaagcugcgucuacaacaugauggggaaacgcgagaagaaacuuggggaguucgggaaagcaaagggaagccgagcgaucugguacauguggcucggcgcccgauaucucgaauuugaagcguuaggauuucuaaacgaggaccauugguucagccgggaaaacaguuacucugggguagagggcgaggggcuacacaaacucggcuacauucuccgagacauaaguaaaauaccagguggcgcaauguacgcggacgacacagcagggugggauacccgcaucacagaagacgaucuacacaacgaagaaaagaucacccaacaaauggaccccgagcaccgacagcuugcaaacgcaauauuuaaacuaacauaccagaacaaggucguaaagguacagagaccgaccccuaccggcacaguaauggacaucaucucccguaaagaccaaagaggaagcgggcagguagggacuuacggccuuaacaccuucacgaacauggaggcccagcucauaaggcaaauggagggagaaggagugcuuaguaaggcagaccucgaaaacccacaccuacccgagaaaaagaucacccaauggcuagagacgaagggagucgagaggcuaaaacggauggcaaucagcggcgacgacugcguagugaagcccauagacgaucgauucgcgaaugccuuguuggcccugaaugacauggguaaaguacggaaggacauaccgcaguggcaaccaucaaaaggcuggcaugacuggcagcagguaccauucugcucgcaucacuuucaugaauuaaucaugaaagacgguagaaagcuagucgucccgugcagaccgcaggacgaguuaauaggucgagcacgaauaagucaaggggccggguggucucuaagagaaacagcaugccucgguaaagcauacgcucagauguggagccugauguacuuccaccgacgggacuuacgccuugcgagcaaugcgauauguagcgccguaccuguacacuggguuccaacgucgcgaacuacauggucuauucacgcacaccaccaauggaugaccaccgaagauaugcuaacaguauggaaccgcguauggauugaagacaacccuuggauggaagauaaaacgcccguuaccacaugggaaaacgugccguaccuaggcaagcgggaagaucaaugguguggcucacugaucgggcuuacuagcagagcgaccugggcgcaaaauauaccgacagcuauacagcagguacgcagucuuaucggcaacgaggaauuucuagacuauaugccgucgaugaagagguuccgaaaagaggaagaaucagaaggcgccauaugguaa

SEQ ID NO: 26090 - RNA, 9873 nt, Artificial Sequence
  derived and/or modified CDS sequence (opt11) from DENV-3__EU482613__SS-prME
acaucgcucugccucaugaugauucuaccggcugcacuagccuuccaccucaccagucgagauggugagccuagaaugauuguugggaagaacgagcgcggaaagagccuacuauucaaaacagccagcggcauaaacauguguacgcucauagcaauggacuugggcgaaaugugcgacgacacaguaaccuacaagugcccccacauaacagaagucgaacccgaggauauagacuguuggugcaaucuaacauccaccugggugaccuacgggaccugcaaucaggcaggggagcaccguagagacaagcgaagcguagcacuugcgccgcacguggggaugggacucgacacccguacgcaaaccuggaugagcgccgaaggcgccuggcgucaagucgagaagguggaaacgugggcgcugaggcacccgggcuucacaauucuggcgcucuuucucgcacacuacauuggcaccucuuugacccaaaaagugguuauauuuauacuauugaugcucguaacacccagcaugacgaugagauguguggguguagggaaccgcgacuuugucgagggucugucuggggcaacguggguggacgugguucuugagcacggugggugcgucacuaccauggcaaaaaacaaaccaacccucgacauagaacugcaaaaaacagaagcaacacaacucgccacgcugcguaagcucuguauugagggaaaaauuacaaacaucacgacggacagcagguguccaacgcagggagaagcaguacuuccagaagagcaagaccagaacuacguauguaaacacaccuacgucgauagaggguggggaaacggcugcggccuauuugguaaagguucccuagucacgugcgcgaaguuccaaugucuggaaccaauagaaggcaaaguaguacaguaugaaaaccugaaauauacggugauaauaacagugcacaccggcgaccaacaccaaguaggcaacgaaacucaaggggugacggcagaaaucacaccacaggccucaacgacggaagcuauacuccccgaguacggcacccucggauuggaauguagcccccguaccggccuagacuucaaugagaugauacugcuaacgaugaaaaacaaggcguggauggugcaccgacaaugguucuucgaccugccgcugccuuggacaucaggcgccacaacggagacccccacauggaauaggaaggaacugcuggugaccuucaaaaacgcacacgccaaaaaacaagaaguugugguacuaggcagucaagagggggcgaugcauacggcgcucacuggggcgacugagauacagaacagcggggggaccagcauuuucgcgggacaccuaaaguguagacuaaaaauggacaaacucgaacuaaagggcaugagcuacgccaugugcacuaacacguuuguucugaagaaagaggucuccgaaacccagcacggcacuauucuaauaaaagucgaauacaaaggagaagacgucccuugcaagauaccguucagcacggaagacggacaaggcaaggcacacaauggacgccuaauuacagccaaccccgucgucacaaagaaggaggaaccagucaacauagaagccgaaccaccguuuggagagagcaacauaguaauuggcauaggcgacaacgccuuaaagaucaauugguacaaaaagggaagcucgauagguaaaauguucgaggcgaccgcgagaggugcgcggagaauggcgauccuaggugacaccgcaugggacuucggaagcguaggcgggguccuuaauagccuuggcaaaaugguacaccaaauauuugggucggcguacaccgcauuguucucgggggugucaugggugaugaagauugguauuggaguacuccuuaccuggauaggccuaaacuccaaaaauaccagcauguccuucagcuguaucgccaucgggauaauaacacuuuaccucggcgccgucguacaggccgauaugggaugcgugauuaauuggaaaggaaaggaauuaaaaugcggcagcggcauuuucguuacgaacgagguccauacauggacggaacaauauaaauuccaagcagacuccccgaaaagacuggcuaccgccauagccggggccugggaaaauggagugugcggaauuagaaguacgacccggauggaaaaucuacuauggaagcaaauagcgaacgagcugaauuacauauuaugggaaaacaacauaaaacugacugugguagugggagacauaauagguguacuggaacaggggaagcgaacccuaaccccgcaaccaauggaacuaaaauacucguggaaaaccuggggcaaggcgaagauagugaccgcugaaacgcagaacucgucguuuaucauagacgggccaaacacaccugaaugcccuagcgcauccagagcauggaaugucugggaaguggaagauuauggauuuggagucuucacgacaaacaucuggcuaaaacuuagagagguauacacacaacugugugaucacagacucauguccgcggcuguuaaggacgagagagccguccaugccgacaugggguacuggaucgaaagucaaaagaacgguucauggaaguuagagaaggcgagccucaucgagguaaaaacaugcacauggccaaaaucacauacgcuguggucaaacggagugcucgaauccgacaugaucauccccaagagccuagcgggccccauaucccaacacaacuaccgucccggauaucauacccagacggcgggaccauggcaucucggcaaacucgaacuggacuucaacuacugugaagggacgaccgucgucaucaccgagaacuguggcacgcgcggcccgagccuucgaaccacuaccguuuccggaaaacuaauacaugaauggugcuguagguccugcacucugccaccacugagauacaugggcgaagacgggugcugguacggcauggagauacgaccaaucucggaaaaagaagagaacaugguaaaauccuugguaagcgcggggucgggggaaguagacaauuucaccaugggaguucuaugcuuagccauccuauuugaagaagugaugcgagggaaguuugggaaaaagcacaugauagcaggaguauucuuuacauuugugcuacugcugucaggccaaauaacguggagagacauggcacauacguugauuaugaucggcaguaacgccucggaccguaugggaaugggagucacauaccuggcucuuaucgcaacguucaagauacaacccuucuuagcgcugggcuucuuccugagaaagcugacuucccgcgagaaccuguuacuaggagucgggcuugccauggccacaacccuucaacucccggaggacaucgaacaaauggcaaacggcaucgcccuagggcucauggcccuuaaacucauaacccaguuugagaccuaccagcuuuggacggcccuaauaucgcugaccugcucaaacacgaucuuuacacuuacaguugccuggcgaacagccacacuuauccuggcuggagucagccuucuaccgguaugccaaagcagcuccaugaggaaaacggacuggcuuccaaugaccguggcagccaugggcguuccaccacugccacucuuuauauuuucccuaaaggauacacuaaagaggcgcagcuggccgcucaacgaaggagugauggcagucgggcucguaaguauucuagcgaguagucuccuccgcaaugacguacccauggcaggucccuugguggcaggaggacuacucaucgcauguuacguuaucacggggaccuccgccgaccucacuguagagaaagccgcagacguuacaugggaggaggaagcggagcaaaccgguguaagucacaaccuaaugauaaccguagacgacgacgggacaaugcgaaucaaagacgacgagacugagaacauccucaccguccuccuuaagaccgcucucuuaauagugucaggaauauucccguacagcauuccagcuacacuccucguauggcacacauggcagaaacaaacgcaaagaucgggagugcugugggauguaccgucgccaccugagacccaaaaagcggaguuggaagagggcguguaccgaauaaagcaacaaggaauuuucggaaaaacucaagucggaguaggaguccagaaggaaggcgucuuccacacgauguggcacgugacacgaggcgcgguccugacuuacaacggcaagcgacucgagcccaacugggccucagugaaaaaggaccuuaucuccuacggaggaggguggagacuaucagcccaauggcagaagggagaagaaguacaagugauagccguggagccuggcaagaauccgaaaaacuuucagacgaugccaggcaccuuucaaaccacuacgggcgaaaucggagccauagcucuagacuucaaacccggcacaagcggaagcccaauaauaaaucgcgaaggcaagauaguugggcuauacgggaacggaguaguuacgaaaaacgggggauacgugucagggaucgcacaaaccaacgcggagccagacggaccaacaccggaauuagaggaggagauguucaaaaaaaggaaucuaacgauaauggaccuccaucccggaagcgggaagacacgcaaauaccucccggccaucguccgagaagcuaucaagaggcggcuaagaacuuuaauccuugcccccacgagaguggucgccgcagaaauggaagaggcauugaagggacugccaauacgcuaucaaaccacagccacaaagucggagcauacaggcagagaaauaguggaccugaugugccaugcgacuuucacaaugaggcuucucagccccgugcgagugcccaauuauaaccuaauuaucauggacgaagcacauuucaccgauccggccucaauagccgcaaggggcuacaucagcacacggguaggcaugggggaggccgcagccaucuucaugacggcgaccccucccggcaccgccgacgccuuuccccaaagcaaugcacccauacaagacgaagagagggacaucccagaacgaagcuggaacuccggcaacgaguggaucacggauuuugcaggaaaaacugucugguuuguacccagcauaaaagcggggaacgauauugcaaacugcuugcgcaagaaugguaaaaaagucauucaauugaguaggaagacauucgacacggaauaucaaaaaaccaagcuaaacgacugggacuucgucguaaccacagauaucuccgaaaugggugcuaauuucaaggccgacagggucauagaucccagacgaugucugaagccagucauccucacagacggucccgaacgggucaucuuggcaggaccaaugccagucacggcagccagcgcagcgcaacgucgcggacgaguaggaagaaacccucagaaggaaaacgaccaauauaucuucaccggacagccucuuaacaacgacgaagaccacgcacauuggacugaagcaaaaauguuacuggacaacauuaacacuccagaaggcauaaucccggcacuguucgaaccagagagggaaaagagcgccgccaucgauggggaauaccgacuaaagggugagucccggaaaaccuucgucgagcuuaugagaaggggcgaccuaccgguauggcuggcccacaaggucgccucggaaggcauaaaauacacagaccguaaguggugcuucgaugggcagcguaauaaccaaauccucgaagaaaacauggacgucgaaaucuggacgaaggaaggggagaaaaagaagcuacggccgagauggcuagaugcucgcacuuacagcgacccucuugcccucaaggaguuuaaggacuucgccgcuggccgaaaauccauagcgcuagaccuagucacagaaaucgggcgaguaccgacucaucuggcacaccgaaccagaaacgccuuggacaaccucguuauguugcauaccagugaacacggaggcaaggcauacagacaugcaguggaggaacugccugaaacaauggagacacuacugcuacuggggcuaaugauacuucucaccgguggagccauguuauuucucaucucaggaaaagggaucggaaaaaccagcauaggauuaaucugcgugaucgcuuccagugggaugcucuggauggccgaaaucccccuacaauggauagcaucugcaaucguauuggaauucuucaugaugguacugcugauaccagaacccgaaaaacaacgcaccccacaagauaaccaacucgcauacguaguaauaggcauucuaacguuagcggcaaucauagcggcaaacgaaaugggucuccuagagacuaccaaaagagaccuaggaaugucaaaagaaccaggagucguuagcccaacgucguaccuggacgucgacuuacauccggcuuccgccuggacccuauacgccguagccaccacagugauuaccccaaugcuuaggcacacaauagagaacaguacagccaaugugagccuugcagcaauagccaaccaggcagucgugcugaugggacuugacaaaggauggccaaucucgaaaauggaccugggcguacccuugcuugcguugggcugcuacagucaggucaacccauuaacccugaccgcagccguacuuuugcuaaucacacacuacgcuauuauaggaccaggauuacaagccaaggccacacgcgaagcacaaaagcgcaccgcagcaggcaucaugaaaaacccuaccguggaugggaucaugacaaucgaucucgacccagucauuuacgauucaaaauuugagaaacagcucggacagguuaugcuacuuguacuaugugcaguacagcugcuacugaugcgcacgucgugggcccuuugcgaagccuuaacgcuggcaacgggaccuaucacaacuuuaugggaaggcagccccgggaaauucuggaacaccaccaucgcgguaucaauggcaaacauauuccgcggaucauaccuagcgggggcggggcucgcauucucgauaaugaagagcgugggcacgggcaagcgaggcacggggucgcaaggagaaacauugggugagaaauggaagaagaagcugaaucaguugucucgcaaagaguucgaucucuacaaaaagucaggcauaacugaaguggaccgaacagaggcaaaggaaggccugaaacggggagagauuacacaccacgcagugagccgaggcagcgcgaaauuacaaugguucgucgagcgaaacauggugauaccagaaggacgcguaauagaccuaggcugcgggagggggggcuggaguuacuauugcgccggguugaaaaaagucaccgaggugcgaggcuauaccaaaggaggaccaggacacgaggaaccaguuccaaugagcaccuacggguggaacaucguuaagcuaaugaguggcaaggacguauucuaccugccgcccgaaaagugcgauacacuauuaugugacauuggcgagagcucaccaagucccaccguagaagaaagcagaacaauccgaguucugaagaugguagaaccguggcugaagaacaaccaguucugcauaaaaguccuaaaccccuauaugccgacggucauagaacaccuugaacgccuacaacgcaagcauggaggcaugcuaguuagaaauccgcucucaaggaacagcacgcacgaaauguauuggaucuccaacggaacggggaacaucguggcaaguguuaacaugguaucucgacuccuccugaaucgauuuaccaugacacaccgacgaccaacaauagaaaaagacguugaccuaggcgccggaacgcgccacguaaacgcugaaccggaaacccccaacauggacgucauuggagaaagaauaaagaggaucaaggaggaacacaacucuacguggcacuacgacgacgaaaacccguauaaaacaugggcguaccacggaucauacgaggugaaagcaacaggcagugccucuuccaugaucaacgguguggucaaguugcuaacaaagcccugggauguaguccccauggucacgcagauggcuaugacagacacaaccccauucggccagcaacgggucuuuaaggagaagguagacacucgcacuccaagauccaugccagggacgcgacgcgugaugggcaucaccgccgaguggcuguggagaacacucgguaggaacaaaaagccgagacugugcacacgggaggaguucacaaagaagguucgaaccaacgcagcgaugggcgcagucuucacggaggaaaaccagugggacagcgcgaaggcugcaguagaagaugaagacuucuggaaguugguggaccgggaacgagaacuacacaaacucggaaagugcggcaguugcguauacaacaugauggggaagcgugaaaagaaacugggagaauucggcaaagcgaaaggaucgagggcaaucugguacauguggcugggugcccgcuaccuggaguucgaggcccuagguuuccuaaacgaagaucauugguucagcagggaaaacaguuacaguggcgucgaaggcgaagggcuacacaagcucggcuacauacucagggauauuagcaaaauacccggaggggcgauguacgcggacgacacggcagguugggacacgcgaaucacggaggacgaucuacacaacgaagaaaagaucacucaacagauggaccccgagcaucggcaauuggcgaacgcgaucuucaaacuuacauaucagaauaaggucgucaagguucaaagaccgacuccuacaggaacaguuauggacauaaucucgcguaaagaccagcgcggcucaggacaggucgggacauaugggcuaaacaccuuuacuaacauggaagcccaauuaauacgacagauggaaggcgaggggguauuaaguaaagccgaccuugagaacccucaccuaccagagaaaaagauaacacaauggcuugagaccaaggggguggaacggcuuaagcgcauggcuauaaguggcgaugauugugucgugaagccaaucgaugaccgauucgcuaacgcucuucuagcccuuaacgacauggguaaagugcggaaagacauaccgcaguggcaacccagcaaaggauggcacgacuggcagcaaguacccuucugcucccaccauuuccacgaguuaauuaugaaagacgggagaaagcuaguagucccaugccgaccccaggacgaauuaaucggccgcgcgagaauaucacaaggggcagguuggagccugagagagacggcaugcuuaggaaaagcauacgcacaaauguggucccuaauguacuuucauagacgugaucugcgacucgcgagcaacgccauaugcuccgcuguacccguccacugggucccaacaucucgcacaacauggagcauacacgcgcaucaucaauggaugaccaccgaggacaugcucaccguguggaaucggguguggauugaagacaaccccuggauggaggacaaaaccccagugacgacaugggaaaacguaccguaccugggcaagcgagaagaccaaugguguggcagucuaauagggcuaacuucaagggcgacuugggcucagaacauaccaacagcaauccagcaagugaggagccuaauaggaaaugaagaguuccuugacuauaugccuagcaugaagcgcuuuagaaaagaagaagagucagaaggugcgauaugguga

SEQ ID NO: 26091 - RNA, 9873 nt, Artificial Sequence
  derived and/or modified CDS sequence (opt11) from DENV-3__EU529690__SS-prME
acaucgcugugccucaugaugaucuugcccgccgcccuggccuuccaccucaccagcagggacggcgagccccggaugaucguggggaaaaacgaacgggguaagagccugcuguucaagaccgcauccgggaucaacaugugcacccucaucgccauggaccugggcgagaugugcgacgacaccgucacuuauaagugcccucacaucacugagguggagcccgaggacauagacuguuggugcaauuugaccagcaccugggugaccuacgggacuugcaaucaagccggcgaacaccggcgagauaaacgcuccguugcuuuggcaccccacgucggcauggggcucgauaccaggacucagaccuggaugagcgcugaaggcgccuggaggcaggucgagaaggucgagacgugggcgcugcggcauccgggguuuaccauccuugcgcuuuuccuggcccacuacaucggcaccucccucacucagaagguggugaucuuuauucuacuaaugcucgugacgcccagcaugacuaugaggugcgucggggugggcaaccgcgauuucgucgagggccuguccggggccaccuggguggaugugguuuuggagcacggcggcugcguaaccacgauggccaagaacaagccgacccucgacaucgaauugcagaagaccgaggccacucaacuggcgaccuugcgcaagcugugcauagagggcaaaaucaccaauaucacgacugauagccgcugucccacucagggggaagccguacugccggaggagcaggaccagaacuacgucuguaagcacaccuacguggaccggggguggggcaauggguguggccucuuugggaagggaucccuggugaccugcgccaaguuccaaugccuggagcccaucgaggguaagguagugcaauacgaaaaccuaaaguacacagugaucaucaccguccacaccggggaccagcaucagguggguaaugagacccaaggggucacggcagagaucacgccccaggccagcaccacggaggcuaucuugccugaguacggcacccuggggcucgaguguucgccgcgcacgggccuggacuucaacgagaugauccuacucaccaugaagaauaaggccuggauggugcacaggcagugguucuucgaucucccccugcccuggacuucgggcgcuaccaccgagaccccaaccuggaaccgaaaggaacuccuggucaccuucaagaacgcccaugccaaaaagcaggaggugguggugcuggggucccaggagggggcgaugcacaccgcccucacgggugccaccgagauccaaaacagcggcggcaccucaauuuucgcuggccaccugaaaugccggcuuaaaauggacaagcuagagcuuaagggcaugagcuacgcaaugugcacuaacaccuucguacugaagaaggaggucucugaaacgcaacaugggaccauauuaauaaagguggaauauaaaggggaggacguaccgugcaagauaccguucagcaccgaggacgggcagggcaaggcucauaauggccgucugaucacggccaaccccguggugaccaagaaagaggagcccgugaacaucgaggcagagccgcccuucggggagagcaacauagugaucggcauuggggauaacgcccugaagauuaacugguacaaaaagggaucaagcaucgggaaaauguucgaggccacugcccggggcgcgcgccggauggccauucugggcgacaccgccugggacuuugggagcguaggagggguuuugaacucucugggcaaaauggugcaccagaucuuuggguccgccuacacggcucuguucucgggcguuuccugggucaugaagauaggcauagggguacuacugaccuggaucggguuaaacagcaagaacacauccaugagcuucuccugcaucgccaucggcaucaucacgcuauaccugggcgcugugguccaggccgacacggggugcgugauaaacuggaaaggcaaggagcugaagugcggcagcggaaucuucguaaccaacgagguccauaccuggacugagcaguauaaguuucaggcagacucccccaaacgccuagccacggccaucgccggcgccugggagaacgggguaugcggcauccgcagcacaacuagaauggaaaaucugcuuuggaagcagaucgcgaacgagcuaaauuacaucuuaugggagaacaacaucaagcugacaguggucgucggugacaucaucggugugcucgagcagggcaagaggacgcugacgccccagccgauggaacugaaauacuccuggaagaccuggggaaaagcuaagauuguaacagccgagacgcagaacagcuccuucaucaucgacggccccaacacccccgagugccccucggccucgcgggcguggaaugucugggagguggaggauuauggguucggcgucuucaccaccaacauuuggcucaagcugagagagguauauacccagcuaugcgaccaucgguuaaugagcgccgccgugaaggaugaaagagccguccacgccgacauggguuauuggaucgagagccaaaagaacgguuccuggaagcuggagaaagcaucccugauagaggugaagacuuguaccuggccaaaaagccacacauuauggucaaauggcguccuagaauccgacaugauaaucccuaagucauuggcugguccaauaucccagcauaacuaccggcccggcuaccacacccagacggccgggccguggcaccuaggcaagcuggagcucgacuucaacuacugcgaggggaccaccguggugaucacugagaacugcggaacccgcggcccgucuuugcggaccaccacggugagugggaagcugauccaugaguggugcugccgcagcugcacguuacccccgcucagauacaugggcgaagacggguguugguacgggauggagauccgucccaucuccgagaaggaggagaauauggucaagagccuggugagcgccggaucaggggagguggacaacuucaccaugggcguccuuugucucgccauccuguucgaagagguuaugcgggggaaauucggcaagaaacacaugaucgcggggguguucuucaccuucguccugcuccuguccggccagauaacguggcgcgacauggcccacacgcugaucaugauagguagcaaugccagcgaccggauggguaugggcgugaccuaucuggcccugauugccaccuuuaagauccagcccuuccuggcgcuaggguuuuuccugaggaagcuaaccagucgggagaaccuccugcuuggggugggccucgcaauggcaacgacccugcagcugcccgaagacaucgaacagauggccaacgggaucgcguugggccugauggcacuuaagcucaucacucaauucgagaccuaccagcuuuggacggcccuuaucagccugaccugcuccaacaccauuuucacccugacggucgccuggcgcaccgcgacacugauccuggcaggggugucgcuccugccggucugccaguccaguuccaugcguaagacggacuggcuccccaugacgguggccgcuaugggcgugccgcccuuaccgcuguucauuuucaaucucaaggacacgcugaagcgccgcagcuggccccuaaaugagggggucauggccgucggccucgucucaauccuggccucgucccugcuacggaacgauguccccauggcgggcccccugguggccgguggccuccucauugccuguuacgugaucaccgggaccagcgcggauuugacggucgagaaggccgcggacgugaccugggaggaggaggcagagcagaccggugucucgcacaaccugaugaucacaguggacgacgaugggacaaugcgcaucaaagacgacgagacagagaacauacucacggugcucuugaaaacugcgcuacugaucgugagcggcaucuucccguauuccauaccugcuacccugcuaguguggcacacguggcagaaacagacgcaacggagcggcgugcugugggacgugcccagcccacccgagacgcagaaagccgagcuggaggagggggucuaccgcaucaagcagcagggcaucuucggcaaaacgcaagugggcguggggguccagaaggaagggguguuccauacuauguggcaugugacccggggcgcgguccuuaccuacaacgggaagcgccuggaaccaaauugggccagcgugaagaaagaucugaucuccuacggcggaggcuggcggcucagcgcccaauggcaaaaaggagaagaggugcagguuaucgcgguggagcccggcaagaaccccaagaacuuccagacuaugccgggcacguuccagacgaccaccggggagaucggcgcgauagcccucgacuuuaagcccggaacguccggcagucccaucaucaaccgcgaaggaaagguagucggucucuacggcaacggggucgugaccaaaaauggaggguacgucagcggcauagcacagaccaaugccgagccggacggacccacacccgagcuggaggaggagauguucaagaaacggaaccuaacgauaauggaccuacaccccggguccggcaagacacgcaaauaccucccggcaaucgugagagaggcgaucaagagacggcuccgcacccugauccuggcccccacccggguggucgccgccgagauggaggaggcccucaagggguuacccauacgcuaccaaacgaccgcgacaaagagcgagcacacgggacgggaaauaguggaccugaugugccacgcaaccuuuacaaugcgcuugcuguccccggugcgggucccgaacuacaaccugaucaucauggaugaagcccauuucacugaccccgcaagcauugccgcgagagguuacaucucgacucgggugggcaugggcgaagccgccgcuauuuucaugaccgcaacgccgccuggaaccgccgacgccuucccucagagcaacgcccccauccaggacgaggaacgcgauauccccgaacgcucguggaacucuggcaacgaauggaucaccgauuucgccgggaagacggugugguucgugccuucaaucaaggcgggcaacgacauagccaacugccuccgcaagaaugggaaaaagguuauacagcugagccgcaagaccuucgacaccgaguaccagaaaacaaaacugaacgacugggacuucguagucacuaccgacauauccgaaaugggcgcgaauuucaaagccgaccgugugaucgacccgcgccggugucucaagcccguaauccugaccgacggccccgagcgcgucauccuggccgggccuaugccagugacggcggcgagcgccgcccagcggcgcggccggguggggaggaacccgcagaaggagaacgaucaguacaucuucaccggucagccguuaaacaacgaugaagaccaugcccacuggacagaggcgaagaugcugcuggacaacauaaacacacccgagggcauuaucccggcccucuucgaaccggaacgggagaaauccgccgccaucgacggcgaguaucgccugaagggagagucucggaagaccuucgucgaacucaugcgacgcggggaccuccccgucuggcucgcgcacaaggucgcauccgagggcaucaaguacaccgaccggaaguggugcuucgacggucagagaaacaaccagauccuggaggagaacauggauguggagaucuggacgaaggagggcgagaagaaaaagcugcgcccccgguggcuugacgcucgcaccuauucagacccgcuggcccuaaaggaguucaaagacuucgcagccggccguaagucgaucgcucucgaccuggugaccgagauagggcgggugcccacgcaucuugcacaucgcacgcggaacgcccuggacaacuuggucaugcuccacaccagcgaacacggcggcaaggcguaccggcacgcgguggaggagcugcccgagacuauggaaaccuuacuccugcugggccucaugauccugcuuaccggcggggcgaugcuguuucuuauauccgggaaggggaucggcaagacaagcaucgggcugaucuguguaauugccucauccggcaugcuauggauggccgaaauaccgcuacaguggauugccagcgcgauaguucuggaauuuuucaugauggugcuccugauacccgagccagagaaacagcggacgccccaagacaaccaacuggccuacguggugauugggauacucacccuggccgccauuaucgccgcgaacgagauggggcuucucgagaccaccaagcgcgaccuaggaauguccaaggagccggggguggucucccccaccuccuaccuggauguggaucuccacccagcuucagccuggacccuguacgcuguggcgacgaccguaaucacccccaugcugcggcacacuauugaaaacagcaccgccaacguaucacucgccgcuaucgcuaaccaagcuguaguacugauggggcuggauaagggauggccgauaucuaaaauggaccucggcgugccgcugcuggcucuagggugcuacagccaggugaacccucugacguugacugccgccguucuccugcucaucacucauuacgcgaucauuggccccggccuccaggcgaaggccacgcgcgaggcucagaagcggacagccgccgggaucaugaagaauccgacugucgacggcauaaugacaaucgaccuggacccugugaucuacgauuccaaguucgagaagcagcuggggcaggucaugcuucuggugcugugcgcggugcagcuccugcucaugcgcaccucuugggcccucugcgaggcccucacucucgccaccggccccaucaccacgcucugggagggcucucccgggaaguucuggaauacaaccaucgcggugagcauggcaaacaucuuccggggcuccuaucucgcgggugcaggacuggcauucucgaucaugaaguccguagggaccgggaagcggggcaccgggagucagggcgagaccuugggugagaaguggaaaaagaaguuaaaccaacugagccggaaagaguucgaccucuacaagaaauccggcauaaccgaagucgaccguaccgaggcaaaggaggggcugaaaagaggagagaucacccaccacgccgucagccgcgguuccgcaaagcugcagugguucguggaacggaauauggugauaccggaggggcgagucaucgaccugggcugcgggcgggguggguggucuuacuacugugccggacugaaaaagguaacugagguacgcggauacaccaaaggcgggcccggucacgaggagcccguccccaugucgacguacggguggaacaucgugaagcugaugagcggaaaggacgucuucuaucugccucccgaaaagugugacaccuugcuuugugacaucggcgaguccagccccuccccgacgguugaggagagccggacgaucagggugcucaagaugguugagccguggcucaaaaacaaccaguucugcaucaaagucuuaaaccccuacaugcccaccgugauugagcaccuugagcgucuccagcggaaacauggcgggaugcuagugcgcaauccccuguccagaaauagcacccacgagauguauuggauuucaaacggaacggggaauaucgucgccagcgugaacauggugucccgacuccugcugaaucgguucacuaugacgcaucgccggccgacuaucgagaaggauguugaucucggcgcgggaacucgccaugugaacgccgagcccgagacccccaacauggacgucaucggagagcggaucaagagaaucaaggaggagcauaacagcacauggcacuaugacgaugagaacccguacaagaccugggcauaccacggcuccuacgaaguaaaggccacggggagcgcaucuaguaugaucaacggcguggucaaguuacuuaccaagcccugggauguugugcccaugguuacgcagauggcaaugacugacacgaccccguucgggcagcagcggguuuuuaaggagaaaguggauacccgcacaccgcguuccaugcccggcacacggcgggucaugggcauaaccgcggaguggcucuggcgcacccuggggcggaauaagaagccccgccugugcacccgggaggaguucacgaagaaggugagaacgaacgccgccaugggcgcgguuuucaccgaagagaaccagugggacucagccaaggccgcagucgaggaugaggacuuuuggaagcucguggacagagagcgggagcuacacaaauuagggaagugcggcucuugcguguauaacaugauggggaagagggagaaaaagcucggcgaguuuggcaaggccaagggguccagagcaaucugguacauguggcugggcgcacguuaccuggaguuugaggccuugggguuuuuaaacgaggaccacugguucagucgugaaaacagcuacagcggcguugagggugagggccugcauaaacucgguuacauccugcgugauaucuccaagaucccggguggcgccauguacgccgaugacacagcggguugggacacgcggauaaccgaagaugaccuacacaacgaggagaagaucacccaacagauggacccggagcaccgccagcucgccaaugccauauuuaagcugacuuaccaaaacaaggugguuaaaguccagagaccgacccccacuggcacugugauggacaucaucagccgcaaagaccagcgggguuccggccagguggggacauauggacucaacacuuucacgaauauggaggcucaacucauccggcagauggagggagaggggguccugagcaaagccgaccuggagaauccccaucugccggagaagaagauaacacaguggcucgagaccaaagggguggagaggcugaagcgcauggcgaucaguggugacgacugcgugguuaagcccaucgacgacagauucgccaacgcccuccucgcauugaaugacauggggaaggugcgcaaggacaucccccaguggcaacccagcaaaggcuggcacgacuggcagcagguuccguucugcagccaccacuuccaugagcuaaucaugaaggacggacggaaacucguuguaccgugccguccccaggacgaacugaucggccgggcaagaaucagccagggggcgggauggucccuccgggagaccgccugccuggggaaagcguacgcgcagauguggagucugauguacuuccaccggagagaccuccggcuagcgucuaacgccauuuguagcgccgugcccguccacugggucccuacgucccgcaccaccuggagcauacacgcccaccaccaguggaugaccacggaggacaugcucaccguguggaaucggguguggauugaggacaauccauggauggaggacaagaccccuguaaccacaugggagaacgugcccuaccucgggaagcgggaagaccaauggugcgguucccugaucggguugacuagcagagcuaccugggcgcaaaacaucccgaccgccauccaacaaguccgcucucucauuggcaacgaggaguuccuggacuacaugccauccaugaagcguuucaggaaggaagaggaaucggagggggcgaucugguag

SEQ ID NO: 26092 - RNA, 9873 nt, Artificial Sequence
  derived and/or modified CDS sequence (opt11) from DENV-3__EU529691__SS-prME
accagccugugccugaugaugaucuuaccggccgcucuggcauuucaucucacgagcagggauggugagccgcgcaugauugugggaaagaacgagaggggcaagagccugcuguucaagacagccagcgggaucaacaugugcacucucaucgcuauggaccucggugaaaugugcgacgauaccgugaccuacaaaugcccgcacaucacugaggucgagcccgaagauauugacugcuggugcaaccugacaagcaccuggguaaccuauggaaccuguaaccaggccggugagcaccggcgcgacaaacggagcgucgcccucgcgccccacguggguaugggccuggacacccgaacccagacguggaugucugccgagggagccuggcgccagguggagaaggucgagacgugggccuuacgucacccuggguucaccauccuagcguuauuccuggcccacuauaucggcaccucccugacccagaaggucgugaucuucauucuucugaugcuagucacuccuagcaugaccaugcggugcgugggcguaggcaaccgcgacuucguugaaggcuugagcggagcgacguggguggacguuguccuugagcacgguggaugcgugaccaccauggcgaagaauaaacccacccucgacauagaacugcagaagaccgaggccacgcagcuggcuacgcuucguaagcugugcaucgagggcaagaucacaaauauaacaacugacagccgaugccccacgcagggcgaggccguacugcccgaagagcaggaccagaacuaugugugcaagcacacguacguggaccggggguggggcaacgggugcggucuguuuggcaagggcucccugguaacgugcgccaaguuccagugucuggagccaaucgaggggaaggucgugcaauacgaaaaccucaaauauaccgugauuaucacuguccacaccggggaucaacaucaagucggcaacgagacacaaggagucaccgccgagaucacgccacaggccucuacaaccgaggcaauccugcccgaauacgggaccuugggccuagaguguuccccgcgcaccggccuggacuuuaacgagaugauccuacucacaaugaagaacaaagcguggauggugcaccggcagugguuuuucgaccugccccugcccuggaccaguggcgccacuacugagacgccgacguggaacagaaaggaacuccuggugacauucaagaacgcacacgcgaagaagcaagagguaguugugcugggcucgcaagagggcgcgaugcacaccgcccucacaggggccacagaaauccagaacuccggagggaccuccaucuucgccggccacuuaaagugcaggcuaaagauggacaaacucgaguuaaagggcaugucuuacgccauguguacaaauacguucgugcucaagaaggagguguccgagacccagcacgggaccauucucaucaagguggaguacaagggugaggacgcaccguguaagauacccuucagcaccgaagaugggcaaggaaaggcccacagcgguagauuaaucaccgcaaacccugucgugaccaagaaagaggagcccgugaacaucgaggccgagccucccuucggggaguccaacauagucauaggcaucggcgauaacgcccugaaaauaaacugguacaagaagggcagcuccaucgggaagauguucgaggcgaccgcccggggugcccgccggauggccauccugggcgacaccgcgugggacuucggcagcguaggcggggugcucaacucccugggcaaaauggugcaccagaucuucgggagcgcauacacggcgcuguucaguggcgugaguugggugaugaaaaucgguaucgggguccuccugaccuggaucggccugaauuccaagaacacaucuaugucuuucuccugcauugccguggggauaaucacccuauaucugggagccgucguccaggcggacaugggcuguguuaucaacuggaaaggcaaggagcuaaagugcggcuccgggaucuucgugacgaacgagguucacaccuggaccgagcaguauaaguuucaggcggauucacccaagcgucuggcuacggccaucgcgggggcuugggagaacggaguauguggcauacggucgacuacccguauggaaaaccugcuguggaagcagauugccaacgagcucaacuacauucuaugggagaacaacaucaaacugaccgugguggugggugauaucauaggcgugcucgagcaaggcaagaggacgcucaccccacagccgauggagcugaaguacucguggaagaccugggggaaggccaaaauagucacugcggagacucagaacuccagcuucauuaucgacggccccaacacucccgagugcccuagugcgagucgggcauggaaugugugggaaguggaagacuacggcuucgguguauucaccaccaacauuuggcuuaagcugcgagaaguguacacccaguugugcgaccaccgguugaugagcgcagcggugaaagacgagcgcgcugugcaugcagacaugggcuacuggauagagucccaaaaaaacgguagcuggaagcuggagaaagcuucccugauagagguuaaaacuuguacguggcccaagucccacacccuaugguccaacggagugcuugagagcgacaugauuaucccgaaaagccuggccggaccuaucucacagcacaaccaucggccagguuaccacacccagaccgcgggucccuggcaccuaggaaaacuugaacuggauuucaacuauugugagggcacgaccguugugaucaccgagaacugcggaacccgaggccccagucuccggaccacaacggugucagguaaacugauacacgaauggugcugcaggucgugcacccugcccccccuccgguacaugggggaggacgggugcugguacggcauggagauucgcccuaucagcgagaaggaggagaacauggucaagucgcuggugagcgccggcuccgggaagguggauaacuucacuaugggcguccugugccucgcaauccuguucgaggaggugaugcgggguaaauucggcaagaaacacaugauugccgggguguuuuucaccuucguucugcuacucucuggacaaaucaccuggcgcgacauggcccacacccugaucaugaucggaagcaaugcaagcgaccgaauggggaugggcgugacguacuuggcccugauugcgaccuucaagauucagcccuuuuuagcccucgguuucuuccugcgcaagcugacuagccgagaaaaccucuugcugggcguaggccucgccauggcuaccacacugcaguuacccgaagacauagaacagauggccaaugggaucgcccugggccugauggcccugaagcucaucacccaguucgagaccuaccaguuguggaccgcccugaucucccucacuuguucgaacacgauguucacucugaccguagcauggcgcaccgcgacacugauccucgcgggaguuagccugcuaccggucugccagagcuccagcaugagaaagacggacugguuaccgauggcuguugccgccaugggcguaccgccccucccacucuucaucuucucccucaaggacaccuuaaagagaaggucauggccucugaacgagggggucauggcggucggccucguguccauucuggccagcucccucuugcggaaugacguuccgauggccgguccccuuguggccgggggccugcucaucgcaugcuaugugauaaccggaacuagcgcggaccucacgguagagaaagcggccgacaucaccugggaggaggaggcugaacagacaggggucagucacaaccugaugaucaccguagacgacgacgguaccaugagaaucaaagacgacgaaaccgagaauauacuuacugugcugcugaagaccgcccuguugaucgugucaggcguguucccuuacagcauccccgcgacacugcucguauggcauaccuggcagaaacagacccagcguucggggguucugugggacgugccgucgccaccagagacgcagaaggcugagcuggaggaaggugucuauaggauuaagcagcagggcauuuuugggaagacccaggugggagugggggugcagaaggagggcguguuucauacuauguggcacgugacccgcggcgccguauugacguacaacgguaagcgcuuagaacccaacugggcaagcgugaagaaggaccugaucucuuauggcggaggcuggcgguuaagugcccaauggcagaagggugaggaagugcaagucauagcgguagagcccggaaaaaaccccaagaacuuucagacaaugcccggcaccuuccagaccacgaccggggagaucggcgccaucgcgcuugauuuuaagcccgggaccagcggcuccccuaucauaaaccgggagggcaagguggucggcuuauauggcaaugggguggucaccaagaacggcggauacguuagcggcauagcacagacgaacgccgaaccggacggcccaacccccgagcuggaggaggaaauguuuaagaagcgaaacuugacgaucauggaccugcacccagguuccgggaagacgcgcaaauaccugccggcuauagugagggaggccaucaaaaggcggcuccgcacauugauccuggcacccacccggguggucgccgcggagauggaagaggcccugaaagggcuucccaucagauaccagacuaccgcuaccaaaagcgaacacaccggucgcgagauuguggaccucaugugccacgccaccuucaccaugagacuccuuagcccggugcggguacccaauuacaaccugauaaucauggacgaggcccacuucacggaccccgcgagcaucgcugcccgcgguuacaucagcacacgggugggcaugggcgaagccgcggcaaucuucaugaccgccacgccacccgggacggcugacgccuuuccacagagcaacgcgcccauccaggaugaggagcgcgacauuccggaacgcuccuggaauagcggcaacgaauggaucaccgacuucgcuggaaagacagugugguucguccccuccauuaaggccggaaacgacaucgccaacugcuugagaaagaacggcaagaaagugauccagcugagccggaaaaccuucgacacggaguaccaaaagaccaaauugaacgacugggacuucguggucacgacugacaucuccgagaugggcgccaacuucaaggccgaucgaguuaucgacccgcgccgcugucugaagcccgugauucugacggacggccccgagcgcgugauccucgccgggcccaugccgguuaccgcugccagcgccgcgcagcgaagaggccgggucgggagaaacccccagaaggaaaacgaccaauacauauucaccgggcagccccucaacaaugacgaagaccacgcgcacuggaccgaagcuaagaugcugcuggacaacaucaacacccccgaggguaucaucccggccuuguucgagccagagcgggagaaguccgcggccaucgacggugaauaccgcuuaaaaggcgagucuagaaagacguucgucgaguugaugcgccgcggagaccuacccguguggcuggcacacaaggucgccuccgagggaaucaaguauaccgaucgaaaauggugcuuugacgggcagcggaacaaccagauccuggaagagaacauggacguggaaauuuggacuaaggagggcgaaaagaagaagcucagaccccgguggcucgacgcccgaacauacagcgauccacuggcgcuaaaggaauucaaggacuucgcggccggccgcaagucaaucgcccuugaccuggugacggagaucgggagaguccccucgcaccuagcccaccgcacccggaacgcucuagacaaucuggugaugcuacacaccucggagcacggcggucgcgcuuaucggcacgccgucgaggaacuacccgagacuauggaaacgcuccuccugcuggggcucaugauacugcucaccgguggcgccaugcuuuuccugaucucuggaaagggaaucggcaagaccagcauugggcugauaugcgugauagccuccucaggcaugcucuggauggcggaaaucccucugcaguggaucgccuccgccauugugcuggaguucuucaugauggugcuguuaaucccugagcccgaaaagcagcgcacgccccaggacaaccaguuagcuuacgugguaaucgggauccucacuuuagccgcgaucaucgccgccaacgagaugggacugcucgagacgaccaagagggaccugggaaugaguaaggagccggggguaguuuccccaaccagcuaccuggacguagaccuccaccccgccagcgcguggacccuguacgccgucgccaccaccgucauaacgccaaugcugcgucauacgaucgagaacaguaccgcuaacgugucccucgcggcgaucgccaaccaggccgugguucugauggggcuggacaagggguggccgaucagcaagauggaucuuggagugccccugcuggccuuagggugcuauucgcaggugaauccucugaccuuaaccgccgcgguacuacugcuuaucacgcacuacgccauuauagguccuggucuccaagcuaaggcgacccgcgaggcgcaaaaacgcacagcugccgguaucaugaagaacccuaccguggacggaauuaugaccaucgaccuggacccaguuaucuacgacucgaaguucgaaaagcagcuggggcaggucaugcuccuaguucugugcgcuguucagcuccuguugaugagaaccuccugggcccucugugaggcgcugacccuggccaccggcccgaucacgaccuugugggagggcucuccagggaaguucuggaauacuacaaucgccgucuccauggccaacaucuuccgaggcagcuaccuugccggggcgggccuagccuucuccaucaugaaauccgugggaacaggaaagcgaggaaccggaucacagggcgagacccucggggagaaguggaagaagaaauuaaaccagcugucccgcaaggaguucgaccucuacaagaaauccggcaucacagagguggacagaacagaggcgaaggaggggcucaagcgcggggagacgacucaccacgccgucucccggggaucggcgaagcugcagugguucguggagcgcaauauggugauccccgaagggcgggucauagaucucgggugugggaggggcgggugguccuacuauugcgcgggucugaagaagguaaccgaggugcggggcuacacaaaaggcgguccugggcacgaggagccuguccccauguccacauauggcuggaacaucgugaaacugaugucggggaaggacguguucuaccugccccccgagaagugugacacccugcugugcgacauuggcgaauccucacccaguccaaccgucgaggagucccgcaccauccgcgugcuaaagauggucgagccuuggcucaagaacaaccaguuuugcauuaaagucuuaaaucccuauaugcccacggugaucgagcaucuugagcgccuccaacgcaagcacggggggaugcugguacggaacccgcucaguaggaacuccacccacgaaauguacuggauuucgaacggcaccgggaauauugucgccuccgugaacauggugagccggcuccuguuaaaccgguucaccaugacgcaucggcgcccgaccaucgagaaggacgucgaccugggcgcaggcacuaggcacgugaacgccgagcccgagacccccaacauggauguaauaggggagcguaucaagcguauaaaagaggagcacaacuccaccuggcacuacgacgacgaaaaccccuacaagaccugggccuaccacggaagcuacgagguaaaggcgaccggguccgcaagcagcaugaucaacggcguggucaagcugcugaccaagccuugggacguagugcccaugguaacccagauggcgaugacggacaccacccccuucggacagcagcgcguguucaaagagaagguggacacgaggaccccgcgcuccaugccuggcacccggcgggucaugggcaucaccgccgaguggcuuuggaggacgcuggggagaaacaagaaaccccggcugugcacacgcgaggaguucaccaagaaggugcgaacgaacgcggccaugggcgcgguguucacagaggagaaccagugggacucagccaaggccgccguagaggacgaagauuucuggaagcucguggaccgggagcgcgaguugcauaagcuugggaaguguggguccuguguauacaacaugauggggaaacgggagaagaagcucggugaguucggcaaggccaaggggagccgagcaauaugguacauguggcuuggugcccgauaucuggaguucgaggcccucggauuuuuaaaugaagaccacugguucucccgcgagaauagcuauuccggggucgaaggugaaggcuugcacaaacugggcuacauucugcgggauaucagcaagauccccgguggcgccauguacgccgacgauaccgccgguugggauacccgcaucacagaagacgaccugcauaacgaagaaaagaucacucagcagauggacccggagcaccggcagcucgccaaugccauauuuaagcucacauaccaaaacaagguggugaagguccagcgucccacccccaccgguaccgucauggacaucaucaguaggaaagaccaacggggcagcggccagguggguacuuacggccucaacacuuucaccaacauggaggcccagcugauacggcagauggaaggggaggggguucugucuaaagccgaucuggaaaacccgcacuuacccgagaagaaaauuacccaguggcuggaaacuaaaggcguggaaagacugaagcggauggcgaucucgggggacgacugcgugguuaagcccaucgacgauagauuugccaacgcucuccuggcgcugaacgacauggggaaggugcggaaggacaucccccaauggcaaccauccaagggcuggcaugacuggcagcagguuccguucuguagccaccacuuccaugaguugauuaugaaggacgggagaaagcucgucgugccaugccggccccaggacgagcuaaucggccgagcucggaucucccagggggccggcuggaguuugagggagaccgcgugucugggcaaggcguacgcccagauguggucuuuaauguacuuccaccgccgggauuuacgccuagcuucuaaugccaucugcucggccgugccuguacauuggguccccacgucacggacaacguggagcauccaugcccaccaccaauggaugaccacagaggauaugcugaccguguggaaccgagucuggaucgaggauaauccuuggauggaggauaaaacaccgguaacuaccugggagaaugugccuuaccuaggcaagcgugaggaccaguggugcggcucccugaucgggcugaccagucgcgccacgugggcucagaacauuccuaccgcuauccagcaaguccguagucucaucggcaaugaggaguuccucgacuacaugcccagcaugaagagauuccggaaggaggaggaguccgagggugcaaucugguga

SEQ ID NO: 26093 - RNA, 9873 nt, Artificial Sequence
  derived and/or modified CDS sequence (opt11) from DENV-3__EU569689__SS-prME
accagcuuaugccuuaugaugauucugccugccgcccuggcguuccacuugacgagccgggacggugagccgcggaugaucguugggaagaacgagagaggcaagucguuacuguucaagacggccagcggaaucaacaugugcacccuaaucgccauggaccugggcgaaaugugcgacgauaccgugaccuacaagugcccacauaucacggagguagagcccgaggacauagauugcuggugcaaccugaccagcacaugggugacuuacgggacgugcaaccaggcgggggagcaccggcgcgacaagcggucaguggcccuugccccccacgugggcaugggguuagacaccagaacgcagaccuggaugagcgcugagggggccuggcgacagguggaaaagguugagacgugggccuugcgccacccgggguucaccauccucgcacuguuccuggcacacuacaucggcaccucccuaacccagaagguggugaucuucauccugcugaugcuggugacgcccagcaugacgaugcguugcguggggguaggcaaccgcgacuucgucgagggccuguccggggcaacgugggucgacguaguccuggagcauggcggguguguuaccacuauggccaagaacaagccaacccucgacaucgagcuucagaagacagaggccacccaguuagcgacgcuacggaagcugugcauagaggguaagaucaccaacaucaccaccgacagccgcugucccacgcagggugaagccgugcugccggaagagcaggaccaaaauuacgucugcaaacacacuuacguggaucgagggugggggaacgggugcggcuuguucgggaaagguuccuuaguaaccugcgccaaguuccagugccuagagccuaucgagggcaaaguugugcaguacgagaaucucaaguacacggugaucaucacgguccacacuggggaccagcaccaggugggcaacgagacccaggggguuaccgccgagaucacgccccaggcgagcaccaccgaggcgauccugcccgaguaugguacccuggggcucgaaugcucuccgcgcacaggucuggauuucaaugagaugaucuuauugacgaugaagaauaaggccuggaugguccaccggcagugguucuucgaucuaccccugcccuggacuagcggcgccacaaccgagacgcccacguggaaccgcaaggaacuccuugugaccuucaagaacgcgcacgccaagaagcaggaggucguggugcuggggucccaggagggcgcaaugcacaccgcccucacgggggccacugagauccagaacagcggcgguaccucaaucuucgccggccaccugaaaugccggcugaaaauggacaagcucgagcugaaagggaugagcuacgccaugugcaccaauacguucguccugaagaaggaggucuccgagacucagcacgggaccauccucaucaaggucgaguacaagggcgaggacgucccuugcaagaucccuuucagcacagaggacggacagggcaaggcgcauaacggucgccugaucacggcaaaccccguugugaccaaaaaggaggagccagucaauaucgaggcggagcccccguuuggggagaguaacauagucaucggaaucggggacaacgcccuaaagaucaacugguacaagaaagggucgucgauagggaaaauguucgaggcaacugcccggggcgcucgaaggauggccauccugggagacaccgccugggacuucgggagugugggcggggucuuaaacagccuuggcaagaugguccaccagauauucggguccgcguacacggccuuguucucuggcguguccugggucaugaagaucggcaucggggugcuccuaaccuggaucggcuugaacucuaaaaacaccuccaugucguucagcugcauugccaucggcaucaucaccuuauaucugggcgccguaguccaggcugacauggggugcgucaucaacuggaaaggcaaggagcugaagugugggagcggcaucuucgugacgaaugagguccauacauggaccgagcaauacaaguuccaagcggacagucccaagcgcuuggccaccgcaaucgcgggcgccugggagaacggagugugcggcauccgcagcacuacgcgaauggagaauuugcuguggaagcagaucgcuaacgagcucaacuacauccugugggaaaauaacaucaaacugaccguggucgugggggacaucaucggcgugcucgagcagggcaaacgcacucugacuccccagccaauggagcugaaguacuccuggaaggccugggggaaagccaagaucguaaccgccgagacgcagaacagcuccuucaucauugacggucccaacacaccggagugucccagcgcgucccgggccuggaacgugugggagguagaggacuacggauucggcgucuucacgaccaacaucuggcuaaagcugcgcgagguguacacgcagcugugcgaccaccgguugaugagcgcugccgugaaggacgagcgggccguccacgcggacaugggcuauuggaucgaaagccagaagaauggguccuggaagcuggagaaggccagccugaucgaggugaagacgugcaccuggccuaagagccacacgcucuggucaaauggagugcuagaguccgacaugaucaucccaaaaagccuggcggggcccauuucccaacacaacuacaggccgggcuaccacacccagaccgccgggccguggcaucucggcaagcuggagcuagacuucaacuacugcgagggcaccacggucgugaucaccgagaauuguggaacccggggccccagccuccggaccacuaccguguccgggaaacugauccacgaguggugcugucguagcugcacauugccuccccugcgguacaugggcgaggacggcugcugguauggcauggaaauacgccccaucuccgagaaggaggagaacauggucaaaagccugguguccgccggcuccggggagguggacaacuucaccaugggcgucuuaugccucgcuauucuguucgaggaggugaugagggggaaguucgggaagaagcacaugauagccgggguguucuucacguucguccugcuccuguccggccaaauaacguggcgcgacuuagcccacacccucauuaugaucggcucaaacgccuccgaccggauggggaugggcgugaccuaccuggcgcugaucgcgacguucaaaauccagcccuuccucgcccugggguucuuccuucgcaagcucaccagccgggagaacuuguuacucgguguaggucuggccauggccaccacauuacagcuucccgaggacaucgagcagauggcaaauggcaucgcccugggccugauggcccucaaauuaaucacgcaguucgagaccuaucaguuauggaccgcccucaucucgcugacgugcuccaacacuauuuucacgcugaccgucgccuggcggaccgcgacucucauccuggccggugugagccugcucccggucugccaauccagcuccaugcggaagaccgacuggcugcccaugaccguggccgccaugggcgugccgccacugccgcuguucaucuucagccugaaggacacccugaaacguagauccuggccucucaacgagggggucauggccguaggccugguuuccaucuuagcaaguucccugcugcggaaugauguccccauggccggacccuugguggccgguggacuccugaucgccugcuacgugaucacagggacauccgccgaucugacugucgaaaaagcggccgacgugaccugggaggaagaagcggagcagacgggcgugagccacaacuuaaugaucaccgucgacgacgacgggaccaugcggaucaaagacgaugagaccgagaacauccugaccguucugcucaagacggcacuucugaucgucuccggcauuuuuccguacagcaucccggccacguuguugguauggcacaccuggcaaaagcagacccagcgguccggcgugcugugggacgugcccagcccacccgagacgcaaaaagcugagcucgaggaaggagucuaccguauuaagcaacagggcauauuuggaaagacccaggugggagugggggugcagaaggagggcguguuccacaccauguggcacgugacccggggcgccguccugacguauaacggcaagcgccucgagccgaacugggccuccgugaagaaggaccucauaucguacggcgggggcuggcgacuguccgcccaauggcagaagggagaggaggugcaagucaucgcgguggagcccggcaagaaucccaaaaacuuccagaccaugccaggcacguuccagaccacgacaggugagaucggcgccaucgcccucgacuuuaagcccgggacguccggcagcccgauaauaaaccgcgagggcaagguggucgggcuauacgguaaugggguugugaccaagaauggcggguacguauccggcauagcccaaacgaaugccgaaccugacggccccacccccgagcucgaggaggagauguucaagaagcgcaaucugaccaucauggaccugcaccccgggucgggcaagaccagaaaauaccucccggcaaucgugcgggaggccauuaagcgccggcugcgcacgcugauacucgcccccacccggguuguggcggccgaaauggaggaggcgcugaagggacugccuauccgcuaccagaccacugccacgaaguccgagcacacaggccgggaaauuguugaccugaugugccacgccaccuucaccaugcgccugcugucccccgugcgggucccgaacuauaaucucauuaucauggacgaggcgcacuuuacagacccugcauccaucgcggcccgcggguacaucagcacacggguggguaugggcgaagccgccgcaauauucaugaccgccacgccgcccgggacggccgacgccuucccccagagcaaugcccccauucaagacgaggagcgcgacauccccgagcgcuccuggaauaguggcaacgaguggauaaccgacuucgcugggaagacagugugguucguaccaagcauaaaggcuggcaaugacauagccaacugucugcggaagaauggaaagaaggugauccagcugucccgcaagaccuuugacacggaguaccagaaaaccaagcucaacgacugggacuucguugucacgaccgacaucagcgagaugggagccaauuucaaggccgaccgggugaucgacccgcgccgaugucugaagccagugaucuugacggacggccccgagcgugucauccucgcgggccccaugccggugacagccgccagugcggcccagcggaggggacggguggggcgcaauccccagaaggagaaugaccaguacauauucacgggucagccgcugaacaaugaugaggaccacgcucauuggaccgaggccaagaugcugcucgacaacaucaacacucccgaggguaucaucccggccuuauuugagcccgagcgggagaaguccgcagcgauagacggcgaguaccgccugaagggcgaaucccggaagacguucgucgagcuuaugcgcaggggggaccugcccguguggcuggcccacaaagucgcuucagaggggaucaaguacaccgaccgaaaguggugcuucgacggccagcggaauaaccagauauuagaggagaacauggauguggagaucuggaccaaggagggugagaagaagaagcugcggccacggugguuggacgcccgcaccuacucugauccgcucgcuuugaaggaguuuaaggacuucgcagccggccgcaagucgaucgcucucgaucucguaacggagaucgggcggguccccacccaccuggcgcaccgcaccagaaacgcccuggacaaccucgugaugcugcacacauccgagcacggcgggaaggcguauaggcacgccguggaggaguuacccgaaacgauggagacacuccugcugcucggucugaugauacugcuaaccgggggcgcgaugcuguuucugaucagcggcaaagggaucggcaagacgagcaucgggcuaaucugcgucauugccuccagcggcaugcuguggauggccgagaucccgcugcaauggauagcguccgcgauugugcucgaguucuucaugauggugcuguugauacccgagcccgaaaaacaacgcacgccgcaggauaaccagcucgccuacgucguaaucgggauucugacacuggccgccaucaucgcggccaacgagaugggccuccuggaaacgaccaagcgugacuugggcaugagcaaggaaccggggguggucucccccacgucguaccucgauguggaccugcacccugccagcgccuggacccuguacgcaguugccacaacggucauaacacccaugcuccggcacaccaucgagaacagcaccgccaacgugucucuggccgccaucgcgaaccaagccguuguccucaugggccucgacaagggcuggcccaucagcaagauggaccugggcgugcccuugcuagccuuagggugcuauucucaggugaacccccuuacccucacugcggccguccugcugcucaucacucacuacgcaauaaucggcccaggccuucaggccaaagcuacccgcgaggcccagaagcggaccgccgcggguaucaugaaaaacccgacggucgacggcaucaugacgauugauuuagaccccgugaucuacgacagcaaguucgagaaacaacucggucaagugauguugcucgugcucugcgccgugcagcugcugcucaugcgaacauccugggcccuuugcgaggcgcucacccucgcuacgggccccaucaccacccugugggaggguagccccgggaaguucuggaacaccacgaucgccguuuccauggccaauaucuuccggggcuccuaccucgcgggggcuggccucgcguucuccaucaugaaaagcguagggaccggcaagcgcggcacugggucccagggcgagacccugggggaaaaguggaagaagaagcuuaaccaguuaagccggaaggaguuugacuuguacaaaaaguccggcauaaccgagguggaucgcacggaggcaaaggaagggcugaagcgcggggagaucacacaccaugccguaaguagggggagcgcaaaacuccagugguucguggaacgaaauauggugaucccggaggggcgcgucaucgacuuaggcugcggcaggggcggguggucuuacuacugcgccggccugaaaaaggugaccgaggugcgcggcuauaccaagggcgggccggggcacgaggagcccguccccaugagcacguacggcuggaauaucgugaaguuaauguccggaaaagacguguucuaccuuccgccugagaaaugcgacacccuacugugcgauauuggcgagucuucucccagcccgaccgucgaggagucccggacaauccgcgugcucaagauggucgagccguggcuaaagaacaaccaguucugcaucaaaguccugaaccccuacaugcccacgguuaucgaacaccucgagcgccugcagcggaagcacggagggaugcugguccgcaacccccuaagucguaacucuacccacgagauguacuggaucagcaacgggaccgggaacaucgucgccuccgucaauaugguuagccgcuuacugcucaaccgguucaccaugacgcaucgacguccgaccaucgagaaggacguggaccuaggcgcaggcacccgccacgugaaugccgaaccggagaccccaaacauggacgugaucggcgaacggaucaagcgcaucaaggaagagcauaacuccacguggcacuaugacgaugagaacccuuauaaaaccugggccuaccacggcagcuacgaggucaaggccaccggguccgcguccuccaugauaaacggcguggugaagcugcucacaaagcccugggaugucgugccaauggucacucaaauggcuaugaccgacaccaccccuuucgggcagcaaagaguguucaaggagaagguggacacccgcaccccacggagcaugccgggcacccgccgggucaugggaauuaccgcagaguggcuguggcggacgcuggggcggaauaaaaagccccgcuuguguacccgggaggaguucaccaaaaaagugaggaccaacgccgcgaugggcgccguauucacggaggagaaccagugggacucggccaaggccgccgucgaggacgaggacuucuggaagcugguggaucgggagcgggaguuacauaagcucgggaagugcgguuccugcgucuacaacaugauggggaagcgcgagaagaagcugggcgaguucggcaaggcgaaggggagcagggccaucugguacauguggcuaggcgcccgcuaucucgaguucgaggccuugggguuccugaacgaggaccauugguuuagccgggaaaacagcuacucaggcgucgagggggaagggcuccacaaguuagguuacauucuacgcgacauaagcaaaauccccgguggcgccauguacgcggacgacaccgcagggugggacacccggauuaccgaggacgaccuccacaacgaggagaaaaucacgcaacagauggacccggagcaccgucagcuugcgaacgccaucuucaagcugaccuaucagaacaagguugugaagguccagcggcccacccccaccggcacggugauggacaucaucucccgcaaggaccagcgggggucaggccaggugggcacguacgggcucaacacauucaccaauauggaggcccagcugauucgccagauggaaggcgaggguguacuguccaaggcggaccucgaaaacccccaccuaccugaaaagaagaucacccaauggcuggagacgaaggguguggagcggcucaagcgcauggccauuagcggcgacgauugugucgucaagcccauagaugaccgguucgccaacgcacugcuggcauuaaacgacauggguaagguccgcaaagauaucccucaguggcagcccuccaagggcuggcaugacuggcagcaggucccguuuuguagccaccacuuccacgagcugaucaugaaagacggucggaagcucgucgugcccugucggccccaagacgagcucaucggacgggcgcgcauuucccagggggcaggcuggucucugcgggagacagcgugucugggaaaggccuaugcgcagauguggucccucauguacuuccaccgccgcgacuugcggcuggccagcaacgccaucuguuccgcagugcccgugcauugggugccaaccagccgcacuacgugguccauccacgcccaccaccaguggaugacaaccgaggacaugcucaccguguggaaccggguuuggaucgaggauaaccccuggauggaggacaagacgcccgugacgaccugggaaaacguucccuaccuagggaagcgggaggaccaguggugcggcagccugaucgggcucaccagccgggcaacgugggcucagaauauuccgaccgccauccagcagguucgcucccuaaucggcaacgaggaguuccuggacuacaugcccuccaugaaacguuuccgcaaggaagaggagucggagggcgccauuugguga

SEQ ID NO: 26094 - RNA, 9873 nt, Artificial Sequence
  derived and/or modified CDS sequence (opt11) from DENV-3__EU482614__SS-prME
accagccugugccugaugaugauccugcccgcugcccuggcauuccaccucaccagccgggacggggaaccccggaugauuguggggaagaacgagcggggcaagagccugcuguucaagacggccucgggcauuaacaugugcacgcucauagccauggacuugggcgagaugugcgacgacaccgugacauacaagugcccgcauauaacugagguugagcccgaggacaucgacugcuggugcaaccugaccagcaccugggugaccuaugggacgugcaaccaggccggcgagcaucgacgcgacaagcgguccguugcccucgcgccccacgugggcaugggcuuggacacucgcacccagaccuggaugucugccgagggcgcguggcgccagguggaaaaggucgagacgugggcccuacgccacccggguuucaccauacucgcccuguuccuggcccacuacauaggcaccucccucacccagaagguuguuaucuucauccuccugaugcucgucacgcccucuaugaccaugcguugcgugggagugggaaaccgagauuucgucgagggccuguccggggcgaccuggguggacgugguucuggagcacggcggaugcgugaccaccauggccaagaacaagccgacccucgacauagaguuacagaagacugaagccacccagcuggccacgcuccggaagcugugcaucgaaggcaaaaucaccaauaucacuaccgacagccgcugccccacccagggcgaggccguacugccggaggagcaggaccagaacuacgucugcaagcacaccuacgucgaccggggauggggcaacggguguggucucuucgguaagggcucccuggugaccugcgccaaguuucagugccuggagcccaucgagggcaaggucgugcaguacgaaaaccucaaauauaccguuaucaucacgguccauaccggcgaccagcaccaagugggaaacgaaacgcagggggucaccgcagagaucacgccgcaagccaguacaaccgaggcgauccucccagaguacggcacccugggacucgagugcuccccgcgcacuggucuggacuucaacgagaugauccugcucacgaugaaaaacaaggccuggauggugcaccggcagugguuuuucgaccugccccugccguggaccagcggggcaacgaccgagacgccgaccuggaaccgaaaagagcugcuggucaccuucaagaacgcgcacgccaagaagcaggagguuguagugcuggggucccaggagggcgccaugcacacagcccuaaccggggcgacggagauucaaaacagcggcgggaccuccaucuucgcaggccaccucaagugcagacugaagauggacaagcucgaacuaaagggcaugagcuacgccaugugcaccaauacguucguccucaaaaaagagguguccgagacgcaacacgguacgauccucaucaagguggaauacaagggggaggacgucccgugcaagaucccguuuagcaccgaggacgggcagggcaaggcacacaauggacgucugaucacggccaaccccgugguaaccaaaaaggaagagccggucaacaucgaagcggagccucccuuuggugagagcaacaucgugaucgggaucggagacaacgcgcuuaagauuaacugguacaagaagggcuccuccaucgguaagauguucgaggcgaccgcccggggcgcccgccggauggccauccuuggcgacaccgccugggauuucggguccgugggcgggguccucaacagccugggaaagauggugcaccagauuuuuggaucagcuuauacagcccuguucagcgggguguccugggucaugaaaaucggcaucgguguguuguugaccuggauagggcuaaacagcaagaacaccuccaugagcuucuccugcaucgcgaucgggaucaucacccucuaccugggcgccgucguucaagcggacaugggaugcgugaucaauuggaagggcaaagagcugaaguguggcagcggcauuuuuguuacuaaugagguccacacauggaccgagcaguacaaguuccaggcggauagccccaaacgcuuagccaccgccaucgccggcgcaugggagaacggggugugcggcauccgcagcacgacccggauggagaaccugcuauggaagcagaucgcuaacgagcucaauuacauccucugggagaacaauaucaaguugaccguagucguaggggacaucauuggcgugcucgaacaaggcaagcguacgcucacgccccagcccauggaguugaaauacagcuggaaaaccugggggaaggcaaagauagucaccgcggagacccagaacagcuccuuuaucaucgauggccccaacacgcccgagugccccagcgccucgcgggcguggaaugugugggagguggaagacuacggguucggagucuucaccaccaacaucuggcucaagcugcgcgagguguacacccagcugugcgaccaccggcuaauguccgcagccgucaaagaugagagagcaguccacgccgacaugggcuacuggaucgagagccagaagaacgggucguggaagcuggagaaggcgagcuuaaucgaggugaaaaccugcacguggccaaagucccauacucuuuggagcaacggcguguuggaauccgacaugaucauccccaagagccuugccgggcccaucucccagcacaauuaucggccgggauaccacacacagacugccgggcccuggcaccucggcaagcucgagcuggacuucaauuauugugagggcacgaccguagugaucaccgagaauugcgggacccggggccccagucuacggacgaccacuguauccgggaagcugauccacgaguggugcugucgcagcugcacccugccgccgcuucgguauaugggcgaggacgggugcugguacggcauggagauccgccccaucuccgagaaggaggagaacauggucaagagcuugguaagugccggcuccggggagguagauaacuuuacgauggguguccugugcuuggccauccuguucgaggaggugaugcgagggaaguucgguaagaagcacaugaucgcaggaguauucuucaccuucgugcugcuccuguccggacagaucacguggcgugacauggcgcacacccuuauaaugaucgguucaaacgccuccgaccggauggggaugggcgugacuuaccucgccuuaaucgccacguucaagauacagcccuuccuggcgcucggguuuuuccugcgcaagcugaccagccgggagaaccucuuacugggcgugggccuggccauggccacgacgcugcagcugccugaggacaucgagcagauggccaacgggaucgcgcucggauuaauggcucucaagcucaucacccaauucgagaccuaucagcuguggaccgcccuuauuagccucaccugcuccaacacaaucuucacacugaccgucgcguggcgcacggccacccugauccucgcgggggugagccugcucccggucugccaguccucguccaugcggaaaaccgacuggcucccgaugaccguagcggccaugggcgugccgccccucccgcuuuucauauucucacuaaaggacacgcugaagcgccgcuccuggccgcuaaacgagggugucauggcggugggccucgugagcaucuuggccucuagccugcuccggaacgacgucccaauggcgggcccccuaguggccgggggucugcucaucgccuguuacgugaucacugggaccuccgcugaucugaccgucgaaaaggccgcggacgugacuugggaggaggaggccgagcagacaggcgugagccacaaccugaugaucaccguagacgaugacgggaccaugcgcaucaaggacgacgaaaccgaaaauauccucacgguacugcugaagaccgcgcuccuaauuguaucgggcauauucccguacucuauuccugccacccugcucguuuggcacaccuggcagaaacagacucagcgguccggugugcugugggacgucccuagcccgcccgaaacccagaaggccgagcuggaggagggggucuacagaaucaaacagcaaggcaucuucgggaaaacccaggugggcgucgggguccagaaggagggcgucuuccacacuauguggcacgugacgcggggagcuguccuaacucacaacgggaagcgccucgaacccaacugggccagcgugaagaaagaccugauaagcuacggcggcggcuggcggcucucagcgcaguggcagaaaggugaggagguucagguuaucgcgguggagcccggcaagaaccccaagaacuuucagaccaugcccggcaccuuccagacgaccacgggggaaaucggcgcgauugcccuugacuucaagcccgggaccagcggcucucccaucauaaaccgugaggguaagguggucggguuguacggcaacgggguggugacgaagaacggcggguacgucuccggcaucgcccagaccaaugcggagccggacggccccacccccgagcuggaggaagagauguuuaagaagaggaaccuuaccaucauggaucugcaccccgguaguggcaagacgcgcaaguaccugccggccauugugcgagaggcgaucaagcgccggcuccgcacccugauccucgcccccacccggguaguagcugccgagauggaggaagcucuuaaggggcugcccauacgcuaccagaccacggcgaccaaguccgagcacaccggccgugagaucguugacuugaugugccaugcaaccuucacgaugcgccuacuaagucccguucgggucccgaacuacaaccugaucaucauggaugaggcccacuucaccgaccccgcuaguaucgccgcgcgugguuacaucagcacccgagugggcaugggcgaagccgccgccaucuucaugaccgcgacgccgcccggaacugccgacgccuucccgcagucgaacgcccccauccaggacgaagagcgcgacauccccgagcgcagcuggaacucgggcaaugaguggaucaccgacuucgccgggaagaccgucugguucguaccuagcauaaaagcgggcaacgacaucgcaaacugccuccggaaaaacggaaagaaggugauacaacugucccgcaagacguucgauacugaguaccagaagaccaagcugaacgacugggacuucguggucacaaccgauaucucugaaaugggcgccaacuucaaggccgaccgugucauagacccucgccggugccugaaacccgugauccugaccgacggccccgagcgcgugauccuggccggacccaugcccgugaccgcggccuccgccgcccagcggcgcggccggguggggcgcaacccccagaaggagaacgaccaauauaucuuuacgggccagccccucaacaacgacgaggaccacgcccacuggacagaggccaagaugcugcuugauaacaucaauacgcccgaagggauuaucccggcccucuucgagcccgagcgggagaagucggccgcuauagacggcgaguaccgcuugaagggggaaucccggaagaccuucgucgaacugaugcggcgcggggacuugccuguguggcuggcgcacaaagucgccucugagggcaucaaguacaccgaccgcaaguggugcuucgacggucagcggaacaaccagauccuagaagaaaacauggacguggaaauauggacuaaagagggcgagaagaagaagcugcgcccccgguggcuggaugcacggacguauuccgauccguuagcccucaaggaauucaaagacuucgccgcgggccgaaagagcaucgcccuggaccuugugacggaaauagggcgggucccaucccacuuagcccaccgcacgcggaacgcccuggacaaccuggucaugcuccacaccucggagcacggggggaaggcguaucgccacgcgguggaggagcugcccgagacaauggaaaccuuacugcugcugggccucaugauccuccugaccgggggcgcaaugcucuuccugaucagcggcaaggggaucggcaagacuucuaucggguuaaucugugucaucgccagcuccggcaugcucuggauggccgagaucccgcugcaauggauugccagugcgauugugcuagaguuuuucaugauggucuuauugauccccgagcccgagaagcagcggacgccccaggacaaccagcuggcguacgucgugaucggaaucuuaacccuggccgccaucaucgccgcaaacgaaaugggccuacucgagaccacaaaaagagaccugggcauguccaaggagccggggguggucagcccuacguccuaccuggacguggaccuccaccccgccagcgccuggacccucuacgccgucgcgaccacugucaucacgccaaugcugcggcauaccaucgagaacuccaccgccaacgugagccuggcagcuauugcaaaucaggccgugguuuugaugggccuagacaagggguggccuauuuccaagauggaccucggcgugccgcugcuagcccucgggugcuacagccaggugaacccacugacccugacggcagccguccuccuacugaucacccacuacgccaucaucggcccgggucuccaggcaaaggcgacccgcgaggcgcagaaacguaccgccgcugggaucaugaagaacccgacgguggauggcaucaugaccaucgaccuggaucccgugaucuaugacucuaaguuugagaaacagcuagggcaagucaugcuccugguccugugugcggugcaguuacuauugaugcguaccagcugggcgcucugugaggcccucacgcuggcaacggggcccaucaccacccucugggaaggcucgcccgggaaauucuggaacaccacuaucgcggucagcauggcaaacaucuuucggggcuccuaccuggcgggggccggucuggcuuuuagcaucaugaagucugucgggaccggcaagaggggcacgggaagccagggcgagacccucggggaaaaguggaagaagaagcuuaaucagcugagccggaaggaguucgaccucuacaagaaaagcggcaucaccgagguagaucgcacggaggcgaaggagggauugaagcgaggcgagaucacccaccacgccgucagccgcggauccgccaagcuacaaugguucguggagcgaaacauggugaucccggaggggcgcgucaucgaccucgggugcgggagagguggguggagcuacuauugcgcuggccugaagaaggugaccgaggugcgcggcuacacaaagggcgggccugggcacgaggagcccguccccauguccacguacggcuggaacaucgugaagcuuaugagcggcaaggauguguuuuaccucccuccggaaaagugcgacacccugcucugcgacaucggcgaauccagccccaguccaaccgucgaggaaagccguacuauacgugugcugaagaugguggagccguggcucaagaacaaccaguucugcaucaaaguccugaaccccuacaugcccacuguuaucgagcaccuggagagauugcaacggaagcacggcgggaugcugguaagaaacccccugucccggaacuccacccacgagauguacuggauuucgaacggcaccgggaauauuguggcgagcgucaacauggucucccgccuucugcugaaccgguucacgaugacgcaccgccggccgaccaucgagaaggacgucgaucucggcgcgggcacacgccacgugaaugcagagcccgagacacccaauauggaugugauuggagagcguaucaaacggaucaaggaggagcacaauuccacguggcacuaugacgacgaaaacccguauaagaccugggccuaccacggguccuaugaggucaaggccacggggucugccuccagcaugaucaacggcguggucaagcugcugaccaagcccugggacguggugcccauggugacccaaauggcgaugaccgacaccacccccuucgggcagcagcggguguucaaggaaaagguggacacgagaacgccgcgaucuaugcccggcacgcgacgugucaugggcaucaccgccgaguggcuuuggcgcacguuggggcggaacaagaagccacgccugugcacccgggaggaauucaccaagaaggugcgcacaaaugccgccaugggcgcgguguucaccgaggagaaccagugggacagugccaaggccgccgucgaggacgaagacuucuggaagcucguggacagagagagagagcugcacaagcugggcaaguguggcucaugcguguacaacaugaugggaaagcgcgagaaaaagcugggcgaguucggcaaggcuaagggaucacgggccauuugguacaugugguuaggcgcgcgcuaucuggaauuugaggcacucggguuuuuaaaugaggaccacugguucagccgggaaaacuccuacuccgguguggagggggagggacugcacaaacucggcuacauccuacgcgacaucuccaagaucccugggggcgccauguacgcagacgacaccgcgggaugggauacccggaucaccgaagaugaccugcacaacgaggagaagaucacgcagcaaauggaccccgagcaccgccaguuagccaacgcgaucuucaagcugaccuaucagaacaaggugguuaagguucagcgcccaacgccuacaggcaccgugauggacaucaucagucgaaaggaccagcggggcuccggccaggugggaacguacggacugaacaccuucacgaauauggaggcccagcucaucagacagauggaaggagaggguguacuaucaaaggccgaccuggagaacccccaccucccagagaagaagaucacgcaguggcuagaaacgaagggcguggaacggcugaagcgcauggcuauuuccggcgacgauugcguggucaagcccaucgacgaccgguuugccaacgcacuccuggcacuuaacgauaugggaaagguccgcaaggacaucccccaguggcagccgucuaaggguuggcacgacuggcagcagguuccguucugcucucaccacuuccacgagcucaucaugaaggacgggaggaagcuugucgugcccugccgcccccaggacgaguugaucggacgggcucgcaucagccagggggcgggcuggucccuccgggagaccgccugucugggaaaggccuacgcgcaaauguggagccugauguacuuccaccgccgcgaccucagacuagcuaguaacgccauuugcagcgccgugccgguacacugggucccgaccucccgcaccacauggagcauccacgcccaccaccaguggaugaccaccgaggauaugcugaccguguggaaucgggucuggauagaagacaacccuuggauggaagauaagacgcccgugaccacgugggagaacgugccguaccucgggaagcgcgaggaccaguggugcgggagccugaucgggcugacuucccgggccacuugggcgcaaaacauuccgaccgccauccagcagguccgcagccucaucggcaacgaggaguuccuggacuacaugcccucuaugaagcgguuccgcaaggaggaggaaagcgaaggggccaucugguaa

SEQ ID NO: 26095 - RNA, 9873 nt, Artificial Sequence
  derived and/or modified CDS sequence (opt11) from DENV-3__EU569690__SS-prME
accagccucugucucaugaugaucuugcccgccgcacuggcguuccaccucacuucucgggauggagaaccgaggaugaucguagggaaaaacgagcgggggaaaucgcugcuauucaagacugccuccgggaucaacaugugcaccuuaaucgccauggaccugggcgagaugugugacgauacugugacuuacaaauguccccauauuacggaggucgaaccagaagacaucgacugcuggugcaaccugaccagcaccugggugacuuacgggaccugcaaccaggccggugaacaccgacgggacaaacgguccguagcacucgcgccccacgugggcaugggucuggacacucggacccagaccuggaugagcgcggagggcgccuggcgccagguugaaaaggucgagacgugggcauuacgucacccgggguucaccauccuugcgcuauuccuggcccauuacaucgggaccucccuaacccaaaagguagugaucuucauccuacugaugcucgucacacccagcaugaccaugcgcugcguaggggucggcaaucgggacuucguggagggccuguccggcgccaccuggguugacguaguccuggagcacggcgggugcgugacuaccauggccaaaaauaagcccacgcucgacauagagcuacaaaagaccgaggccacacagcuugcgacccuccgcaaacuuuguauugaagggaagauaaccaacaucacaaccgacagccgcugccccacucaaggcgaagcuguguuaccggaggagcaggaccagaacuacgucugcaagcacacguacguggaccgggggugggguaauggguguggccucuuugggaagggcucccuaguaaccugcgcuaaguuucagugccucgaaccuaucgagggcaaggugguacaguacgagaaucucaaguacaccgugaucaucacgguccacacuggggaccagcaccaggugggcaacgaaacccaggggguaaccgccgagaucacgccccaggcgagcaccaccgaggcgauccugcccgaguacggcacccucgggcucgagugcuccccgcgcaccggccuggauuucaacgagaugauucugcucacaaugaagaacaaggccuggaugguccaucggcaaugguucuuugaucuacccuuacccuggacuagcggcgcuaccaccgagacccccaccuggucccggaaggagcuccuggucaccuucaagaacgcgcacgccaagaagcaggaggucguaguccuggggagccaggaaggcgcgaugcacaccgcucucacgggagccaccgagauccaaaauuccggcggcaccucaaucuuugcgggccaccuaaagugucgucugaagauggauaagcucgagcugaagggcauguccuacgcuauguguaccaacacguucguccugaagaaggagguaagcgagacacagcacgggaccauccucaucaagguggaguacaaaggggaggacgucccguguaaaaucccauucucaacugaggacgagcaagggaaggcucacaacgguaggcugaucacggccaaccccguggucaccaagaaggaggagcccgucaacaucgaagcggagccacccuuuggugaauccaacaucgugauugggaucggugauaacgcccuuaagaucaacugguacaagaaggggaguuccaucggaaagauguucgaggcgacggcccgcggggcccgccgcauggccauccugggcgacaccgccugggacuucgguagcguagggggaguccucaacucucuggggaagauggugcaccaaaucuucggcagcgccuacacggccuuauucagcgguguuaguugggucaugaagaucggcauuggcgugcuccuaaccuggaucgggcuaaauuccaagaacaccagcaugaguuucagcugcauugccaucgguaucaucacucuguaccuaggggccguuguucaggccgauaugggaugcgugaucaauuggaaggguaaagagcugaagugcggcucugggaucuucgugacaaaugagguccacaccuggacugaacaguacaaauuccaggccgacucccccaagcgccuugccaccgcgauugccggagccugggagaacggugucugcgggauccgcuccacgacccguauggagaaucugcuguggaagcagaucgcgaaugaacuaaauuacauccugugggagaacaacauaaaguugacugugguugugggcgacauuaucgggguccucgagcagggcaagcgcacccucaucccgcagccgauggagcugaaguacagcuggaagacuuggggcaaggccaagaucgucaccgccgagacccagaacaguagcuucaucaucgauggcccuaacacccccgagugucccagugccagccgggcguggaaugugugggagguggaggacuaugguuuuggagucuucacgacgaacauaugguugaaguugagagaggucuacacccaacugugcgaccaccgccucaugagcgccgccgugaaagaugagagagccguccacgcagacauggguuacuggaucgagucccaaaagaacggcagcuggaaguuagagaaggcaagucugaucgaggugaagacaugcacuuggccuaaaucccacacccucuggucaaauggcgugcuagaaucagauaugaucauccccaagagcuuagccggcccaauaagccagcacaauuacaggcccggguaccauacccagacagccggccccuggcaccuaggaaagcuagagcuggacuucaauuacugcgaggguaccacgguugugaucacugagaauugcggcaccagagggcccucccucagaaccacgacugugagcggcaaguugauccacgagugguguugccgcuccugcacacuaccuccacucagguacaugggggaggaugggugcugguaugggauggagauucgccccaucagcgagaaagaggagaacaugguuaagucccuggugagcgccggcagcggcgaaguugacaacuucacuaugggcgugcuuugcuuggccauccuauuugaagaggugaugcggggcaaguucgggaagaagcacaugauagcggggguguucuuuaccuucguccugcuacugagcggccagaucaccuggcgugacauggcccacaccuuaaucaugaucgguuccaacgcgagcgaccggaugggcaugggggugaccuaucucgcccuuaucgcaacuuucaagauccagcccuuccuggcgcucggcuuuuuccugcgcaaauugaccagccgggagaaccuccuccuggggguaggcuuagccauggcuaccacgcugcagcuacccgaggauauugaacagauggccaauggcaucgcucucgggcugauggcccuuaaacucauaacgcaauucgaaaccuaccagcuguggaccgcguuaauuucucugaccugcagcaauacaaucuuuacgcugaccgucgccuggcgcaccgcgacccugauucucgcgggcguuucgcugcugccagucugucagagcuccucgaugagaaagacggacuggcugccaaugaccguggcggccaugggggugccgccucuuccacuguuuaucuucucccucaaggacacccuaaaacgccgcucauggccacugaacgagggagucauggccgugggccucguguccauccuggccagcucccuucuccggaacgacguccccauggcggguccccugguggcuggcgggcuccuuaucgccugcuacgugaucacgggcaccagcgccgaccuaaccguugagaaggcagcggacgugaccugggaggaagaggcugagcaaacggggguaucccacaaccugaugaucaccgucgaugacgacggcaccaugcgcaucaaggacgacgaaaccgagaacauccucaccgugcuucugaagacggcucuuuuaaucgugucggggaucuuuccguacuccauccccgccacccugcuggucuggcacaccuggcaaaagcagacccagagaagcggcguacugugggacgugcccucaccacccgaaacccagaaggccgaacuggaggagggcgucuaccgaauuaagcagcaggggaucuucggcaaaacccaggugggagugggaguccagaaggaagggguguuucacaccauguggcauguaacccgcggcgcgguccucaccuacaaugguaagcgcuuggagcccaacugggcuuccguuaagaaggaccuaauuuccuauggaggcggguggagacuaucagcccaguggcagaagggcgaagaggugcaggucauugccguggaacccgggaagaaccccaagaauuuccagacaaugcccggcaccuuccagaccacgacaggcgagaucggagcaaucgcucuggacuuuaagcccggaacaagugggucccccaucaucaacagagaaggcaagguggucggccuguacggcaacggcguggugaccaagaaugggggcuacguaagcgggaucgcccagaccaacgcggagccggacggccccacccccgaguuggaggaagagauguucaagaagcgcaaccucacuaucauggaccugcaccccggcuccgggaagacgcgcaaguaccuaccugccaucgugagggaggccaucaagagacggcuuagaacacugauauuagcccccacacguguggucgcagcggagauggaggaggcacucaagggccugcccauccgcuaucagaccaccgcgaccaagagcgagcacacgggccgggagaucguggaccugaugugucacgccacguucaccaugaggcuccugucucccguucguguaccaaacuacaaccugaucaucauggacgaggcgcauuucacugacccggcgucaauagccgcgcgugguuacaucucaacccggguggggaugggugaagcagccgcaauauuuaugacggcgacgccgcccggcacagccgacgccuucccgcagucuaacgcucccauccaggacgaggagcgcgacaucccagagcgcuccuggaauagcgguaacgaguggaucaccgauuucgccggcaagaccgugugguuugugcccuccaucaaggccgguaacgauauagccaauugccuccggaaaaacgguaaaaaggugauccagcugucccgcaagaccuucgauacggaauaccagaagacuaagcugaacgacugggacuucguggucacaacagauauuuccgaaaugggagccaauuuuaaggccgaccgggugaucgacccgcgccggugucucaagccugugauacuuacggacggccccgagcgggucaucuuagccggccccaugccggugaccgcggcaagcgccgcccagcggcgcgggcgggugggccguaacccccagaaagagaacgaucaguacauuuuuaccgggcaaccucucaacaaugacgaggaccacgcacacuggacagaggccaagaugcuccuggacaacauaaacaccccagagggcauaaucccugcccucuucgaacccgagcgggagaaguccgccgcaaucgacggcgaauacagguuaaagggcgagagccggaagacauucgucgagcugaugcgccggggcgaccuccccguguggcuggcacauaaaguugcauccgaaggaaucaaguacaccgaccgcaaguggugcuucgauggucagcggaacaaccaaauucuagaagaaaauauggacguggagaucuggacaaaagagggggaaaagaagaaacuccgccccagguggcuggacgcacguaccuauagcgaucccuuagcccuaaaagaauuuaaggacuucgcugcgggucgcaaguccauagcccuugaccuggugaccgagaucggcagaguacccacccaccuagcgcaccgaacccggaaugcccuggauaaucuggucaugcuccacacaagcgagcacgggggcaaggccuaccgccaugcgguggaagaacugcccgagacgauggaaacccugcuacugcuggggcucaugauacugcugacgggcggggccaugcuguuccuaaucucagguaagggcaucgggaagacauccaucggccugaucugugucauagccagcuccggcauguuguggauggcagagauuccgcugcaguggauagcuagcgcuauagugcuggaguucuuuaugaugguccuccuuauaccagagcccgagaagcaacggacgccacaggacaaucaacuggccuacgucguuaucggcauacuuacucuagcugccaucaucgccgcgaacgagaugggguuacuggagaccaccaagagggaccugggcauguccaaggagccuggcguggucagccccacguccuaccuggacguggaccuccacccagccuccgccuggacccuguacgcgguggcgacaaccguaauaacccccaugcugaggcacaccauugagaacuccaccgccaacguuagccucgccgcaaucgcgaaccaggcgguuguucuaaugggccuggacaaaggcuggccgaucuccaagauggaucucggugugccccugcuggcccucggcugcuauagccaggugaaccccuugacccugacggccgcgguacuccugcucaucacccacuacgccaucauuggcccgggccuccaggcgaaggccacgcgcgaggcccaaaagcgaacggcugccggcauaaugaagaaccccacgguggacggcaucaugaccaucgaucuggacccggugauuuacgacucuaaguucgagaagcaacugggccaggucaugcuccuggugcugugcgcugugcagcuccugcucaugcgcaccagcugggcccucugcgaggcccugacccuggcuacgggcccgaucaccacccucugggaaggcuccccuggcaaauucuggaacaccacgaucgcuguuucgauggccaacauauuccgggguucguaccuagccggugcagggcucgcguucagcauuaugaaauccgugggcacugggaagcgcggcaccggcagccagggggaaacccucggcgaaaaguggaagaagaagcugaaccagcuaagccggaaggaguucgaccuguacaaaaaguccggcaucacagagguggaccgcaccgaggcaaaggagggccugaagagaggggagaucacccaucacgccgucucgcggggcuccgccaaguugcaaugguucguggagaggaacauggugaucccggagggccgcgucaucgaccucggaugcggacgcggaggguggagcuacuauugcgccgggcugaagaaagugacugaggugcguggcuacaccaaaggcgggccaggccacgaggagcccguccccaugucgacauacggguggaacaucgugaaacugaugagcgggaaagacguguucuaccucccgcccgaaaagugugacacccugcucugcgacauuggggaguccagccccucuccaaccgucgaggagagccggaccauacgcguccugaagaugguagagcccuggcucaagaacaaccaguucugcaucaaggucuuaaacccguauaugccuacagugaucgagcaccuggagcgccuccagcggaagcacggaggcaugcuggugcgcaauccucuuagcagaaacuccacccacgagauguacuggaucuccaacgggacugggaacauaguggccagcgucaacaugguuucccgccucuuauugaaccguuucacaaugacucaccgacguccgacgauugaaaaggacgucgacuugggugccggcacccgccacguaaacgccgagcccgaaacccccaauauggacgugaucggcgaacggaucaagcgcaucaaggaggaacacaacagcacguggcacuacgacgacgagaacccguacaagaccugggccuaccacgggagcuacgaggucaaggccacagguagcgccucuuccaugaucaacgggguuguaaagcugcuaaccaaacccugggacguggugcccauggucacucaaauggcgaugacggacaccacccccuuuggccagcaacggguguucaaggagaagguggauacgcgcacaccucggagcaugcccgggacgcgcagggucauggguaucacagcggagugguuauggcgcacgcucggccggaacaagaagccccgccugugcacccgggaggaguucacaaagaaggugcgcaccaacgcagccaugggggcgguguucacggaggagaaccagugggauuccgccaaggcugcaguggaggacgaggacuucuggaagcucguggaucgcgagcgggagcugcauaagcuggguaagugcgggagcugcguguacaacaugaugggcaagcgcgaaaagaaauugggcgaguucgguaaggccaaagggucgcgugcgauuugguacauguggcugggggcgcguuaucuagaguuugaggccuuaggguucuugaacgaggaccauugguucagccgcgaaaacuccuacuccgggguggaaggggagggguuacauaagcuaggcuacauccugcgcgacauuagcaaaauccccggaggggccauguacgcggacgacaccgcggguugggauaccagaaucaccgaagaugaucugcacaacgaggagaagaucacgcagcagauggauccggaacaccgccaacucgcgaacgccaucuucaagcugaccuaccaaaacaagguggucaaaguccagcggcccacccccaccgggaccgugauggacauaaucagccgcaaagaucagcgggguuccggacaggugggcaccuauggauuaaacacauuuaccaauauggaggcgcaacucaucagacagauggagggagagggcguccugagcaaggccgaccuggagaacccccacuuaccggagaagaagauaacccaguggcuugagacgaagggcguggagcggcucaagcguauggcaaucuccggggacgauuguguagucaagcccaucgacgaccgcuucgccaacgcucuccuggccuuaaacgauaugggaaagguccguaaggacaucccacaguggcagcccucuaaaggguggcacgacuggcagcagguaccguuuugcucccaucacuuccacgagcucaucaugaaggacgggagaaagcuggucgugcccugccgcccacaagacgaacugauagggcgggcccguauaagucaaggcgccgguuggagccuccgggagaccgcuugccuggggaaggccuacgcacaaauguggagccugauguacuuccacagacgcgaucuccggcuagccucaaacgcaaucugcagcgcagugcccguccauugggugccaaccucccgcaccacguggagcauccaugcccaucaccaauggaugaccacggaggacaugcugaccguguggaaccggguauggauugaagauaaccccuggauggaggacaaaacgcccgucaccaccugggagaacgugcccuaccuggguaagcgagaggaccaguggugcggcagcuugaucgggcucaccagccgggcgacgugggcgcagaacaucccgaccgcgauccaacagguccgcagccuuaucggcaacgaggaguuccuggacuacaugccguccaugaagcgguucaggaaggaggaggagagcgagggcgccauuugguaa

SEQ ID NO: 26096 - RNA, 9873 nt, Artificial Sequence
  derived and/or modified CDS sequence (opt11) from DENV-3__EU569691__SS-prME
accucccucugucuaaugaugauccugcccgccgcccuggcguuccaccucacuucccgggacggggagccccggaugaucguggggaagaacgaacgggguaagagccuacuguucaagaccgccucggggaccaacaugugcacgcucauagccauggacuuaggcgagaugugugacgauaccgugaccuacaaguguccccacaucaccgaagucgagccagaggacauagauugcuggugcaaccucaccagcacuugggugacauacggaaccugcaaccaggcaggcgagcaucgacgcgacaagcgguccguugcccucgcgccccacguaggcauggggcuggauacccgcacccagacguggaugagcgccgagggugccuggcggcagguggagaaggucgagacgugggcacugcgccacccgggguucacuauccuagcccucuuucuggcucacuacaucggcacaucccucacgcagaaggucgugaucuuuauccuacugaugcucgucacuccuagcaugaccaugcggugcgugggcgucggcaaccgugacuucgucgaaggccuguccggggccaccuggguggacgugguauuagagcauggcgggugcgugacgacaauggccaagaacaaaccaaccuuggauauugagcugcagaagacugaggccacgcagcuggcgacccuacggaaacugugcaucgagggcaagaucaccaacaucacuacggacagccgcugccccacccagggagaggcggugcucccggaagagcaggaccagaacuacgucugcaagcacaccuacguggauaggggcuggggaaacggaugcgggcucuucgggaagggcucccuggugaccugcgcgaaguuccagugccuggaacccaucgaggguaaggucgugcaguaugaaaaccucaaauacacggugaucaucaccgugcacacuggggaucaacaucaggugggcaacgagacccagggggucacggccgagaucaccccacaagccagcaccaccgaggcuauccuccccgaauacggcacccugggucucgaguguucgccgcgcacgggacuggacuucaacgagaugauucugcucaccaugaagaauaaggccuggauggugcacagacaaugguucuucgaucugccgcugcccuggacgucuggagcuaccacugagacaccgaccuggaaccgcaaggagcuccuggugaccuucaagaacgcccacgccaagaagcaggaggugguagugcuggggucccaagagggcgcuaugcacacugcgcucacgggagccacagagauccagaacagcggcgggacgucaauuuuugccgggcacuugaagugucgucugaagauggacaaacucgaacugaaaggcaugucuuaugccauguguaccaacacguucgucuugaaaaaggagguguccgagacucagcacgggaccauccucaucaagguggaguacaagggcgaggacguaccuugcaagauuccauucagcacggaggacgggcagggcaaggcacacaacggcagacucaucacugcaaaccccguggucaccaagaaggaggagcccgucaauaucgaggccgagccgcccuucggggagagcaacaucgugaucggcaucggggacaacgcccugaagaucaauugguacaagaagggcuccagcauugguaagauguucgaggcgaccgccaggggcgcacgccggauggcuauccugggcgacacggccugggauuucgggagcgugggagguguccucaacagccugggcaagauggugcaccagaucuuuggguccgcguacaccgcacuguuuagcggggugagcugggugaugaaaaucggcaucgggguccuccugacauggauaggccugaacaguaagaacaccucaaugagcuuuuccugcaucgcgaucgggauuauaacgcucuaccugggcgccgugguccaggcugacauggggugcgugaucaacuggaagggcaaggagcugaagugugguaguggaaucuucgugacaaaugagguccauaccuggaccgagcaguacaaguuccaggccgacucccccaaacgccucgcgacggccauugccggcgccugggagaauggggugugcggcauccgcaguaccacccggauggagaaccugcuuuggaagcagauagcgaaugaacucaacuauauuuugugggagaacaacaucaaacugacagugguugugggggacauaaucggaguguuggagcagggcaagcgcacgcugacaccccaaccgauggaguugaaguacuccuggaagaccugggguaaagccaagaucgugacugcggagacucagaacagcucuuucaucaucgacggccccaacacccccgagugcccaucugcgucccgggccuggaacgucugggagguggaagacuacggguucggcguauucacuaccaacauauggcucaagcugcgcgagguguacacccagcucugcgaccaucggcucaugucggcggcaguaaaggacgagcgcgccguccaugccgauaugggcuacuggaucgagagccagaagaacgguuccuggaagcuggagaaggcgucauuaaucgaggugaagaccuguacguggccgaagucucacacccucuggagcaacggcguccuggaauccgacaugauaauccccaagagccuggccgggcccaucagccagcacaacuaccguccgggauaccacacucaaacggccgggccguggcaccuaggaaagcuugagcuggauuuuaacuauugcgagggcacuacugucgugauuaccgagaacugcgggacgcgcggcccgagccuccggacgaccaccgugagugggaagcucauccacgaauggugcugccggagcugcacgcugcccccgcugcgguauaugggagaggacggaugcugguacggcauggagauccgaccuaucuccgagaaggaagagaacaugguuaagagccuggucuccgccggcagcggggagguugacaacuucaccaugggcguccuguguuuggccauacuauucgaagaggugaugcggggcaaguucgggaagaagcauaugaucgcggggguguucuucaccuucgugcugcuguugucaggccagaucaccuggcgcgacauggcgcauacacugaucaugaucggaagcaacgccagugaccggauggggaugggcgugaccuaccucgcucugaucgcaaccuuuaaaauacaacccuuccuggcgcucggauucuuccuucgcaagcugacuagccgggagaaccuccugcuuggcgugggacuagccauggccacgacucugcagcuacccgaggacauagagcagauggccaaugggaucgcucucgggcugauggcucugaagcucaucacgcaguucgagaccuaccagcuguggacggcccugauuagucugacaugcucgaauaccaucuucacccugacuguagccuggcgcaccgccacacugauucucgcaggggugagccugcugccggucugccaguccagcuccaugcgcaaaaccgauuggcuccccaugacgguggcagccaugggggucccgccgcuaccgcuuuuuaucuuuacccugaaggacacucuuaaaagacgcagcuggccccugaacgaaggggucauggcagugggccucgucuccauauuagccagcucccuacugcggaacgacgucccaauggcgggcccucuuguugccgggggccugcucaucgcaugcuacgugauaaccggcaccucagccgaccugacgguggagaaggcagcggacguuaccugggaagaggaggccgagcaaacaggcguaucacauaaccugaugaucacugucgacgacgacgggacgaugcggauuaaggacgacgagaccgaaaacauccucaccgugcugcugaagaccgcccucuuaauugugucuggcaucuuccccuacuccauccccgccacguugcucguguggcauaccuggcagaaacaaacccagcggagcggagugcugugggacgugcccagcccgcccgaaacccaaaaagccgagcuggaggagggggucuaucgcaucaagcagcaaggcauuuucgggaagacgcaggugggcguggggguccagaaggaaggcguguuccacaccauguggcacgugacacggggagcgguccucacccacaacgggaagcgacuggagcccaacugggcauccguuaagaaagaccugaucuccuacggcgggggcuggcggcucagcgcccaguggcagaagggggaggaagugcaggucaucgccguggagcccggcaagaaccccaagaacuuccagacgaugccaggcacguuucagacaacuacgggggagaucggcgcgauugcccucgacuucaagcccggaaccagcggaagccccaucaucaaccgcgagggcaaaguggucggccuguacggcaacggggugguuaccaagaacggcggauacgucagcggcaucgcccagaccaacgccgagccggacggccccaccccggagcuagaggaggagauguucaaaaaacggaaucucaccaucauggacuuacaccccggguccggcaagacccgcaaguaucugccggccaucgugcgugaagcgaucaagcgcaggcuccgcacucugauccuggcgcccacgcggguggucgcugccgagauggaggaggcucucaagggcuuacccauccgguaccagaccacugcgacaaagucggagcauacgggccgggagauuguggaccugaugugccacgcgaccuucacuaugcgccuccugucccccgugcgggucccgaacuacaaccugauuaucauggacgaagcccacuucaccgaucccgccagcaucgccgcgcgcggcuacaucuccacacggguuggcaugggcgaggccgcugcuauauuuaugaccgcgaccccacccgggacugccgaugccuucccucagucgaacgcacccauccaagaugaggagcgagacauccccgagcgcucguggaacagcggcaaugaguggauaaccgacuucgccgggaagaccguuugguucgucccuuccaucaaggcuggcaacgauaucgcaaacugccucaggaaaaacgggaagaaggugauccaguugagccgcaagacuuucgacaccgaauaccaaaagacuaagcuuaacgacugggacuucguggucaccacggacaucuccgagaugggcgccaacuucaaggcggacagagucaucgauccgcgccgcugucucaaaccugugauccugaccgacggccccgagcgcgucauuuuggccgggcccaugccggugacagcugccucggccgcccagcggcgcggccggguggggcgcaauccccaaaaagagaacgaccaguauaucuuuacgggccagccccucaacaacgacgaagaccacgcccauuggaccgaagcgaagaugcugcuagauaacaucaacacccccgaaggaaucaucccggcccuuuucgaacccgagcgggagaaguccgcggcaaucgacggcgaguaccgccugaagggcgaaagccggaagaccuucgucgaguuaaugcgccgcggggaccuccccgucuggcuggcgcacaaggucgccuccgagggcauuaaguacacggaccguaaguggugcuucgacgggcaacggaauaaccagauccuggaggagaacauggacguggaaaucuggaccaaggagggugagaagaagaaacugcgcccccgcuggcuggacgcccguaccuacucagacccguuagcccucaaggaguucaaagacuucgcugcgggccgcaaguccaucgcccuggaccuggugaccgagaucgggcgcgucccuacgcaccuagcccaccgcacccggaacgcccuggacaaucuggugaugcuccacaccagcgaacacggcgggaaggccuaccgccaugcgguggaggagcuacccgagaccauggagacgcuacuccugcugggccucaugauccugcucaccggcggcgccaugcucuucuuaaucuccgggaaggggaucggcaaaaccagcaucgggcucaucugcgucaucgccucuuccggcauguuauggauggccgagaucccucugcaauggaucgccagcgcgaucgugcuagaguucuucaugaugguucuccucaucccagaacccgagaaacagcgaacgccccaagauaaccagcuggccuacguggugaucgggaucuuaacgcuggcagccaucaucgccgcgaacgagaugggacuacucgagacgaccaagagagaucugggcauguccaaggagccggggguggucagccccaccuccuaucuggauguggaccuacaccccgccagcgccuggacguuguacgccguggcgaccaccgucauuacccccaugcugcgucacacgauagaaaacagcaccgccaaugucagccucgcggccaucgccaaccaggcgguugucuuaaugggcuuagacaagggguggccuaucuccaagauggaccucggaguuccccuguuagcccuagggugcuacagccaagugaauccccugacccuaacggcggccguccuccugcugauuacgcauuacgcuaucaucgguccaggcuugcaggcgaaggccacacgcgaggcgcagaagcggaccgccgccggaauuaugaagaacccgaccguggacggcaucaugacgaucgaccuggaucccgugaucuacgacuccaaguucgagaagcagcuggggcaggucaugcuccucgugcugugcgcgguacagcucuuauugaugagaaccucuugggcgcuaugcgaggcccugacccuggccacugguccgaucacgacccucugggagggcucccccggaaaauuuuggaacaccaccauagcggugagcauggcaaacauuuuuagaggcucuuaccucgcuggggccggccuggccuucaguauuaugaaauccguggggaccgggaagagagggacggggagccagggugaaacccucggggagaaguggaagaagaaacugaaccagcugucccggaaggaguuugaccucuacaagaaaucagguaucaccgaaguggacagaaccgaggcgaaagaggggcugaagcgaggcgagauuacgcaccacgccgucagccgcggcucagcgaaguugcagugguucguggagcgaaacaugguaauuccggaggggcgagucaucgaccucggcugcggucggggcggauggagcuacuacugcgccggccuuaagaaaguuaccgaggugcgcggcuacaccaagggagggcccggucacgaggagcccgucccaauguccaccuacggcuggaacaucgugaaguugaugagcgggaaagacguguucuaccucccgcccgagaagugcgacacucugcugugcgacaucggcgaguccucacccucccccacugucgaggagagccggacgauccgcgugcugaagaugguggagccguggcucaagaacaaccaguucugcaucaaagucuuaaaccccuacaugcccaccgugaucgagcaccucgagcgccuucaacggaagcauggcggaaugcuggugcgcaacccgcucucccgcaauagcacucacgagauguacuggaucagcaacggcaccgggaacaucgucgcuagcgugaacauggugucacgauuacugcuuaaccgguucaccaugacccaccgccgcccgacgaucgagaaggacguagaccucggcgcagguacccgccacgugaacgccgagcccgagacccccaacauggacgugaucggggagcggauuaagcgcaucaaagaggaacacaacagcaccuggcauuacgacgacgagaauccguaccgcacgugggccuaucacggcaguuacgaggucaaagcuaccgguucggccuccagcaugaucaacggcguggucaagcugcuuaccaagcccugggacgugguucccauggugacccaaauggcgaugaccgacaccacccccuuugggcaacagcgcguguucaaggagaagguggacacucggacgccgcgcuccaugccagguacccggagagucaugggaauuacugccgaguggcucuggcguacccuggggcggaacaagaaaccccgacugugcacacgcgaagaguucaccaagaaggugcgcaccaacgcugcaaugggugcgguguuuaccgaggagaaucagugggacagcgcgaaggcggccgucgaggacgaggacuuuuggaagcucguggaccgggagcgggaguugcacaagcuggguaagugcggcucaugcguguacaacaugauggggaagcgggagaagaagcucggcgaguuugguaaggccaagggcucccgcgcgaucugguacauguggcugggcgcccgguaccuggaguuugaggcgcuuggguuccugaacgaagaccacugguucagccgcgaaaacucauacucgggcgucgagggugagggccugcacaagcugggauacauccuccgggauaucuccaagauccccgggggagccauguaugccgacgacacggcggggugggacacccgcaucaccgaggacgaccugcauaacgaggagaagaucacgcagcaaauggacccggaacaccgacagcuagccaacgccauuuucaagcuuaccuaucagaauaaggugguuaagguccagcgccccacgcccaccggcaccguuauggauauuauaagccggaaggaccaacgcggcuccggccaggugggcacguacgggcugaauacguucaccaacauggaggcccagcugauccggcagauggagggcgaagggguucuuagcaaggcagaucuggaaaacccccaccucccggagaagaagaucacccaauggcuggagaccaagggaguagagagacugaagcggauggcgaucucuggcgacgacugcguggucaagccgaucgacgaccgcuucgccaacgcccuucuggcccugaacgacauggggaaggugcguaaggacaucccacaguggcagcccagcaagggcuggcacgacuggcagcaggucccguucugcucccaccauuuccacgaguuaauaaugaaggacggccgcaagcugguggugcccugccggccucaggaugaacuuauaggccgcgcacggaucagccaaggagcaggcuggucccucagggaaacggccugcuuaggcaaggccuacgcccagauguggagccugauguacuuucacagacgggauuuacgccuggcaucaaacgccaucugcucugccgugcccguucacuggguuccgaccucccggacaaccuggagcauccacgcccaccaccaguggaugacgacagaggacaugcugaccguguggaacagaguuuggauagaggauaaccccuggauggaggacaagaccccugugaccacuugggagaacgugcccuaccuugggaagagagaggaccaguggugcggcucccugaucggucugaccucacgcgcaaccugggcccagaacaucccuaccgccauccagcaaguccggagccucaucggcaacgaggaguuccuggacuacaugccguccaugaaacgcuuccggaaggaagaggagagcgagggagccaucugguga

SEQ ID NO: 26097 - RNA, 9873 nt, Artificial Sequence
  derived and/or modified CDS sequence (opt11) from DENV-3__EU482452__SS-prME
acuagcuuauguuuaaugaugaugcugcccgccacccuggcuuuucaccucaccucucgggacggcgaaccccggaugaucguggggaagaaugagcgcggcaagagucugcuauucaagaccgcguccgggaucaacaugugcacccucaucgccauggaccucggcgagaugugugacgauaccgugaccuacaagugcccccugauugccgaaguggagccugaggacaucgacugcugguguaaccugaccagcacaugggugacuuacgggacgugcaaccaggcgggcgaacaccggcgcgauaaacgcuccguggcccuggcgccccacgugggcauggggcuggacacacgcacccagaccuggaugagcgcagagggcgccuggcggcaggucgagaagguggagacgugggcgcuccggcaucccggcuucaccauacuagcacucuuucucgcucacuacaucggcacauccuugacccaaaaggugguaauauucauacugcucaugcuggugacgccuagcaugaccaugaggugcgugggugugggcaaccgcgacuuuguggagggccugucgggggccaccuggguggacguuguucucgagcauggcggcugugugacgacuauggcuaagaacaagccaacauuagacaucgagcugcagaaaaccgaggcgacccaacucgcuacgcuccggaagcucugcauugagggcaagaucacgaacauaacgacggauagcagaugucccacgcagggcgaggcgauucucccugaggaacaggaccagaauuacguaugcaagcacacguauguagaccggggguggggcaaugggugcggucuauucgguaaggguucccuggugacgugugccaaguuucaaugccucgagcccaucgaagguaaagugguucaguaugaaaaccugaaauacaccgugauaaucacgguccacaccggggaccagcaccaggucggcaacgacacccaaggggugacaguggagaucacgccccaggccaguacuguggaggcuguauuacccgaguacggcacccucggguuagagugcuccccgcgcacuggccucgacuucaaugagaugauccucuugacgaugaagaacaaggcguggaugguccaccgucaaugguucuucgaccugccgcuaccauggaccucuggugccacgaccgagaccccaacuuggaacaggaaggagcugcuggucaccuucaaaaacgcccacgccaaaaaacaggagguggucgugcucgggucccaggagggugccaugcacacagcgcugaccggggccacggagauccagaauucgggcggcacuucuaucuuugcuggacaccugaagugccggcuaaagauggacaaacuggaauugaaggggaugucuuacgccaugugcuuagacaccuucguucugaagaaggaggucagcgagacccagcacgggacgauccugaucaaaguggaauacaagggcgaggaugcgccgugcaagauccccuucagcaccgaggacgggcagggcaaggcgcacaacggacgccugauuacagccaaccccgugguaaccaagaaggaggagcccgucaacaucgaggccgagccgcccuucggggagucgaauaucgucaucgggaucggggacaaggcccucaaaaucaauugguacaagaaaggcuccucaaucggaaaaauguucgaagcaacggcgaggggcgcccggagaauggccaucuugggcgacaccgccugggauuuuggaucagucggcggggugcugaacucacucggcaaaaugguucaucagauauucgggucagcguacacggcccuguucagcggcgucuccuggaucaugaaaaucggcaucggggugcugcucaccuggaucggcuuaaacagcaagaacacauccaugucuuucucuugcaucgugaucgggaucaucacacuguaucucggcgccguagugcaggccgacauggggugcgucaucaacuggaagggcaaggagcugaagugcgguagcgggauauucgucacgaacgagguccacaccuggacggagcaguacaaguuccaggccgacucucccaagagacuggcaaccgcaaucgccggcgccugggaaaacggggugugcggcauccgcagcaccacgcggauggagaaucucuuauggaagcagaucgccaaugaauuaaacuacauccucugggaaaauaacaucaagcugacagucgugguaggggacgucauaggcguacuggagcaaggcaagcguacgcucacaccccaaccgauggagcuuaaauacuccuggaagacaugggggaaggcgaagaucgucacagccgagacccagaauucuagcuuuaucauugauggccugaacacccccgaaugccccagcgccucccgggccuggaacguaugggaaguggaggacuacggguuuggcguuuucacaacaaacaucuggcucaagcuacgcgaggucuacacccagagcugcgaccaccggcugaugagcgcggcaaucaaggacgaacgcgcagugcaugccgacaugggcuacuggaucgaaucccagaagaacgggagcuggaagcuagagaaggccucguucauugagguaaagaccugcaccuggcccaagagccacacauuauggaguaacggcgugcuggagagugacaugauuaucccaaagagccucgcggggcccaucagucagcacaaccaccggcccgguuaccacacgcagaccgcggggccauggcaucuggguaaacuggagcucgacuuuaauuacugcgaggguaccacaguagugaucacggagaacugcgguacccgcgggcccucccugcggacaacaacagucucagggaagcugauccacgaguggugcugccgcuccugcaccuugccgccccucagguacaugggagaggacggguguugguacggcauggagauccggccaaucaacgagaaggaagagaacauggucaagagcuugguuuccgccggcucagggaaggucgacaauuucaccaugggaguccuaugccuggcuaucuuauucgaggaggugaugcgugguaaguucggcaaaaagcacaugaucgccggggucuuauucaccuucguccugcuucucucgggucagaucacauggcgcgacauggcgcauacccugaucaugaucgguagcaaugccagugacagaauggggaugggcguuaccuauuuagcccucauugccaccuucaagauccagcccuuucuggcauugggauuuuuccuccgcaagcuaacgagccgggagaaccugcuucugggagucggccuggcgauggcgaccacucuccaacugccggaggauaucgagcagauggccaacgggaucgcucugggccucaugaccuugaagcugauuacucaauucgaaacuuaucaacucuggaccgcguuaguguccuugaccugcucuaauacgauauucacccucacaguagccuggcgcaccgccacgcuuaucuuggcgggggugagccuccugccacuuugccaaucuagcuccaugcggaaaaccgauuggcucccgaugaccguggccgcgaugggagucagccccuugccccuguucaucuucucccucaaagacaccccgaagcgcaggagcuggccgcucaacgagggugugauggcggucggucugguaagcauucuagccagcucccuccugcgcaacgacguaccaauggccggucccuuagucgccggcggccugcugaucgcgugcuacgucaucacggggaccucagccgaucucacgguggagaaagccgccgacguaaccugggaggaggaagcagagcagacgggggucucccacaaccuuaugaucacuguggacgacgauggcacaaugcgcauuaaggaugaugaaacagagaacauauuaaccgugcuccugaagacggcucugcucaucgugagcggcauuuucccauacuccaucccggccacccugcuaguguggcacacguggcagaagcagacgcagcgaagcggcgugcucugggauguucccaguccgcccgaaacgcagaaggccgaacuggaggaaggaguuuaucguauuaagcagcagggcauuuucgggaagacccaggugggcgucggcgugcagaaagaagguguauuccauaccauguggcauguuacccggggugcaguucugacgcacaacgggaagcgccucgagccgaacugggccucagucaagaaggacuuaaucuccuacggagguggauggcggcucagcgcccaguggcagaagggugaagaagugcaagugaucgccguagagcccggcaaaaaccccaagaauuuccaaaccaugcccgguaucuuccaaaccaccacgggggagaucggugccauugccuuggacuuuaagccggguaccucaggcaguccuauuaucaaccgcgaggguaaagucguagggcucuacggcaacggugugguuacgaagaacggcggcuacguguccggcaucgcgcagaccaacgcggaacccgacggacccacacccgaguuagaggaggaaauguucaagaaacggaaucugacaaucauggaccuccaccccggguccgggaagacacgcaaguaccuccccgccaucgugcgggaggccaucaagcgccgucuuagaacgcuaaucuuggccccgacgcgggucgucgcggcggagauggaggaagcccugaagggacuacccauucgcuaccagaccacggcgacgaaaagcgaacauacaggccgggagaucguugaccugaugugucacgccaccuucaccaugcgauugcucaguccuguccgggugcccaacuacaaucugaucauuauggaugaggcgcacuucacugacccggcaagcaucgccgcgcgcggguacauauccacucgugugggcaugggcgaagcugcagcaaucuucaugacagccacgccgcccggaacggccgaggcguuuccacagucgaacgcaccgauccaggacgaggaacgcgacauccccgaacgauccuggaacagcggcaaugaguggauaacagacuucgucgggaagaccgugugguucgugccguccauuaaggcugggaaugacaucgccaauugccugcggaagaaugggaaaaagguuauccagcucagccgcaaaaccuuugauaccgaguaccagaagacgcggcugaacgacugggacuuuguaguuaccaccgacaucuccgagaugggcgcaaacuucaaggcggaccgcgucaucgauccccgacggugccugaagccggugauccucacagacggacccgaacgggugauccuggccgggccgaugcccgucaccgcggcgucggccgcgcagcgccguggccgagugggacguaacccacaaaaggagaacgaccaguacaucuucaccggccaaccucugaauaacgacgaggaccacgcccacuggaccgaggccaagaugcuccuggacaacaucaauacccccgaggguaucauccccgcccuguucgagccggaacgggagaagucugcggcgaucgacggcgaguaccggcuaaagggggagagccgcaagacguucgucgaguuaaugagacgcggcgaccugcccguguggcucgcccacaagguggcuuccgagggaaucaaguacacggaccggaagugguguuucgacggggagcgcaauaaccagauccuagaggaaaacauggacgucgagauauggacgaaggagggugaacggaagaaauuaagaccccgcuggcuugacgcgcggaccuacagcgacccccuagcgcugaaagaguuuaaagacuucgcugcuggccgcaaguccauagcccucgaucugguaaccgagaucggccggguaccgagccaccuggccuaccgcacucggaacgcgcucgacaaccuggucaugcugcacaccagcgaacacgggggucgcgccuacaggcacgcaguggaggaacuuccagagaccauggaaacccuccugcuccugggguuaaugaucuuacucacgggcggggccaugcuguuccucauaucagggaaggggaucggcaaaaccucuauagggcugaucugcguaaucguuuccagcggcaugcuguggauggccgauaucccccuccaguggauagcguccgcgaucguacuggaauucuucaugauggucuuauugaucccggaacccgagaagcaacgcacuccccaggauaaccagcuggccuacguuguuaucgguaucuuaacucucgcagccaucguggcagccaacgagaugggccugcucgagacaaccaagcgggaucucggaaugucgaaggagccaggggucguauccccgacgagcuaucuggacguggaccugcaccccgccuccgcuuggacccucuacgccgucgccacaaccgugaucacccccaugcugcgacacacaauagaaaacagcacggccaacgugucccuggccgcgaucgcgaaucaagcgguagugcucaugggcuuagacaagggguggcccauuagcaaaauggaccugggaguaccgcucuuagcccugggaugcuacucccaggucaacccacucacauuaacugccgccgugcuccugcuggugacucacuaugcaaucaucggccccggcuugcaagcgaaagccacgcgggaggcccagaaacgcaccgcugcggggauuaugaagaacccaacagucgauggcaucaugacaaucgaccucgacccggugaucuacgacucgaaauucgagaagcagcugggccaggugaugcugcucguucugugugcggugcagcuacucuuaaugcggacguccugggcccuuugcgaagcccuuaccuuggccaccggccccaucaccacgcucugggagggcagccccgggaaguucuggaauacgaccaucgcgguguccauggccaauaucuuccgcggcagcuaccucgccggugccggccuggcauucuccaucaugaagagcguggggacaggccggcgcggaacggggagccagggcgagacgcugggugagaaguggaagaagaagcucaaucagcugucccggaaggaguucgauuuguacaaaaaguccggaaucaccgagguagaccgcacagaggcgaaggaggggcucaaacggggcgagacuacgcaccacgcuguaagucgcggcagcgccaaacuccagugguucguggagagaaacauggugaucccggagggucgcgugaucgaucugggcugcggucgcggcgggugguccuacuacugcgcaggccucaagaaaguaacggagguucggggcuacaccaagggcgggccagggcacgaggagcccgugccgaugagcaccuacggcuggaauaucgucaagcugauguccgguaaggacguuuuuuaccugccuccggagaagugcgacacgcugcucugcgauauaggagaaagcucccccucuccaacagucgaagagucccgcacaauccgcguccugaagaugguagaacccuggcugaagaacaaccaguucugcaucaaagugcucaacccguauaugccgaccgucaucgaacacuuggagcgccugcaacggaaguaugguggcaugcucgugcgcaacccccuaagccggaauaguacacacgagauguacuggaucagcaacggcacggggaacaucgucuccagcgucaacaugguuucccgccugcuccugaaucgguucaccaugacccaccgccggcccacgauagaaaaggaugucgaccugggcgccgggacgcgccacguaaaugcugaaccggagacccccaacauggaugugaucggagagcggaucaagcgcauaaaggaggagcacucuaguaccuggcauuacgacgacgagaauccuuacaagacgugggccuaucacggcagcuacgagguaaaagccacugggucggcgucgagcaugaucaacggagugguaaagcuacucacgaagccgugggacgucgugccaauggugacucagauggcgaugacggacaccacccccuuuggucagcagcggguauucaaggaaaagguugauacccgcacgccccggccgaugccgggcacacgcaagguuauggagauuaccgcugagugguuguggcgaacccucggucgcaacaagaagccccggcugugcacgcgggaggaguucaccaagaagguccgaaccaacgccgccaugggugcuguguucaccgaggagaaccagugggacuccgcgcgugcggccguggaggaugaggaguucuggaagcuggucgacagggagcgcgagcuccacaaacugggcaagugcgggucgugcgucuauaacaugauggguaagcgcgagaagaaauugggggaguucggcaaggccaaggggucccgggcgaucugguacaugugguugggcgcgcgguaccuggaguuugaagccuuaggguuccucaacgaggaccacugguucucucgggagaacuccuacagcgggguggagggcgagggucugcacaaguugggcuauauccuacgcgauaucucaaagauccccggcggggccauguacgccgaugacacagcgggcugggacacccggauuaccgaggaugaccuccacaacgaggagaagauuacccagcagauggaucccgagcaucgccagcucgccaacgccauuuucaagcucacguaccagaauaaggucgugaagguccagcggccgacccccaaagggacagucauggauaucauaagucgcaaggaccagcggggcucaggucagguaggaaccuacggccugaacaccuucacuaacauggaagcccaguuagugcgccaaauggagggggaggggguccucagcaaagccgaucuggaaaacccccaucuccuugagaaaaagaucacucaguggcuggagaccaagggaguggagcggcuuaagcgaauggcgaucucuggcgacgacuguguggucaagccgaucgacgaccgguuugccaaugcauuacuggcacugaacgacauggggaaggugaggaaggauaucccccaauggcagcccagcaagggauggcacgacuggcagcaagugcccuucugcucgcaccacuuccacgagcucaucaugaaggacggucggaagcuggucguuccaugccgcccgcaggacgagcugauugggcgggcccggaucucucagggcgcgggguggucccuuaaagagaccgccugccugggcaaagccuacgcacagauguggagcuugauguauuuccaucggagggaccuccgccuggccuccaacgcgaucugcagcgccgugccuguccacuggauucccacgagcagaaccaccugguccauccacgcccaccaccaguggaugaccacggaggauaugcugaccguguggaacaggguguggauugaggacaacccauggauggaggacaagacccccgucaccacgugggaggacguuccguaucucggcaagcgcgaggaucaguggugcgggagccugaucggccuuaccagccgcgcgaccugggcgcagaacauccucaccgccauacagcagguacggucgcugaucggagacgaagaguuccuggacuacaugcccuccaugaagcgcuuccggaaggaggaggagagcgagggcgccaucugguaa

SEQ ID NO: 26098 - RNA, 9873 nt, Artificial Sequence
  derived and/or modified CDS sequence (opt11) from DENV-3__EU482453__SS-prME
acgagccugugccucauaaugaugcuacccgcgacgcuggccuuccacuuaaccagccgcgauggcgagccgagaaugaucgucgggaagaacgaacgggguaagagccugcuguucaagaccgcgucggggaucaauauguguacccuaaucgccauggaccuaggugagaugugcgacgauaccgugacuuacaagugccccuuaaucgcagaaguggagcccgaggacaucgacugcuggugcaaucuaaccagcaccuggguaacguacggcacgugcaaccaggccggggaacaccggcgcgacaagcgcuccgucgcgcuggcgccccauguggguauggggcuggacacucguacgcagacguggaugucugccgagggcgccuggcggcagguggaaaaggucgagacgugggccuuacgccacccgggcuucacgaucuuagcccuguuucucgcccacuacaucggcaccagccugacccagaagguagugaucuucauccuucuuaugcuugucacgcccucgaugaccaugcgcugcguggggguaggcaaccgcgacuucgucgagggccucuccggagccacguggguugacgucguccucgagcacggggggugcguaacuacgauggccaagaacaagcccaccuuggacauugagcuccaaaagacagaggccacccaguuggcuacgcugcggaaguuaugcaucgaaggcaagauaacuaauaucaccaccgauagccggugccccacgcagggcgaggcgauccugccggaagagcaagaccagaacuaugugugcaaacauaccuacguugaccggggauggggcaacggcugcggacuguucggaaaggguucucuggugaccugcgccaaauuccagugccucgagcccaucgagggcaaagugguacaguacgaaaaccuuaaguacaccgugaucaucacggugcacacgggugaccaacaccagguggguaaugacacccagggggugaccgucgagauuacaccucaggcuagcacuguggaagccguccugccugaguacggcacccuugggcuggaaugcucgccacgcaccggccuggacuucaacgagaugauacuccugaccaugaagaacaaagcuuggaugguccacagacagugguuuuucgaucugcccuuacccuggacuagcggcgccaccacagagaccccuacguggaaccguaaggagcugcuagucaccuuuaagaacgcccacgccaagaaacaggaaguggucgugcuuggcucccaagagggcgccaugcacaccgcgcugacaggggccacggagauacagaacagcggugggaccuccauauuugcaggccaccugaagugcaggcuaaagauggacaagcuggagcucaaaggcaugagcuacgccaugugccucaauaccuucguucugaaaaaggaagugagcgagacgcagcacgguacuauccuaaucaagguggaguacaagggcgaagacgccccguguaagauccccuucucaacggaggacgggcagggcaaggcgcacaacgggcgcuuaaucaccgccaaccccguggugacuaagaaagaggagcccgugaacauagaggcagagccgcccuucggcgaaagcaacaucgugauaggcaucggggauaaggcccucaagauuaauugguacaagaaagggucaagcaucggcaagauguuugaggcuacggcccguggcgcccgccgcauggcgauucugggcgauaccgccugggacuuuggcagcguagguggugugcugaacucucucggaaagauggugcaccagauauucggguccgcauacaccgcccucuucucuggcgucucguggaucaugaagaucggcaucggggugcugcucacguggauuggucuaaauagcaagaacacgucaaugagcuucuccugcaucgcgaucggcauuaucacucuguaccucggggcgguaguccaggccgauauggguugugcgauaaauuggaagggcaaggagcugaaguguggaagcgggaucuucgucaccaacgaaguucacacauggacugaacaauacaaauuccaggccgacagcccuaaacgccuggcgaccgcuaucgccggcgcuugggagaacggggucugcggcauccgaucuaccacccgcauggagaaccuccuuuggaagcagaucgccaacgagcugaacuacauucucugggagaauaacauaaaacucacggugguggucggugacauaaucggcgugcuugagcaggggaagagaacccucaccccccagccgauggagcucaaguauucauggaagacaugggggaaggccaaaaucgugacggcggagacccagaauagcucauucauaaucgacggcccuaacaccccugagugcccaagcgcuucucgggccuggaacgucugggagguggaggacuacggguucgguguguucacuacuaacaucugguuaaagcugcgcgaggucuauacgcaauccugcgaccaccgucugaugagcgcggccaucaaggaugagcgcgccgugcaugcagacaugggcuauuggaucgagucccagaagaauggcucauggaagcuggagaaggccagcuucaucgaggugaagacguguacauggcccaagucucacacccucuggucaaaugguguucuggaguccgacaugauaauucccaagucccuggccggucccaucagccagcauaaucaccggccgggcuaccacacgcagaccgccgggcccuggcaccucgguaaguuggagcuggauuucaacuacugcgagggcacgaccguggugauaacggagaacugcgggacacggggcccuucccuccggaccaccacggucucagggaagcucauccacgaaugguguugccgauccugcacccugccgccuuuaagguacaugggagaagacgggugcugguacgguauggaaauccgcccuacuaaugagaaggaggagaacauggucaagagccuggucuccgcaggcagcgggaagguggauaauuuuaccaugggggugcugugccucgcaauccuguucgaggaggucaugcgggggaaguucggcaagaagcauaugaucgcugggguccuuuucacguucgugcuucugcuuuccggacagaucaccuggcgugacauggcccacacccucauuaugaucggcagcaaugccuccgaccggauggggaugggcgugaccuaccuggcccugaucgcgacauucaagauccagccuuuucuagcccugggguucuuccugcggaagcuaaccagucgggagaacuuacugcucggcgugggacuagccauggccaccaccuuacaguuacccgaggauauagaacagauggcgaacggcauagcccugggccugaugacguugaagcuuaucacucaguuugagaccuaucagcuauggaccgcccucgugucccugacgugcuccaacacgauuuucacccugaccguggccuggcgcacggcuacguugauccuugcgggcgucagccugcucccuuugugccagucaagcuccaugcgcaagaccgacugguugcccaugaccguggcagcuaugggcguaccgccccugccacuguucaucuucucgcuaaaggacacgcccaagagacgcucauggccccucaacgagggggugauggcagugggccuggucucgauccuagcuuccucuuugcuucgaaaugacgugccaauggcgggcccgcugguggccggcggccuccugauugcguguuacgucaucacagggaccucugcugaccugaccguggagaaagccgcggacguuaccugggaggaggaggcagagcaaaccggcgugagccacaauuugaugaucacgguggacgacgacggaaccaugcguauaaaagaugacgagaccgaaaauauccuaacaguucuccucaagacagcucuacugaucguuuccggcauuuuccccuacucuauccccgcuacccuccugguuuggcacacauggcagaaacaaacgcagcgguccggggugcugugggauguacccuccccgccggagacucagaaggccgaacuagaggaggggguuuaucgcauaaagcagcagggcaucuuugggaagacccaggugggcgugggagugcagaaggagggaguauuccauaccauguggcacgugacgcggggggcggugcugacacacaacgggaagcgccuggagcccaacugggcuagugugaagaaggaucucaucagcuacggcgggggguggcgacuguccgcccaguggcaaaagggggaggagguucaagugaucgccguugagccgggaaagaacccgaaaaacuuccagaccaugccaggaauuuuccagacgacgaccggggagauaggugcgaucgcccuggauuucaagcccgggaccagcggcagccccaucaucaaucgcgaaggcaagguuguggggcuguacggaaacgguguggugacuaagaacgggggguauguaucgggaauagcacaaacgaacgccgagcccgacggccccacccccgagcucgaagaggagauguucaaaaagcgcaaccugacuaucauggauuuacaccccgggagcggcaaaacucgcaaguacuuacccgcaaucgugagagaagcgauaaagaggagguugcgcacucugauccucgccccgacccgggugguggccgcggagauggaggaggcccugaaaggcuuacccauacgcuaucaaaccaccgcgacuaaauccgagcacaccggccgggagaucguggaccugaugugucacgccaccuucaccaugcgcuuacugagcccgguucgcgugccgaacuauaaccuaaucaucauggacgaggcccacuuuacggaucccgccuccaucgcugcgagaggauacauuucgacacgggugggaaugggugaggcagcugcaaucuucaugacagcaacuccacccgggacugcugaagccuucccccaguccaacgcgccaauacaagacgaggagcgggacaucccagagcgcagcuggaacuccggcaacgaguggaucaccgauuucguggggaaaaccgugugguucgugcccagcaucaaggccgguaacgacauagcaaauugccugcggaaaaacggaaagaaggucauacagcuuucccgcaaaaccuucgauacggaguaucaaaagacccggcucaacgacugggacuucguugucaccaccgacaucagcgagaugggcgccaacuucaaggccgaccgcgucaucgauccgcggagaugccugaagcccgugauccuaacggacggccccgagcgggugauccucgcagggcccaugcccgucacugccgcgagugccgcccagcgccgggggcgcgucggacgcaacccucaaaaggagaacgaucaguauaucuucacagggcagccccugaacaacgaugaggaccacgcucauuggacugaggccaagaugcuucucgauaauaucaacaccccggaggggauaaucccugcgcuguucgagcccgaacgggagaagagugcagccauagacggcgaauacaggcugaaaggcgagucccgcaaaacguucguugagcuuaugcggagaggggacuugccggucuggcuggcgcacaaagucgcuagcgagggcaucaaauacaccgaccggaagugguguuucgacggggagcgcaacaaccagauucucgaggagaacauggacguagagaucuggaccaaagagggugaacggaaaaagcugcgcccacgcuggcuggaugccagaaccuacagcgaucccuuggcccugaaggaauucaaggacuucgcugccggccguaaaagcaucgcucuggaccucguaacggagaucgggcggguuccgucccaucuggccuaccgcacccggaacgcccuggacaaccuagucaugcugcauacaucagagcacgguggacgcgccuaccggcacgccguggaagagcugccggagaccauggaaacguugcugcuccuggguuuaaugauucuguuaaccggcggcgcgaugcuauucuuaaucagcggcaaagggaucggcaagaccagcaucgggcucauuugcgugaucgucagcuccggcaugcuguggauggccgacgugccccugcaguggauagccucugcgaucgugcucgaauucuucaugaugguauugcucaucccggagccugaaaagcagcgcaccccgcaggacaaucagcucgccuacguugugauugggaucuuaacccuagcggccaucguggcagccaacgaaaugggccuccucgagaccacgaagcgggaucugggcauguccaaggagccggggguggugagcccaaccuccuaucuagacgucgacuugcaucccgccucugcguggacgcuguaugccguggccacgaccguaaucaccccgaugcuccggcacacgaucgagaacucgacggcaaacgucagcuuagccgcaaucgccaaccaagccguaguccucaugggccuagauaagggguggccaauuuccaagauggaucuggguguccccuuacuugcucuggggugcuacagccaggugaacccccuuacgcucaccgcggcagugcugcuguuggugacgcacuacgcuaucaucggaccgggcuuacaagccaaggccacccgagaagcacaaaagcguaccgccgcggggaucaugaagaacccuaccguagacggcaucaugaccauagacuuggaccccgucaucuacgacuccaaguucgagaagcagcucgggcagguaaugcuauugguguugugcgcgguacagcuucugcugaugcggaccagcugggcccugugcgaagcacuuacucuggccaccggcccuauuacaacccugugggaaggcuccccagggaaguucuggaauaccaccaucgcggugagcauggcaaauaucuuccgcgguuccuaucuggccggcgccggccuggcauucagcaucaugaaguccguggguacgggccgccguggcaccggaagccagggcgaaacccugggugagaaguggaaaaagaaacugaaccaguuaagccggaaagaguucgaccuguacaagaaauccggcaucacagagguggaccggacugaggcuaaggaggggcugaaacggggggagaccacccaccacgccgucagccguggguccgcgaaacuccaaugguuuguggagcggaauauggugauccccgaggggaggguuauagacuugggaugcggucgcggcggguggagcuacuacugugccggcuuaaagaaagucaccgagguuaggggcuacaccaagggcgggcccgggcacgaggagccaguccccauguccacauacggcuggaacaucgugaaguugaugucaggcaaggacguguucuaucugccccccgagaagugcgacacucugcuuugcgacaucggggagucuagccccucgccuacggucgaggagagcagaaccaucagagugcucaagauggucgagcccuggcuuaagaacaaccaguucugcaucaagguccugaaccccuacaugcccacugugaucgaacaccucgaacgccugcaacggaaguacggggggaugcuggugcggaauccgcuaucgcggaacagcacacacgagauguacuggaucuccaacgggaccgggaacaucgucucuuccgucaacaugguaagccggcugcugcuaaaccgguucaccaugacccacagacggcccacgaucgagaaagacgucgaucuaggcgccggcacacgccacguuaacgccgagcccgagacccccaacauggacgucaucggggagcguauuaagcgcaucaaagaggagcacucaagcacguggcacuacgacgacgagaauccguacaaaacuugggcuuaucacggcucuuacgaagugaaggcuacugggucagcaaguaguaugaucaacggcguggugaagcugcucaccaagcccugggacgugguucccauggucacucagauggccaugaccgacacaaccccguucgggcagcagagaguuuucaaggagaagguagacacacgcacgcccagaccaaugcccggcacacgcaagguaauggagauaaccgccgaguggcucuggcgaacccugggccgcaacaagaagccgcgccucugcacccgagaggaguucacuaagaagguacgcaccaacgcugcgaugggagccguguucacggaggagaaucaaugggacagcgccagagccgcggucgaggacgaagaguucuggaagcuggucgaccgggagcgggagcugcacaagcucgguaaaugcggguccugcguguacaacaugauggguaaaagggagaagaaacuaggggaauucggcaaggccaagggaucaagagcuauuugguauaugugguuaggggcccgcuauuuagaauucgaagccuuaggauuccugaacgaggaccacugguuuucccgggagaacagcuacuccggggucgagggcgaaggguuacacaaacugggauacauccuccgcgacaucagcaaaaucccgggaggggcgauguacgccgaugacaccgccggcugggacacccggaucaccgaagacgaccuccauaacgaggagaagauaacacagcagauggauccugagcaucgacagcuggcaaaugcuauuuucaaacugaccuaucagaacaagguggugaagguccagcggcccaccccgaagggcacugucauggacauuauuucccgcaaagaccagcggggcucaggucaagugggcaccuauggucucaauacuuucaccaacauggaggcgcagcuaguccggcagauggagggggagggggugcuuuccaaggcagaccucgaaaacccucaccuauuggagaaaaaaaucacccaauggcuggaaaccaaggggguggagcggcuuaagaggauggccaucagcggcgacgauugcgucgugaagccaaucgacgaccgcuucgccaacgcccuacuggcgcuuaacgacauggguaaggugcgcaaggauaucccccaguggcagccgagcaaaggauggcacgacuggcagcagguucccuuuuguagccaccacuuccacgagcugauaaugaaggauggacgcaagcucguagugcccuguaggccccaggaugagcugauaggacgcgcacggauaucccagggcgccggauggucgcugaaggaaacggcuugccucggcaaggccuacgcccagauguggucgcugauguauuuccaccggcgggacuugagacucgccucgaaugcuaucuguuccgccguaccaguucacuggauacccacgagcaggaccacauggagcauccacgcccaccaccaguggaugacgaccgaggacauguuaacaguauggaaucgcguuuggaucgaggauaaucccuggauggaggacaaaacccccguuacgaccugggaagacgugccguacuuaggcaagcgcgaggaccaguggugcgguucacucauaggccugacgagccgcgccaccugggcccagaacauccugacggcuauccaacaggugcguucccucauuggagacgaggaauuccucgacuacaugccuagcaugaagcgguuccggaaggaggaagagcuggagggcgccaucugguga

SEQ ID NO: 26099 - RNA, 9873 nt, Artificial Sequence
  derived and/or modified CDS sequence (opt11) from DENV-3__EU482454__SS-prME
acgagccuaugucucaugaugauguugcccgcaacccucgcuuuccaccugaccucccgggacggagaaccuaggaugauuguagguaaaaaugagcgcgguaaaagccugcuguucaaaaccgcuuccgguaucaauaugugcacccucaucgcaauggaccucggcgaaaugugugacgacacaguaacuuacaaauguccgcuaaucgccgagguggaacccgaagacauagacugcugguguaaccuaacaagcaccuggguuaccuacgggacgugcaaccaagcaggggaacaccggcgcgacaaaagaagcguggcucucgccccacacguagggaugggccuggauacaaggacccaaacuuggaugagcgcugagggggccuggaggcaagucgaaaaaguggaaaccugggcacuaagacacccagguuucacgauacuagcacucuuccucgcgcauuauauaggcacaucccuaacgcaaaagguagugauuuucauacugcucauguuagucacacccuccaugaccaugcgcugugucggagugggcaauagggacuucgucgaagggcuaucaggggcaacaugggucgacguggugcuagaacacggaggcugcgucacaacgauggcgaaaaauaaaccaacucuggacauagaacuccagaaaaccgaggcgacacaacuggcaacacuaagaaaacuguguauagagggcaagauuacuaauauaacaacagacucacgaugccccacgcaaggagaagcuacgcuaccggaagaacaagaucaaaacuauguguguaaacacacguacgucgaccgggguuggggaaacggcuguggcuuauucggcaaggggucccuagucaccugugcaaaguuccaaugccucgagccaauagaaggaaaaguuguccaauacgagaaccugaaguacacagugaucaucacggugcacaccggggaucaacaccaaguaggaaaugauacucaaggugugacagucgagaucacaccccaagcgucgaccguggaagccgugcugccagaguacggaacccucggacuagaaugcagcccacggacgggacucgauuucaaugaaaugauacugcugaccaugaaaaacaaggccuggauggugcacaggcaaugguucuuugaucuaccgcucccauggaccucaggggccacgacagaaacaccgacauggaaccgaaaggaacuccucgugacguuuaaaaacgcgcacgcgaagaaacaagaagucguagugcuggggagccaagaaggggcgaugcauacggccuuaacgggggcaacagagauccagaacucgggugggacuucuaucuucgccggacaccuaaaaugucgacuaaagauggacaagcuggaacuaaaagguaugaguuaugcuaugugccucaacaccuucguacuaaagaaagaaguaagcgagacucagcaugguaccauacuaauaaaagucgaauacaagggugaagacgcaccaugcaaaaucccauucaguaccgaagacggccaaggaaaagcacacaauggcaggcugauaacagcaaacccuguggugaccaagaaagaagaacccgucaauauagaggcagaacccccauuuggcgaauccaacauagucauagguauuggggacaaagcauuaaaaaucaacugguacaagaaagggaguagcauagggaagauguuugaggcuaccgcgaaaggcgcgcgccgcauggcgauauuaggcgauacagcaugggacuucggauccguaggagggguccuuaacagccuggggaaaauggugcaucagauauucgggagcgccuacacagcccucuuuucgggaguaaguuggauaaugaaaauaggaauugggguacuacugaccuggauaggccugaauagcaagaacacaagcaugucauuuagcuguaucguaaucgguauaaucacacuauaccugggggccguaguucaagccgacaugggaugcgucauuaacuggaaggguaaagaacucaagugcggaucugggaucuucguaacaaacgaaguccacaccuggacggaacaauacaaauuccaagccgauucaccuaaaaggcuagcuacggccauagccggagcaugggagaacgggguaugcggcauuaggucuacgacucguauggaaaaccuacucuggaagcaaauagccaacgagcucaacuacauacuaugggaaaauaacauaaagcugacagugguaguuggugacaucaucggcgugcuagaacaggggaaaagaacacucacgccgcagcccauggagcuuaaauacuccuggaaaaccugggguaaggccaagauaguaacagcagaaacucagaacuccagcuucauaaucgacgguccaaacacccccgagugucccagcgcuucccgugcguggaacgucugggaggucgaagacuacggcuucggcguguucacgacgaacauauggcucaagcuccgggagguguauacgcagucuugcgaccaucggcuaaugagugcagcuauaaaggacgaacgcgccguccacgccgacaugggcuacuggauagaaagccagaaaaacggcucauggaaacucgaaaaagcgucauuuauagaaguaaagacaugcacuuggccaaaaucacacacucucuggagcaacgguguacucgaaagcgauaugauaauccccaaaucgcuugcgggacccauuagccaacacaaccacaggccuggguaucacacgcagacugccgggcccuggcaucuaggaaagcuggaguuggacuucaauuacugcgagggcacuaccgucgugaucacggagaacugcggcacucgcgggcccucgcucagaaccaccacugucuccggaaaguugauacacgaauggugcuguagaagcuguacccugccaccccucagauauaugggugaagacggcugcugguacggcauggaaauacgacccauaaacgaaaaagaagagaacaugguaaagucacuuguaagugcaggaagcggaaaaguggacaacuucaccaugggcguauuaugucuugcaaucuuguucgaagaagucaugcgaggaaaguuuggcaagaaacacaugaucgccggaguacuauucacauuuguacuacuacugagcggacaaauuacguggagagacauggcgcacacccucaucaugaucggcagcaacgcuagugaccgaaugggaauggguguaacauaccuggcacucauugcgacauucaaaauucagccauuccucgcgcucggguucuuccucagaaagcuaaccagucgggaaaaccugcuuuuagggguggggcuagcgauggcaacaacauugcagcucccagaagacauagaacaaauggccaacggcaucgcacuugggcuaaugaccuugaaguuaauuacacaguucgagacauaccagcuguggaccgccuuagugagccuuaccugcagcaacacaaucuuuacacucacagucgccuggaggacggccacgcuaauauuggcugggguaucgcuacuaccacuaugccaaucaucaagcaugagaaaaacugacuggcuacccaugacgguggccgccauggguguaccgccccucccucuauucauauucagccucaaagacacacccaaacgccggucauggccccuaaacgagggaguaauggccgucggucugguaucaauacuggcauccagucuacuccgaaacgacgucccaauggcagggccgcuaguagccgggggucuacuaaucgcguguuauguuaucacgggaacaagcgcagaucuaaccguagagaaggcggcagauguaacauggguagaagaagcagagcaaacgggcgugagccacaaccugaugaucacgguggacgaugacggcacgaugcgaaucaaagacgaugagacggaaaacauccuuacgguccuacuuaagacagcacuccuaauaguauccggcaucuucccauacagcauccccgcaacucugcucgucuggcacacauggcaaaaacagacccaacggucaggaguccugugggacguacccaguccacccgagacacagaaggccgaguuagaggagggggucuacagaauuaaacagcagggaauauucggcaaaacacaagugggcguuggaguacaacgagaagguguuuuccacacgauguggcacgucacgaggggcgcaguccuuacacacaauggaaaaagauuagagccaaauugggcuucgguaaagaaggacuugaucaguuacggcggcggcuggagacucagugcccaauggcaaaaaggcgaagagguacaagucauagccguagaacccggcaaaaauccgaaaaacuuccaaacaaugccaggcacuuuccaaacaaccaccggagaaauaggagccauagcgcuggauuucaaaccaggcacauccggaucgcccauuauaaacagggagggcaaagucgugggucucuauggaaauggagucguaaccaagaaugguggguacgucagugguauagcccaaaccaaugcagagccggacgggccuacgcccgaacuggaggaagaaauguucaagaagcgcaaccugacaauaauggaccugcacccggggucggguaagacccggaaguacuugcccgcgauaguuagggaggcgaucaaaaggcgauuaagaacccugaucuuggccccaacacgcguuguagccgcggaaauggaagaagcccugaaaggccuaccuauaagauaccagacaacggccacgaaaucggaacacaccggccgcgagauagucgaucuaaugugccacgcgacauucacuaugcgacuacuuucccccguucgcgucccgaauuacaaccuuauaauuauggacgaagcgcacuuuacugacccagcauccaucgccgcacgcggcuauauaucgacacgaguggggaugggggaagcggcugcaaucuuuaugaccgcaacaccuccagggacagccgaggcguuuccccagagcaaugccccgauccaggacgaagaacgggacauaccagagaggucuuggaacagcggaaacgaguggaucaccgacuucguggggaaaacugugugguucguaccaagcaucaaagcaggaaaugacaucgccaauugccuaaggaaaaacgguaagaaaguuauccagcugagcaggaagaccuucgacacggaguaccagaaaacgcggcucaacgacugggacuucgugguaaccacggacaucagcgaaaugggggcaaacuucaaggccgacagggucauagaccccagaaggugucuaaaaccaguaauacuaacggacggucccgaacgaguaauucucgccggaccgaugcccgucaccgccgcaagcgcggcacagcgccgaggaagaguugguagaaauccacaaaaagagaacgaucaauacauauucacggggcaaccccucaacaaugacgaggaccacgcacacuggaccgaggcaaaaaugcuucucgacaacauaaacacuccagaaggaaucaucccggcacuauucgagccagagcgcgagaaaagcgcagccaucgacggcgaguaccgcuuaaaaggcgaaagucgaaaaaccuucguagagcucaugcggcgcggcgaccuacccgucuggcuugcacacaaaguagcauccgaaggcaucaaguacacagaccggaaauggugcuucgauggagaacgaaacaaccagaucuuggaagaaaacauggacguagaaauauggacgaaggagggcgagcggaagaagcuccggccgcgauggcucgaugcucgaaccuauagcgauccacucgccuugaaagaguucaaagacuuugcagcaggccgaaaauccaucgcgcuagaccucgugacagaaauagggcgagugcccucucaucuagcccacagaacacgaaacgcucuggauaaccucguaaugcugcacaaaagcgagcacggaggucgugcauaucgacaugcgguagaggagcuccccgagaccauggaaacgcugcugcugcucgggcucaugauacucuugaccggcggugcaauguuauuucuaaucucugggaaggguaucggcaagacgagcauggggcucauuugugugauaguaucguccgggauguuauggauggccgacguaccacuacaauggauagccagugcaauagugcuugaguucuuuaugaugguguuguugaucccagagcccgaaaagcaaaggaccccgcaagacaaccaacuagcauacgugguaauuggcauauuaacucucgccgcgaucguugcggcgaacgaaaugggccuccucgaaaccaccaaacgggaccuugguaugaguaaagaaccugguguaguauccccuacgagcuacuuggacguggauuugcaucccgcaucugcauggacgcuguaugccguggccaccacugugaucacuccaaugcuccggcauacaauugaaaacucaacugcaaacgugucgcucgccgccaucgcgaaccaggccguugucuugauggggcuagauaaaggcuggccgauaagcaaaauggaccugggagugccacugcuggcccucggaugcuauucccaagucaacccacugacccucacagcagcaguacuccugcucgugacacauuacgcgaucauugggccgggccugcaagcaaaggcgacgcgagaggcacagaagagaacagccgcugggauuaugaaaaacccaacgguggacgguauuaugaccauugaccuggacccggugaucuacgacucuaaguucgaaaaacaguuaggccaaguaaugcuauuaguacucugcgccguacaacuacuccugaugcgcacgucaugggcacugugcgaggcacugacgcucgcaacaggcccuauaaccacgcucugggaaggaagcccagggaaguucuggaacacaacaaucgcggugaguauggccaacauauucagaggaagcuaccuagcgggcgccggucuagcauuuuccaucaugaaaagcgugggcaccggcaggagagggaccgguucgcagggugaaacccuaggagaaaaauggaagaagaaacuaaaccaacucucgaggaaagaguucgaccuuuacaagaaaucgggcauaacggaaguggaucgaacugaggccaaagaagggcucaaacguggagagacaacgcaccacgcgguaagccggggaagugcaaaacuccagugguuuguggaacggaacaugguaaucccagaaggucgagucauagaccuggggugcgggcgaggaggauggucguauuacugugcagggcuaaagaaagugaccgaggugagaggauacacaaagggagguccaggucacgaggaaccgguaccaaugagcaccuacggauggaacauagucaaacuuaugucagggaaggacgucuucuaucuaccacccgaaaagugcgacacgcuacucugugacaucggcgagaguaguccuucccccacaguggaagagucccgaacaauccggguacuuaaaauggucgagccuuggcugaagaacaaccaauuuugcauuaaggugcuaaacccauauaugcccacaguaaucgagcaccuagaacggcuacaacgaaaguacggcggcauguuggugcgcaacccccucagcagaaacucaacgcacgaaauguacuggauuagcaacgggacaggaaacauaguaagcagcguuaacaugguaucaagauugcuacuaaacagguucacaaugacgcaccgccggccgacaauagaaaaagaugucgaccucggugcggguacaagacacgugaaugccgagcccgaaacaccaaauauggacguaauaggagagaggauaaaacgcaucaaggaagaacacagcagcacuuggcacuaugaugacgagaacccguacaaaacgugggcauaccauggcucauaugaagucaaagcgacaggcucugccagcagcaugauaaaugggguaguaaagcuacugacuaaaccaugggacguagucccgauggucacucaaauggcaaugaccgacacgacucccuucggccagcagcggguguuuaaagagaaaguagacacccggacucccaggccgaugccaggaacacgaaaggugauggaaauaacagcggaguggcucuggagaacgcuagggcgaaauaagaaaccacgacuuugcacaagagaggaguucaccaaaaaggugcggacgaacgcagccaugggggccguauucacggaggaaaaccaaugggacagcgcacgcgcagccgucgaggaugaagaguuuuggaagcuaguagaucgugaaagagaguuacacaagcuaggaaaaugcggcuccugcguuuacaacaugauggggaagcgcgagaaaaagcugggugaguucggaaaggcuaaagggucgagagcaauaugguacauguggcuuggcgcacgauaucuagaauuugaggcacucggauuccuaaaugaagaccauugguucucgagggaaaauuccuacucugggguugagggcgagggcuuacauaaacuaggcuacauacuucgagacauuagcaagaucccgggaggggccauguacgcugacgacacugccggaugggacacacggauaacagaagacgaucugcacaacgaggagaaaaucacacaacaaauggaucccgaacacagacagcuagccaaugccauauuuaagcucacguaccaaaacaaaguaguaaaaguccagcggcccacgcccaagggcacggucauggauauaauuucgcgaaaggaucaacguggaagcggccaaguaggcacguauggccuaaacacauucacuaacauggaggcgcaacucgugcgacaaauggaaggcgaaggaguauuaagcaaagcggaccucgaaaacccccaucugcucgaaaaacgcauuacacagugguuggagaccaaaggagucgaaaggcugaagagaauggcuaucucaggagacgacugcguugucaagccgauagaugaucgauuugcgaacgcgcugcuagcgcucaacgacauggggaaaguucggaaagacauaccccaauggcaaccuuccaaaggauggcaugacuggcaacaggugccuuuuuguagccaccacuuccaugaguuaauaaugaaggacgggcgaaaauugguagucccuugucgcccacaagacgaacuaauaggucgcgcucggauaucgcagggagccgguuggucccucaaggaaaccgcaugcuugggcaaggcauacgcacaaauguggagccucauguauuuccauagacgagaccuacgccuggccuccaaugcgauauguucggccguacccgcccacuggauacccacaucucgaacgacaugguccauacacgcccaucaccaguggaugacaacagaggacaugcuuacaguauggaaucguguguggaucgaagacaacccauggauggaagacaagacgccagugaccacgugggaagacgugcccuaccuaggcaaacgagaagaccaauggugugggucgcuaauuggccucacgucacgagcaaccugggcccagaauauucugaccgcuauccaacagguccgcagcuuaauaggggacgaagaguuccuagauuacaugccgagcaugaaacgcuucagaaaagaagaggagagugagggcgcgauaugguaa

SEQ ID NO: 26100 - RNA, 9873 nt, Artificial Sequence
  derived and/or modified CDS sequence (opt11) from DENV-3__EU482455__SS-prME
acaucccucugucugaugaugaugcugcccgcaacacuggcguuucaccucaccucucgugacggcgagccgaggaugauaguggggaaaaacgagcgcggcaagagccugcuguucaagacagcgucggggaucaacaugugcacccucaucgccauggaccugggggagaugugcgaugacaccgugaccuacaagugccccuuaguggcggaaguggagcccgaggacaucgacugcugguguaaccuuaccagcaccugggugaccuacgggacgugcaaccaggccggcgagcaccggcgggacaagcgguccguggcucuggcgccccacgugggcaugggccuggacacccgcacccagaccuggaugagcgccgagggagccuggaggcaggucgaaaaagucgagacgugggcucuccggcacccgggcuuuaccauucuggcgcuguuuuuggcccacuauaucgggaccucgcuuacccaaaaggugguuaucuucauccuccucaugcuggugacgccgagcaugaccaugcggugcgugggggucggcaaccgcgacuucgucgagggccugucaggggcgacguggguggacguuguucucgagcauggcgggugugugaccacgauggccaagaacaagcccacccuggauaucgaacugcaaaagacugaggccacccagcucgccacgcugcggaagcuguguaucgagggaaagauuacaaacaucaccacagacagccgcugccccacgcagggcgaggcgauccuuccggaggagcaagaccagaacuacgucuguaagcacaccuauguugaccggggguggggcaacgggugcggccuguucgggaaaggcucgcugguaaccugcgcgaaauuccagugucucgagcccaucgagggcaaggucguccaguaugagaaccugaaauacaccgugaucaucacgguacauacgggggaccagcaccaggugggcaacgacacacaaggggucaccguggaaauuacgccacaggccagcaccguggaagccguacugcccgaauacggcacgcuugggcuggaguguagcccccgcaccggucuggacuucaacgagaugauccucuugaccaugaagaacaaggcuuggauggugcacaggcaaugguucuucgaccugccccuccccuggacaagcggcgccacaaccgaaacuccgacguggaacaagaaggagcuacuggugaccuuuaagaacgcacacgccaaaaagcaggaggucguggugcucggcucccaagaaggcgcuaugcacaccgcacugacgggggccacggagauccaaaauucaggcgggacauccaucuucgcgggccaccugaagugccgccucaagauggacaagcuggaacugaaggggaugagcuacgccaugugucuaaacaccuucgucuuaaagaaggagguguccgaaacacaacaugggacgauucugaucaagguggaguacaagggcgaagacgccccgugcaaaauccccuucuccaccgaggacgggcagggcaaggcgcauaacggccggcugaucaccgccaaccccgucgucaccaagaaggaggagcccguuaacaucgaggccgagccucccuucggggagagcaacaucguuauugguaucggggauaaggcacucaagaucaauugguacaagaagggauccagcaucgguaagauguucgaggcgacggcccgcggugcucggcguauggcgauccugggagauaccgccugggauuucggguccguagguggcgugcugaauagccugggcaagaugguacaucagaucuucggcuccgcguacaccgcgcuuuuuagcggcgugucauggaucaugaagauuggcauagggguucugcucaccuggaucggccugaauagcaagaauacauccaugagcuucuccugcaucgucauagggaucaucacccuguaccucggcgccguggugcaagccgacauggggugcgcaaucaacuggaagggcaaggaacugaagugcggcuccggaauuuucgucaccaaugaggugcacaccuggacggagcaguacaaauuccaagcggacucccccaaacgacuggccaccgccaucgcuggcgccugggagaacgggguguguggcauccgcagcaccacccgaauggagaaccucuuauggaagcagaucgcaaaugagcucaacuacauccucugggaaaauaacaucaagcuaacgguggucguuggggacaucaucggcguccuggagcagggcaaacgcacccucacgccccagccaauggagcugaaguacaguuggaagaccuggggcaaggccaagaucgugacggccgagacccagaacagcuccuucaucaucgacgggcccaacacccccgagugccccagcgccucucgcgcguggaaugucugggagguggaggauuaugguuucggcguguuuaccacgaacaucuggcugaaguugcgggagguuuacacacagagcugcgaccaccgccugaugagcgcagccaucaaggacgaacgggcgguccacgccgacaugggcuacuggaucgagucccagaagaacgggagcuggaagcuggaaaaggcguccuucaucgagguuaaaaccuguaccuggcccaagucacacacccucuggucaaacggcgugcuggaguccgacaugaucauccccaagucccuggccgggccuaucucacaacauaaccaccgcccgggauaccacacccagaccgccggacccuggcaccucggcaagcuggagcuggacuucaacuacugcgaaggcaccacggucgugaucacggagaacugcgggacucggggccccucccuccgcaccaccacggugagcggaaagcugauacacgaauggugcugccgguccugcacccugccaccccuccgcuacaugggcgaagacggaugcugguacggcauggagauccgucccauaaacgagaaggaggaaaacauggucaagagucuggugagcgcgggcagcgggaagguggacaacuuuaccaugggcgugcugugccuagccaucuuguucgaggaggugaugcgcgggaaguucggaaagaagcacaugaucgcgggggugcuguucaccuucguacuccugcuguccggccagaucacauggcgggacauggcccacacccucaucaugaucggcagcaacgcauccgaccgcauggggaugggcgugaccuaucuggcccugaucgccacuuucaagauccaacccuuccucgcacugggguucuuccugcggaaacucacgagccgcgaaaaccuguugcucggggugggccuggccauggcgaccacccugcagcuccccgaggauaucgagcagauggccaacgguaucgcgcuaggccugaugaccuuaaagcugaucacgcaauucgagaccuaccaguuguggacugcccucgugucgcugaccugcuccaauacgaucuucacccugaccguugccuggcggaccgccacacucauccuggccggggucagccugcucccgcugugucaguccagcuccaugcgcaagacugacuggcuccccaugaccguugccgccaugggcgugccgccccucccacuguucauuuucucucugaaggacaccccaaagcggcgcuccuggccgcucaacgagggggucauggccgugggguugguguccauccuggccuccagucuccugcgaaacgacguuccaauggccggcccguuaguggcuggcgggcuccugaucgcgugcuaugugaucacggguaccuccgccgauuuaaccguugagaaagccgcggacguaaccugggaggaggaggcggagcagacgggaguuucucauaacuuaaugaucaccgucgacgacgacgggaccaugcggauuaaggacgacgagaccgagaacauccugaccgugcugcucaagacggcccuacugaucguuagcggcauauuucccuacucaauucccgccacccugcuggucuggcacacauggcagaagcagacccagcguuccggcgugcugugggacgugcccagcccgcccgagacgcagaaggcagagcucgaggaaggugucuaucgcaucaaacagcagggcaucuuugggaagacccaggugggcgucgggguacagaaggaaggcgucuuccacaccauguggcacgucacccgcggcgccguccuaacccacaacggaaagaggcuagagcccaacugggcguccgugaagaaagaucuuaucaguuauggcgggggcuggaggcugucagcccaguggcagaagggggaagagguacaggugaucgccguggaacccggcaagaacccgaagaauuuucagacgaugcccggcaucuuccagacaaccacgggcgaaaucggugccaucgcgcucgacuucaagccugggaccucagguagcccuaucaucaaccgcgaagguaagguaguagggcuguacgggaacgggguuguaacaaagaacggugguuauguuuccggcaucgcccagaccaacgccgagccagacggccccacgccugagcucgaagaggagauguucaagaagcggaaccugaccaucauggaccugcacccggggucuggcaagacgcggaaguaucuaccggcgauuguucgcgaggccaucaagcggagguugcggaccuuaauacuugcacccacgcgcgugguggccgccgagauggaagaggcccugaaggggcugcccauucgguaccagaccaccgccacuaaguccgagcacacgggccgggaaaucguagaccucaugugccacgcuacuuucaccaugcggcugcugagcccgguccgcgucccaaacuacaacuuaaucaucauggaugaggcccacuucacagaccccgcuuccaucgcagcucggggauacaucagcacgcgcguuggcaugggcgaggcggcagccaucuucaugacggccacaccgcccgggaccgcggaagccuucccccaguccaacgcacccauacaggacgaggagcgggauaucccugagcgaaguuggaacuccggaaacgaauggaucacggacuucguugguaagaccgucugguucgucccuucuaucaaggccggcaacgacaucgcuaacugccuacgcaaaaacgggaaaaaggugauccaacugucccggaagacuuuugacaccgaguaccagaaaacgcgccucaacgacugggacuucgucguaacgaccgacaucagcgagaugggagcgaacuucaaagccgaccgggugaucgaccccagaaggugccugaagcccgucauauuaacagacggccccgagcgcgugauuuuggcugggccgaugccagugacggccgccagcgccgcccagcggcggggccggguggggcgcaauccccaaaaagagaacgaccaauauauauuuaccggccagccucugaauaacgacgaggaucacgcccacuggaccgaggccaagaugcugcuagacaacaucaacacuccagaagguauuauccccgcccuguucgagcccgagcgcgagaaguccgcagcgaucgacggcgaguaccgccuuaaaggcgagucccggaaaaccuucgucgagcucaugcgccgcggggaucugcccgucuggcuggcccacaagguggcaucugagggaaucaaguacacggaccgcaaauggugcuucgacggggagagaaacaaccaaauccucgaagagaacauggacguggagauuuggaccaaggagggugagaggaagaaauuacgaccgagauggcuugacgcgcgaaccuacagugacccccucgccuugaaagaguucaaagacuucgccgccggccgcaagagcauagccuucgaccuggugaccgagaucggacgcguacccucccaccucgcguaccggacgcggaacgcauuagacaaccugguuaugcuucacaccucggagcacggcgggagggcuuaucgucacgccgucgaggagcugccagagacaauggagacccucuugcugcucggccucaugauucugcuuaccgggggcgccaugcuguucuugauauccggaaaggguauaggcaagaccucuaucgggcugauuugcguaauugucagcuccggcaugcucuggauggcggacguccccuugcaauggauugccagcgcaaucgugcuggaguucuuuaugauggugcuacugauccccgagcccgagaagcaacgcacaccgcaggacaaucagcuggcuuacguggucaucgggauccucacccuggccgcgauaguggccgcgaacgaaaugggacuacucgagacaaccaagcgggaccugggcaugucgaaagagcccgggguugugagccccaccuccuaccucgacguugaccuccaucccgccucugccuggacauuguaugcggucgcgacaaccgugauuacgccgaugcugcgucacacgaucgagaacuccacggccaacgugagccucgcugcgaucgccaaccaagccgucgugcugaugggccuggauaagggcuggcccaucucuaagauggaucuaggcgugccgcuacuggcccucggguguuacagucaggugaacccacugacuuugacggcagcggugcuccugcuggugacccacuaugccaucaucggcccaggccuccaggccaaggccacaagggaggcccagaagcguaccgcugccgguaucaugaagaaccccacggucgacgggauuaugaccauugaccuggaucccgugaucuacgacuccaaguucgaaaagcagcugggccaggucaugcuccuggugcugugcgcgguucaacuccugcugaugcgcacgucgugggcucucugcgaggcccugacccuggccacgggucccaucaccacgcuuugggagggcagcccggggaaguucuggaacaccacaaucgccguaucgauggccaacaucuucagaggcuccuaccuggccggcgcgggcuuggccuucagcaucaugaaguccgucgguaucggccgccguggcaccgggagccagggugagacgcucggggagaaauggaaaaagaagcugaaucagcucagcaggaaagaguucgaccucuacaagaaauccggcaucaccgagguggaccgaaccgaagccaaggaagggcugaagcgcggcgagacaacccaccacgcuguuagccggggguccgcaaagcugcagugguucgucgaaaggaacauggugauaccagaagggcgggucauagaccucgggugugggcgcggaggguggagcuacuacugcgcgggccugaagaaagugacggagguccgcggcuauaccaagggcggccccgggcacgaggagcccgugccgauguccaccuauggcuggaacauagucaaguuaaugagcgggaaggacguguucuaccugccucccgagaagugcgauacccuucugugcgauaucggcgagucaucucccuccccgacgguggaggaaagccggacgauccguguccugaagaugguggagcccuggcucaagaacaaccaguuuugcaucaagguucugaacccauacaugcccaccgugaucgagcaucuggagcggcuccagagaaaauacggcgggaugcuggugcggaacccucucucccgcaacagcacccacgagauguacuggauuuccaauggcacggggaacauaguuagcuccgugaacauggugagucggcuucugcugaaccgcuucacuaugacccaccggcgaccgaccaucgaaaaggacgucgaccucggcgccgggacgcgccacgugaacgccgagccagagaccccgaacauggacguuaucggagagcgcaucaaaagaaucaaggaggaacacagcagcaccuggcacuacgacgacgagaaccccuacaagaccugggcguaccacggcucguacgagguuaaggccacgggcucugcgagcuccaugauuaaugggguggugaagcugcugacuaagcccugggaugucgugcccauggugacccaaauggccaugaccgacacgaccccuuucgggcagcagcgcgucuuuaaggagaagguggacacccggacgccccggcccaugccgggcacacggaaggugauggagaucaccgccgaguggcuguggcgcacccuggggcggaacaagaagccuagacugugcacaagggaggaguucacgaagaagguccggaccaacgccgccaugggggcaguguuuaccgaggaaaaccagugggacagcgcccgcgccgccgucgaagacgaggaguucuggaagcucgucgaucgggagcgcgagcugcacaagcugggcaagugcggauccuguguguacaacaugauggguaagcgggagaagaaguuaggggaguucggcaaagcgaagggcagccgcgccaucugguacauguggcugggggccagauaccuggaguucgaggcacucggguuucucaaugaggaccacugguucucucgcgagaacagcuacuccggcguggagggcgaggggcugcauaagcugggcuacaucuuacgggacaucagcaagaucccaggcggagcaauguacgcagacgauacugcagggugggacacgaggaucaccgaagacgaucugcacaacgaagagaagaucacccagcagauggaucccgagcaucggcagcuggccaacgcuaucuuuaaacugaccuaucagaacaaggucguuaaggugcagcgccccacgccgaagggaacgguaauggauaucaucucucggaaggaucagcgcggcagcggacaggucgggaccuaugggcugaacaccuucaccaacauggaggcgcagcucgugagacagauggagggggagggcguccuguccaaggcugaccuagaaaacccgcaccuccuggaaaagaagauuacgcaguggcuugagacaaaggggguggagcgccucaagcggauggccaucagcggcgacgauugcguggucaaacccaucgacgaucgcuucgccaacgcccugcuggcucucaacgacaugggcaaggugcggaaggauaucccccaguggcaaccguccaagggguggcacgacuggcagcaggucccauucugcagccaccacuuucacgaacugauuaugaaggacggccgcaagcuagucguaccuugccggccgcaagacgagcucaucgggcgcgcacggaucucccagggcgccggauggagccuaaaggagaccgcaugccugggcaaggcguaugcccaaauguggucccucauguacuuccaccgccgggaucugcggcuggcgucgaacgccaucugcucggccgugcccguccacuggauccccaccagccgcacaaccuggucgauucacgcucaccaucaauggaugaccaccgaggauaugcucacgguguggaaucggguguggaucgaggacaaccccuggauggaggacaaaaccccugucaccaccugggaggacgugcccuaccugggcaagcgagaagaccaauggugcgggucccugaucggacucacgagccgggcaaccugggcgcagaauauccugaccgccauccagcagguccgcucccugaucggggacgaggaguuccucgacuacaugcccaguaugaaaagauuucgaaaggaggaggaguccgagggugcaaucugguga

SEQ ID NO: 26101 - RNA, 9873 nt, Artificial Sequence
  derived and/or modified CDS sequence (opt11) from DENV-3__EU482456__SS-prME
acaagccugugccuuaugaugaugcugcccgccacccuggccuuccaccucacguccagggacggcgagccgcguaugaucgugggcaaaaaugagcgcggaaaguccuugcuguucaagaccgcguccgggaucaacaugugcacccucaucgcuauggacuugggcgagaugugcgaugacacuguuacauacaagugcccccucaucgcagagguggaacccgaggacaucgacugcugguguaaccucaccagcaccugggugacauacgggacaugcaaccaggcaggcgagcauagacgcgacaagcgguccguggcccuggcuccccacgugggcauggggcuggacacccgaacccagacauggaugagcgccgagggcgccuggagacagguggagaaaguagagacgugggcccuaaggcacccgggguuuacgauuuuggcgcuguuucuugcccacuacauaggcacgucccugacccagaagguggugaucuucauucuacuaaugcuggucacgcccagcaugacuaugaggugcguuggggugggcaaccgcgacuuugucgagggccuaagcggggccacuuggguggacguggugcucgagcacggcgggugcgugaccacgauggccaaaaacaagcccacccucgacaucgagcugcagaaaacagaggccacacaacucgcgacgcugcgaaaacuuugcaucgagggcaagauuaccaacaucaccaccgacucgcgaugccccacgcaaggugaggccauacucccugaggagcaggaccagaauuauguguguaagcacaccuacgucgaccgggggugggggaaugggugcggccuguucgguaagggcaguuuggugaccugcgccaaguuucagugucucgagcccaucgagggcaaggugguccaguacgagaaccuuaaauacaccgucauaaucaccgugcacacgggggaccagcaccaagucggaaacgacacccagggggugaccguagagaucacgccccaagcgucgacgguggaggccguucugcccgaguacggcacccucgggcuggagugcuccccgcgcaccgggcuugacuuuaccgagaugauucuacugacgaugaagaacaaagcguggaugguucacagacagugguucuucgaccuuccccuccccuggacuagcggcgccaccacugagacgcccaccuggaaccgcaaggaguuacuggugacuuuuaagaacgcccacgcaaagaagcaggagguggucgugcucgguucccaggagggcgcgaugcauaccgcccugacgggggccaccgagauccaaaacagcggugguaccuccauuuucgccggacaccugaaaugccggcuaaagauggacaagcuggagcugaaggggaugagcuacgccaugugccuuaacacguucguacugaagaaggaggucuccgagacgcagcacgggacuauccugaucaagguugaguauaagggcgaggacgccccgugcaagauccccuucagcaccgaagacgggcaaggcaaggcgcacaacggccgccugauuaccgccaacccugugguaacaaagaaggaggaacccgugaauauugaggcggaaccgccguucggagaguccaacaucguuaucggcaucggagauaaggcauugaagaucaacugguacaagaagggcucuagcaucgggaagauguucgaggcgacugcccggggcgcccgccggauggccauccugggcgacacggccugggacuucgggagcgucggcggggugcugaacagccucggcaagauggugcaucagaucuucggguccgcguauacugcacuguucagcggcgucuccuggaucaugaagauagguauaggugugcuguugacguggaucggccugaacagcaagaauacauccaugaguuucuccugcaucguaaucgggaucaucacgcuguaccucggcgcugucguacaggccgacauggggugugugaucaacuggaagggaaaggaacucaagugcggcagcggaaucuucgucacuaaugaggugcauacauggaccgagcaauauaaguuccaggccgauucgcccaagcgccuggcgacugcaaucgcgggcgccugggagaacggagugugcgguauacgcagcaccacacguauggagaaccuccuguggaagcagaucgccaacgagcuuaauuacauucucugggagaacaacaucaaguuaaccgucguggugggagacaccaucggcguacuagaacagggcaagcgcacacucacgccccagccaauggagcugaaguacucauggaagaccuggggcaaggcgaagaucgugaccgccgaaacucagaacagcuccuucaucaucgacggcccgaacacucccgagugcccgagcgccucccgggcuuggaacguuugggaggucgaggacuauggguucggagucuucacaaccaacaucugguuaaagcuccgcgagguguacacccaaagcugugaccaucggcugaugagcgcggccauuaaggaugagcgggccgugcacgccgacaugggcuauuggauagagagccaaaagaacggcagcuggaagcuggagaaggcgucguucaucgaagugaagaccugcacguggccgaaaagccacacccuauggucaaacggcguucuggaaucagacaugaucauuccaaagagccuggcggggcccaucagccagcacaaucaccggccgggcuaucacacccagaccgccgggcccuggcaccucggcaagcuggagcuggacuucaacuacugugagggcaccaccgucgugauaaccgagaacugcgguacacgcgguccgucccuccggacgacuaccguuagcgggaagcugauccacgaguggugcugccgauccugcacucugcccccgcuccgguacaugggcgaggacggcugcugguacggcauggagauaagaccgaucaacgagaaggaagagaacauggugaaaucucugguauccgccgggagcggaaaggucgacaacuuuacgaugggcguacugugccucgcgauauuguuugaggagguaaugagagggaaguucggcaagaagcacaugaucgccggggugcucuuuacguucguacuucuacuguccggacagauaacauggcgcgacauggcgcacacucucaucaugauugggagcaacgccuccgaccggaugggaaugggcgugacguaccuggcguugauugcaacuuucaagauacagcccuuucucgcccugggguucuucuugcggaaguuaaccucacgggagaaccugcuacucggcguugggcuggcuauggccacuacacugcagcugccagaggacaucgagcagauggccaacgggaucgcccugggccuaaugacacuuaaguuaaucacccaguucgagaccuaccagcuguggacugcgcucgucuccuuaacuugcuccaacaccaucuucacgcugacgguagccuggcgcaccgccacccucauacuagcgggugucagccuccuuccucucugccaaucgagcuccaugcggaagaccgauuggcuucccaugacagucgccgcgaugggcgugccuccccugccgcuguucaucuucagccugaaggacacccccaagcgccgcuccuggccacucaacgagggggucauggccgugggccuggugagcauucuugccagcagccuccugagaaacgacguccccauggcaggcccguuaguugccgggggccuccugaucgcgugcuacgugaucaccggaaccuccgcggauuugacggucgagaaggccgccgacgugaccugggaggaggaagccgagcagacuggcgugagccacaaccucaugaucacagucgacgacgacgggaccaugcgcaucaaggaugaugaaacagagaacauucugacagugcugcucaagaccgcacuguuaaucgucuccggaauauuccccuauucuauucccgccacgcuccuggucuggcacacguggcagaagcaaacucaacggucgggcgugcugugggacgugccaagcccucccgagacccagaaggccgagcucgaggagggggucuaccgcauaaaacagcagggcaucuucggcaagacccaggugggcguggggguccagaaagagggcguguuccacacaauguggcacgugacccggggcgcaguccucacccauaacgggaagaggcuggagcccaauugggccucagugaaaaaggacuuaaucuccuauggcgggggcuggcggcuguccgcucaguggcagaaaggugaggaggugcaggucaucgcaguggaaccgggcaagaacccgaagaacuuccagacgaugcccggcaucuuccagacuaccaccggggagauaggagccaucgcccuggacuucaagccuggaaccucaggcagcccgaucauaaaccgcgaggggaagguggucggccuguacggcaacgggguggugacgaagaacggaggcuacgucucaggcaucgcucaaacaaaugcugaacccgacggacccacccccgagcucgaggaagagauguucaagaaacggaaccugaccaucauggaccugcacccggggucuggcaaaaccaggaaguaccugccugccaucgugcgggaggccaucaagagacgucugcgcacgcugaucuuagcccccacccggguggucgcugccgagauggaggaggcacugaaggggcugcccauccgcuaccagaccacggccaccaaguccgagcacaccggccgggagauuguggaccucaugugccacgccaccuucacgaugcgccugcugagccccgugcgcguccccaacuacaaccucaucaucauggacgaggcgcacuuuaccgacccagccuccaucgccgcccgcggauacaucagcacccgggugggaaugggagaggccgcagccaucuucaugaccgcgacgcccccggggaccgccgaggcuuucccccagaguaacgcccccauccaggacgaagagagagacauacccgaacgcagcuggaacuccggcaacgaguggaucaccgauuuugugggcaaaaccgucugguuuguucccagcauuaaggccggcaacgacaucgccaacugccugagaaagaacgggaagaaggugauucagcuuuccaggaagacuuucgacacagaguaccagaagacacggcucaacgacugggacuucgucgugaccacggacauauccgagaugggcgccaacuuuaaggcagaccgcgugaucgacccccggagaugccuuaagcccgucauccugaccgacggccccgagcgggugauacucgcugggccuaugcccgucaccgccgccagcgccgcccagcgucggggcagagucgggcggaauccccagaaagaaaacgaccaauacaucuucaccggucagccccugaauaacgacgaggaccacgcccauuggaccgaagccaagaugcugcucgauaacauaaacacgccggaagggauaauccccgcacuguucgaacccgagcgcgaaaagagcgccgcgaucgacggagaguaccgcuuaaaaggcgagucccgcaagaccuuuguggaacucaugcgacguggggaccugcccgucuggcuggcacacaagguugcaagcgagggcaucaaguacaccgaccggaaguggugcuuugacggggagcgaaauaaccagauacucgaggagaacauggacguggagauuuggaccaaagagggcgagcggaaaaagcugcgaccgcgcuggcuggacgcccgaacguacuccgacccccucgcguuaaaggaguucaaggacuuugccgcaggucgcaagucgaucgcccuugaucucgucaccgagauagggcguguuccaucgcaucuggccuaccguacccggaacgcgcuggacaaccucgugaugcuacauacgagcgaacacggcgggcgcgcauaucggcacgccgucgaggagcugcccgagacgauggagacccuucuccugcucggccugaugauccugcucaccgggggcgccaugcuuuucuugaucagcggcaaggggaucggcaagaccuccaucgggcucauuugcgugaucguaagcuccgguaugcuguggauggccgacgucccacugcaauggaucgcgagcgccaucguguuggaguucuucaugaugguguugcucauccccgagcccgagaagcagcggacaccgcaggacaaccagcucgccuacgucgugaucgggauccugacgcuggccgccaucguggcggccaacgaaaugggccuccucgagaccaccaagcgggaccugggcaugucaaaggaacccggggucgugagccccacgaguuaccucgacguggaccugcauccugccagcgcauggacauuauacgccguggcuaccaccgugaucacgccgaugcuccgccacaccaucgagaacuccaccgccaaugugagccuggccgccaucgcgaaccaggcuguagugcugaugggccucgacaagggguggccuaucucaaagauggacuuaggagugccccuccuggcccugggaugcuacagccaagucaacccccugacccuuacggccgcuguucugcugcucgugacccacuaugcgaucaucggcccgggccuacaggccaaggccacucgggaggcacagaaacgcaccgccgcuggaauaaugaagaaccccaccguugacggcaucaugaccaucgaccuggauccugugaucuacgacuccaaguucgagaagcagcucggacaggugaugcuacugguccucugcgccgugcagcuuuugcucaugcggaccagcugggcucuuugcgaggcccucacccucgccacgggcccuaucaccacccugugggaggggucgccggggaaguucuggaacaccacgaucgcggucagcauggccaacaucuuccgcggcuccuaccuggccggggccgggcuagcauucagcaucaugaaguccgucgguaccggccggcggggcaccgggagccagggcgagacccucggggagaaguggaagaagaagcuaaaccagcucagccggaaggaauuugaccuguacaaaaaguccgggauuaccgagguugaccgcaccgaggccaaagagggucuaaagcggggcgagacgacccaccacgccgugagcaggggcuccgccaaacuccaaugguucguugaaagaaacaugguaaucccagagggcagagugaucgacuuaggcugcggccgcggcggguggagcuacuacugcgcaggccuaaagaaggugaccgaggugcggggcuacacgaaagggggacccgggcacgaggagcccgugccgaugucgaccuacggcuggaacaucgucaagcucaugagugggaaggacguguuuuaccugccacccgaaaagugugacacacugcugugugauauuggcgaguccagccccuccccgaccguggaagagagccguacgauccggguccucaagaugguagagcccuggcugaagaacaaccaguucugcaucaagguguuaaacccuuauaugcccacagucaucgaacaccuagagcgccugcagcggaaguacggcgguaugcuggugcgcaacccgcuuucucggaacagcacccacgagauguacuggaucuccaacggcaccgggaauaucguaagcuccgucaacauggugagccgccugcugcucaacagguucaccaugacccaucgaagacccaccauagagaaggacgucgaccugggcgccggcaccaggcacgugaacgcagaaccggagacgccuaacauggacgugaucggggagcggauuaaacgaaucaaagaggaacacuccagcaccuggcacuacgacgacgagaaccccuacaagaccugggccuaucauggcuccuacgaggucaaggccacgggcucagccagcuccaugauaaacgggguggugaaguuacucacgaagcccugggacgucgugcccauggugacccagauggccaugacugacaccacgccguucgggcagcagagagucuuuaaagagaagguggacacccgcaccccgcggcccaugcccggcacccgcaaagucauggagaucacugcugaauggcuguggcgaacccugggccgcaacaaaaagccgcgccugugcacccgagaggaguuuacuaagaagguacggacgaaugccgccaugggagccguauucaccgaggagaaccagugggacagcgcgagagcugccguggaggacgaagaguucuggaagcuggucgaccgugagcgggagcugcacaagcugggcaagugcgggucuugcgucuacaacaugaugggcaaacgcgaaaagaagcugggggaguucggaaaggccaagggcagcagagccaucugguacauguggcugggggcccgcuaccucgaguucgaggcccugggcuuccugaacgaggaucacugguucucccgggagaacagcuauuccgggguggagggcgaggggcuccacaaacugggcuacauccugcgcgacaucagcaagauccccggcggggccauguacgccgacgacaccgcuggcugggacacccggaucacggaagacgaucuccacaaugaggagaagaucacucagcagauggacccagagcaccgccaguuagccaacgccaucuucaagcugaccuaccagaacaaagucgugaaggugcagaggcccaccccgaaagggacuguuauggacaucauaaguaggaaagaccagcgggggagcggucagguggggacguacggccucaacacguuuacaaacauggaggcucagcuaguucgccagauggagggggaaggagucuuauccaaggccgaccuggagaacccccaucugcuggagaagaagaucacccaguggcucgagacaaaggggguggagcggcugaagcgcauggcgaucagcggcgacgacugcguggucaagcccaucgacgaucguuucgccaaugcccugcucgcacuuaacgacauggggaaggugcgcaaggacauaccccaguggcagccuuccaaaggguggcacgacuggcaacaggugcccuucugcagccaccauuuccacgaacugaucaugaaagacggccggaagcuagucgugcccugccgcccccaagacgagcugauaggcagggcccggaucucccagggcgcgggguggucguugaaggagaccgcaugccuggggaaggcuuacgcccagauguggucucugauguacuuccaccgacgggacuuacgccucgccagcaacgcuaucugcagcgccguuccgguccacuggauccccacgagccgaacgacguggagcauccacgcccaccaccaguggaugaccaccgaagacaugcuuaccguguggaaccgcguguggauugaggacaaccccuggauggaggacaaaacgccgguaaccaccugggaggacgugccauaccucggcaagcgcgaggaucaguggugcggguccuuaaucggacuuacgagccgcgccacgugggcgcagaacaucuuaacagccauucaacaggugcggucccucauuggggacgaggaguucuuagacuacaugcccucuaugaaacgcuuucggaaagaggaagaguccgagggggcuaucugguga

SEQ ID NO: 26102 - RNA, 9873 nt, Artificial Sequence
  derived and/or modified CDS sequence (opt11) from DENV-3__EU482457__SS-prME
accagcuuuugccucaugaugaugcuuccggcuacccucgcauuccaccuaacgagucgggacggcgaaccgcggaugaucgugggcaagaacgagcggggcaagagccuccuguuuaaaaccgcgucugggaucaacauguguacccuuauugccauggaccucggcgagaugugcgacgacaccgucacguauaaguguccccugaucgcggagguggagccggaagacaucgacugcugguguaaccugacgagcaccuggguuaccuacggaacaugcaaccaggccggcgagcaccggcgcgacaagcguuccgucgcccucgcgccccacgugggcauggggcuggacacccggacccagacauggaugucagccgaaggcgccuggcgccagguggagaaggucgaaaccugggcccugcgccacccaggguucaccauccucgcgcucuuucucgcccacuacaucggcaccucccucacacagaaggugguaaucuucauccugcuuaugcucguaacucccagcaugaccaugcggugcguaggugugggaaaccgcgacuucguagagggccucuccggggcaaccuggguggaugugguacuugagcauggcgggugugugacuacgauggccaaaaacaagcccacgcucgacaucgagcugcagaagaccgaggccacccagcuggcaacgcugagaaagcucugcaucgaaggcaagaucaccaauaucaccaccgacagccgcugccccacgcagggagaggcgacccugccggaggagcaggaccagaacuacguguguaaacacacauacguugacaggggauggggcaacgggugcggccucuucggcaaaggcucccuugugaccugcgcgaaauuccagugccucgagccuaucgagggcaaggugguccaguaugagaaucugaaguacacggucauuaucacuguucacaccggugaccagcaccaaguuggcaacgacacccaggggguuacggucgaaaucaccccacaggccagcacuguggaggccgugcugcccgaauacgguauacuuggguuggagugcuccccacggaccggccuugacuucaacgagaugauccuucucaccaugaaaaacaaggccuggaugguccaucggcagugguucuucgaccugccguuacccuggaccagcggugccaccaccgagaccccuacuuggaaccgcaaggagcuccuggugaccuucaagaaugcccacgccaagaaacaggaggugguagugcuagggagucaggaaggcgcgaugcacaccgcgcugacaggggccacggaaauccagaacagcggagggaccuccauauucgccggccaccucaagugcagacugaaaauggaccgucucgagcucaagggcaugagcuacgcaaugugccuaaacaccuucguuuugaagaaagaagucagcgagacccagcacggaacgauccugaucaaaguggaguacaagggagaggacgcuccgugcaagaucccauucaguacugaggacgggcaggggaaggcgcacaacggccgccugaucaccgccaaucccguggucaccaagaaagaggaacccgucaacaucgaagccgagccccccuuuggcgagagcaauaucgugaucggcaucggggauaaggcccugaagaucaacugguacaagaagggcucuagcauugggaagauguuugaggcgacagcccgcggcgcccggcgcauggcaauccucggcgacacugccugggacuucggcuccgucggcgggguucugaauagccugggaaaaaugguccaccagaucuucggguccgcguacacagcccucuucucuggcgucuccuggauuaugaagauaggcauaggggugcuguugaccuggaucggcuuaaacucaaaaaacacguccaugucauuuuccugcaucgugaucgguaucaucacccuguaccugggcgccguagugcaggcggacaugggaugcgugaucaauuggaagggcaaggagcuaaagugcggcagcgggaucuucgucaccaacgaggugcacacuuggacggagcaguacaaguuccaggccgacucccccaaacgccucgcgaccgcaauagccggggccugggagaacgggguguguggcauccguaguacuacccgcauggaaaaucugcucuggaagcagauugcuaacgagcugaacuacauccuuugggagaauaacaucaagcucacgguugucgugggggacacgaucggcguuuuagaacagggcaagaggacauugacgccccagcccauggagcucaaguauucuuggaagacuuggggcaaggcuaaaaucgugacugccgagacacagaauagcuccuucauuaucgacggucccaacaccccggaaugccccagcgccucucgcgcguggaacgucugggaggucgaggacuacggcuucggcgucuucacgacuaacauuuggcugaagcugcgggagguguauacucaaagcugcgaccaccgccucaugagcgcggccaucaaagacgagcgagcgguccacgccgacaugggcuacuggaucgagagucagaagaacggguccuggaagcuggaaaaagcgucauucaucgaggugaagaccugcaccuggcccaagagccacacgcugugguccaacggcgugcucgagucagacaugaucauccccaagucccuagcggggcccaucucacagcauaaccaccgcccgggcuaccacacccagaccgccgggcccuggcaccuggggaagcucgagcuggacuucaacuacugcgaaggcaccaccguggugaucaccgagaacugcgguaccagaggccccucccugaggaccacgaccgugagcgguaagcucauacacgaguggugcugccgguccugcacccugccaccgcugagguacaugggugaggacggcuguugguacggcauggagauccggcccaucaacgagaaggaggagaauauggucaagagccuugugucugccgguagcggcaaaguggacaacuuuaccaugggcguacugugccuggccauccucuucgaggaagugaugaggggaaaguucggcaagaagcacaugaucgccggggugcuguucacguucguccuguuacugucgggucagaucaccuggcgggacauggcccacacucugaucaugaucggcuccaaugccuccgaccgcauggggaugggcgugacauauuuagcguugauagccacguuuaaaauccaaccuuuccuggcacucggguuuuuccuccggaaguugaccucccgagagaaccuccugcugggcgucggccucgcgauggccacaacccugcagcugcccgaggacaucgagcagauggcgaacggcaucgcccucggccugaugacgcugaagcucauaacccaguucgagaccuaccagcuguggacggcucugguuagccucacaugcuccaacaccaucuuuacccucacgguggcuuggcggacggccacccugauccucgcgggggucucgcugcugccgcucugucaguccaguuccaugcgcaagaccgacuggcugccaaugaccguggccgcgaugggagugccgccauuaccccucuucaucuucagccugaaggacacucccaagcgacggucauggccccugaacgaggguguaauggcggugggauuagugagcaucuuggccuccagccugcuccgaaacgacgugccuauggcaggaccgcugguggccggcggucugcugaucgcgugcuacgugaucaccgggaccuccgccgaccugaccgucgagaaggccgccgacgugacgugggaggaggaggccgagcagaccggaguaagccacaacuuaauggucaccguggacgaugacggcaccaugcggauuaaggacgacgagacagagaauauacucacaguucuucugaagaccgcacucuuaauugucuccggcauauuccccuauagcauucccgccacccugcucguguggcacaccuggcagaaacagacgcagcgcagcggcguacuuugggauguccccucgccgccggagacccagaaggccgagcuagaggaggggguguaccggaucaaacagcagggcaucuuuggcaagacucaggugggcgugggggugcagaaggaagggguguuccacacaauguggcacgucacgcgcggcgcuguacucacccacaacgggaagcggcuugagcccaacugggccucggucaagaaggacuuaaucagcuacggugggggcuggcgccucuccgcgcaguggcagaagggggaagaggugcaggugaucgccguggagccagguaagaacccgaagaacuuccagaccaugccaggcaucuuccagaccacuacuggggagaucggugccaucgcccuggacuucaagccggggaccagcgggaguccgaucaucaacagggagggcaaggucgugggucuguauggcaacggaguagucaccaagaacggcggguacgugaguggaaucgcgcagaccaacgcagagccggaugggcccaccccugaacuggaggaggagauguucaagaagcgcaaccucaccaucauggaccugcacccggggaguggcaagacccggaaauaccugccggcuaucgugcgugaggccauuaagcgacgccuccggacucugauucuagcccccacccgcgucguggcggcggagauggaagaggcccucaaaggucugcccauccgauaccaaacgacggcaacuaaguccgagcacaccggccgcgagaucguagaccugaugugucaugccacauucaccaugcgguuacugagcccgguccgcgugcccaacuacaaccugaucaucauggacgaggcgcacuucacugaccccgccuccaucgcagccaggggguacaucagcacucgcguuggcaugggcgaggcagcggccaucuucaugaccgccacgcccccgggcaccgccgaggcguucccccagaguaacgcccccauccaggacgaggaacgcgacaucccugagcgcucauggaacucgggcaacgaguggauuaccgacuucgucgguaaaacgguaugguucgugccuagcaucaaggccggcaacgacaucgccaacugucuccgcaaaaacggcaagaaagucauccagcugucccguaagaccuucgauaccgaguaccagaagacacgucugaacgacugggacuucguagugaccaccgacaucucugagaugggcgcuaacuucaaggcggaucgagucauugacccccgccggugccucaagccugugaucuuaacggacggcccugagagagugauacuggccgggcccaugccaguaaccgccgcaucugcugcgcagcgccgcggccgugugggacgcaacccccagaaggaaaacgaucaauacaucuucaccggccaaccacucaacaacgacgaggaccaugcucacuggaccgaggccaagaugcuguuggacaacaucaacaccccggagggcaucauccccgccuuauucggccccgaaagagaaaaauccgccgcgaucgacggcgaauaccgccuuaagggggagucccggaagacguuuguugaguugaugcgcagaggcgaccuucccguguggcuggccuauaagguggccagcgaggggaucaaauauaccgauagaaaguggugcuucgauggagaacggaauaaccagauucuggaagagaacauggaugucgaaauauggaccaaggagggcgaaaggaagaagcuccgcccgcgguggcuggacgcccguaccuacuccgacccccuggcgcucaaggaguucaaggauuucgcggccgggcgcaagagcauagcccuggaccuugugaccgaaaucggccgcguacccucucacuuagcccaccggacccgcaacgcgcuggacaaccuggucaugcuccacacgucugagcacgggggccgagcuuaccgccacgccguggaggagcugccugagaccauggagacgcugcuccugcuggggcucaugauacugcugaccggcggagcgaugcuguuccugaucucgggaaagggaaucgggaagaccuccauagggcugauaugcguuauugucagcuccggcaugcucuggauggccgacgugccauuacaauggaucgcgagugccauaguucuggaguucuuuaugaugguccucuugaucccugagcccgaaaagcagagaaccccgcaggacaaccaacuggccuacguggugaucggcauccucacacucgccgcgaucgucgcggcaaacgagaugggccuccucgagaccaccaagagggaucuggggauguccaaggagcccggaguagugagccccacuuccuaccuugacgucgaccuccaccccgccucagcauggacccuuuaugccguggcgaccaccgugaucacccccaugcugcgacauaccauugagaacucgaccgcuaacgucagccucgcugcgaucgcgaaccaggccgugguccugauggggcucgauaagggguggcccauauccaagauggaccucggggugccccuccuggccuuaggaugcuacagccaggugaacccuuuaacacugacggcugccguacuccugcucgugacacacuaugcgaucaucgggccggggcuccaggcgaaggccacucgcgaggcccaaaagcggacagccgcgggaaucaugaagaacccaaccguggacggaaucaugacgaucgaccuggaccccgugaucuacgacuccaaauucgagaagcagcugggccaagucaugcucuuagugcugugcgccgugcaacuccugcugaugcgcaccucuugggcacucugugaggcucugacacuggccacuggcccaaucacuacccucugggaagggucuccgggaaaauucuggaacaccaccaucgcggucagcauggccaacaucuuccgaggguccuaccucgccggagccggcuuagcguucagcauaaugaaguccguaggcacaggccgccgggggacgggcagccagggagagacccucggcgaaaaguggaagaagaagcugaaccagcuuagucggaaggaguucgaccucuacaagaaguccgggaucaccgaaguggacaggaccgaggccaaggagggccugaagcgcggagagacgacccaccaugcagucagucggggguccgccaaacugcagugguucgucgagcgcaacauggucauacccgagggccgcgucaucgaucugggcugcggccgcggaggguggagcuacuacugcgccgggcugaaaaaggugaccgaggugagaggcuacaccaaagggggacccggccacgaggagcccgugccgauguccacguacggguggaacaucgugaagcucaugaguggcaaggaugucuucuaccugccgcccgaaaagugcgacacucugcugugugauaucggcgagaguucuccauccccaaccgucgaagagucacggacaauccgcguucugaagaugguggagccuuggcucaagaacaaccaauucugcauaaagguccugaaccccuacaugcccacagucauugaacaccuggagcggcuucagcgcaaguacgggggcaugcuggugcggaauccgcugagucgcaauagcacucacgagauguacuggaucaguaacggcaccggcaacaucguaagcuccgugaacauggucagccggcuucugcuaaaccgauucacuaugacucaucggcgcccuacuaucgagaaggauguugaccuuggagcggggacccggcacgucaacgccgagcccgaaacaccgaacauggacguaauuggcgaacgcaucaagcgcaucaaggaagagcauuccagcaccuggcauuacgacgacgagaacccguacaagaccugggcguaccaugggagcuacgagguaaaggccacuggcagcgccuccuccaugaucaacgggguggugaagcugcugaccaagccgugggauguggugccuauggugacgcaaauggccaugaccgacacuaccccguucggacagcagcgcguguuuaaggagaagguggacacgcggacgccacggccaaugcccggcacucggaaggucauggaaaucaccgccgaguggcucuggcgcacgcuggggcgcaacaaaaagccgagacuguguacccgcgaggaguucaccaagaaagugaggacuaacgccgccaugggagccguguucacagaggagaaccagugggacaaugcgcgcgccgccguugaggacgaagaguucuggaaguugguggauagagagcgcgagcugcacaagcugggcaagugcggcagcugcguguacaacaugauggggaaacgggagaaaaagcucggcgaguucggcaaagccaaggggucgagagcaaucugguauauguggcugggcgcccgguaccuggaguucgaagcccucggguucuugaacgaggaucacugguucagccgcgagaacuccuauagcggaguagaaggggagggccugcacaaacucggcuacauccugcgcgacaucuccaagauuccaggaggcgccauguacgccgacgauaccgcgggaugggacacgcgcauuaccgaggacgauuuacauaacgaggaaaagaucacacagcagauggaccccgagcaccggcagcuugccaaugccauauucaaacugaccuaccagaacaagguggugaagguccagcgcccuaccccgaaagggaccgugauggacaucaucagccggaaggaccagcgcggaaguggccaagucgguaccuacgggcugaacacuuucaccaacauggaggcccagcucguccggcaaauggagggcgagggaguacugagcaaggcugaccuggaaaacccccaccuccuggagaagaaaaucacccagugguuggagaccaagggcguggagaggcucaagcggauggccaucuccggcgacgacugcguuguaaaacccaucgacgaucgcuucgcgaacgcccugcuggcccucaacgacauggggaagguccggaaagacaucccgcaguggcagccgagcaagggcuggcacgacuggcagcaaguccccuucuguucccaccauuuccacgagcugauaaugaaggauggacgcaagcuggucgucccguguaggccacaggacgagcucauaggccgggcgcgcaucucgcagggggcgggcuggucgcugaaggaaacggccugccugggcaaagccuacgcacagauguggucucucauguacuuccaucggcgcgaucugcggcuggccuccaacgcaaucugcagcgccguccccgugcauuggauccccaccucccgcacuaccuggagcauccacgcacaccaccaguggaugacgacagaggacaugcucacggucuggaaccggguguggauugaggacaaucccuggauggaggacaagaccccggugacuacgugggaggaugugccguaccuggggaagcgcgaggaccaguggugcggcagccugauugggcucaccagucgagccaccugggcgcagaacauucuuacggccauucagcagguacgaagccucaucggcgaugaggaguuucucgacuacaugccgagcaugaagcgguuucgcaaggaggaggagucagagggcgccaucugguga

SEQ ID NO: 26103 - RNA, 9873 nt, Artificial Sequence
  derived and/or modified CDS sequence (opt11) from DENV-3__EU482458__SS-prME
acuagccuuugcuugaugaugaugcugcccgcuacccuagccuuccaccucaccaguagagacggcgagccucggaugaucguggggaagaacgagcgagguaaaagcuuacuauucaaaaccgcuuccggaaucaacaugugcacccucaucgccauggaucugggcgagaugugcgaugacaccguuaccuacaaguguccccucaucgcagagguggagcccgaggacaucgacugcuggugcaaccuuaccuccaccugggugacauaugguacguguaaucaggccggcgaacaccgucgcgauaaaagauccguggccuuggcgccccacgugggcauggggcuggacacccgcacccagacuuggaugagcgccgagggggcguggcggcaagucgagaaaguugagaccugggcccucagacauccgggguucaccauccucgcgcuguuccucgcccacuacaucgggacauccuuaacccagaagguagugaucuuuauucuucuuauguuagucacaccgagcaugacaaugcggugcguaggagugggcaaccgcgacuuugucgagggccuuucgggggcuacauggguggacguaguccucgaacacggcgggugcguaaccacuauggccaagaacaaaccgacacuggacaucgagcugcaaaagaccgaggcgacccagcucgcgacacuucggaagcuguguauagaggggaagaucaccaacauuacaaccgacagccgcugccccacgcaaggcgaggccauccugccggaggagcaggaccagaacuacguaugcaaacauacauacguugacaggggauggggcaauggguguggccuguucggaaagggcucacuggugaccugcgccaaguuccagugucucgagcccauugaaggcaaaguuguucaauaugaaaaccucaaguacaccgucaucaucaccguacacaccggggaccaacaccaggucgguaacgacacacaaggggugacggucgaaauuacaccgcaggcuucaacgguggaggccgucuuacccgaauacggcacccuggggcuggagugcuccccgcgcaccggacuggacuucaacgagaugauccuacugacaaugaagaacaaagcguggaugguccaccggcagugguucuucgaccuuccccugccguggaccucaggcgccaccacggagacccccacguggaaccguaaggagcugcugaccacuuucaagaacgcccacgccaagaagcaggaggugguggucuuagggagucaggagggcgccaugcacaccgcccuuacgggcgccacagaaauucaaaacagcggcgggaccuccaucuucgccgggcaccugaaaugccggcucaaaauggacaaacuggaguuaaagggcaugagcuacgccaugugccugaacaccuucgugcugaaaaaggagguauccgagacacagcauggcaccaucuuaauuaaggucgaguacaagggagaagacgcaccgugcaagauccccuucagcacugaggacgggcaaggcaaggcccacaauggcaggcugaucaccgccaaccccguuguuacgaagaaagaggagccugucaacauugaggccgagccgcccuucggggagagcaacaucgugaucggcaucggugacaaagcgcuuaagaucaacugguacaaaaagggguccagcaucgggaagauguucgaggcuacagcacguggcgcccgccggauggcaauccugggugacaccgcgugggacuucgggucggugggcgggguccugaacucucucggcaaaaugguucaccagaucuucggguccgccuacaccgcccuuuucaguggaguguccuggaucaugaaaaucgggaucgggguccucuuaacuuggaucggccuuaacagcaagaacaccucaaugagcuuuucgugcauugugaucgggauuauuacccuauaucucggcgccgugguccaggccgacauggggugcgccaucaauuggaaggguaaggagcugaagugcgggagcgggaucuucgugacaaaugaggugcacacguggacugaacaguacaaguuccaggcggacaguccgaaacgccucgcaaccgccaucgccggugccugggaaaacggugucugcgguauacgcaguaccacacggauggagaaucuccuguggaagcaaauagcgaacgagcugaacuacauccucugggagaacaacaucaagcugacggugguggucggugacauaaucggcguguuagagcaaggcaagcgcacccucacgccucaaccuauggagcugaaguacuccuggaagacgugggggaaggccaagaucguaacggccgagacccagaacagcuccuucauaaucgacgggcccaacacacccgaguguccgagcgccucccgggcauggaacgugugggagguugaggacuacggguucggaguguuuacgaccaacaucuggcugaaguuaagagaggucuacacccagagcugugaccaccggcucaugagugcagcgaucaaggacgagcgcgccgugcacgccgauaugggguacuggaucgagucgcagaagaacgggagcuggaaacuggaaaaggccuccuucauugaagugaagaccugcaccuggcccaagagccacacauugugguccaacgggguccuagagagcgacaugaucauacccaagagucuggccgggcccaucagccagcacaaucaucggcccggcuaccacacccagaccgcgggucccuggcaccucggcaagcucgagcuggacuucaacuacugcgaagggaccacuguugugaucaccgagaacugcggaaugcguggccccucacuccggaccaccacggugucggggaaguuaauacacgaguggugcugucgcucgugcacccugcccccgcuaagguacaugggcgaggacgggugcugguauggaauggagauccgcccgaucaacgagaaggaagagaacauggucaagagucuggugucagccggcagcgggaaggucgacaacuucacaaugggcgugcugugccucgcuaucuuguucgaggaagugaugcgggggaaguucggaaagaagcacaugaucgcgggaguucuauucaccuucguacuccuacugagcggccaaaucacguggagagauauggcccacaccuuaauaaugaucggcucgaacgccagugaccggauggggaugggcgucaccuaccuggcccugauagccaccuucaaaauucagccauuccucgcguuaggguucuuucugagaaagcucacgagccgcgagaaccuguuacucggaguuggccuggcaauggccacuacucugcagcuccccgaagacaucgaacaaauggccaacggcaucgcguuaggcuugaugacauuaaaacugauuacgcaguucgagacauaccaacuguggaccgcccucgucucacugacuugcagcaauacgaucuucacccugacgguggccuggcggacggcaacccucauccucgccggugugagcuuauuaccgcugugucaaucuagcuccaugcggaaaacagacuggcugccuaugacaguagcagccaugggcgugccgccccugccgcuuuucauauucagccugaaagacacccccaaacggagauccuggccccugaacgagggcgugauggccgugggccuggucucgaucuuagccuccagcuugcugcggaacgaugugcccauggccggcccgcuggucgccggcggguugcugauagcaugcuacgugauuaccgggaccuccgccgacuugaccguagagaaggcagccgacgucaccugggaggaggaggcugaacagaccggaguaucgcacaaucucaugaucacaguggacgacgaugggaccaugaggaucaaggaugacgagacggagaacauucuuacgguacugcucaaaacggcccuguuaaucgucuccggcaucuuccccuacagcaucccggccacccuccugguauggcacaccuggcagaagcagacccagcgguccggcgugcugugggacguccccagcccacccgaaacucagaaagccgagcucgaggaggggguguaccgcauuaagcaacaagguauauucgggaagacccaggucggcgucggggugcagaaggagggcguguuucacaccauguggcaugucacccggggugccguacugacgcauaacgguaagcgacuggagccgaauugggcguccgucaagaaggaccucaucagcuacggcgguggguggcggcugagugcccaguggcagaagggugaagagguccaagugaucgccguggagcccggcaagaaccccaagaacuuccaaacgaugcccggcauauuccaaaccacgacgggggaaaucggcgccaucgcgcuggacuucaagcccgggacuagcggcucuccgauuauuaaccgcgaggggaaagugguagggcuuuacggcaacggaguggucacuaaaaacggcggguacguguccgguauagcccagaccaacgcggagccagacggacccacgccggagcucgaggaggagauguucaagaagcggaaccugacgauuauggauuugcacccggggagcggaaagacccgcaaauaccuacccgcgaucguccgggaggccaucaagcgccgguugcgcacccugauccuggcgccgacgcgggugguugcagccgagauggaggaggcccugaagggucugcccauccguuaccagaccacggccaccaaguccgaacauacgggccgcgaaauuguggaucucaugugccacgcgaccuucaccaugcgccuacugagcccggucagaguucccaacuacaaccucauuauaauggacgaggcacacuucaccgaccccgccucuaucgccgcacggggcuacaucagcacacgggugggcaugggugaggcagccgccaucuucaugaccgcgacuccgccugggacugcggaggcauuuccccaguccaacgccccgauacaggacgaggagcgcgacauccccgagagaagcuggaacuccggcaaugaguggauaacggacuucgucgggaagaccgugugguuugugcccagcauuaaggcgggcaacgauaucgccaacugccugcggaagaacggcaagaaggucauccagcuaucccgcaagaccuucgacacugaguaccaaaagacgcguuugaacgacugggacuucguugucaccacggauauuagcgaaaugggcgcuaauuucaaggccgaccgcgucauagauccccggcgcugccugaaacccguaauauuaacugacggccccgagcgggugauucucgcggggccgaugccagucacugccgcauccgcggcccagcgcagaggacgcguggggcggaacccacagaaggagaacgaccaguacauuuucaccgggcagccccugaacaacgacgaggaccaugcccauuggacagaggccaaaaugcuccucgauaacaucaacaccccggaggguaucauccccgcccuguuugaaccagagcgagagaaguccgcggcuauagacggcgaguaccggcugaagggugagucccgcaagaccuucgucgagcucaugcgccgcggggacuugcccgucuggcuggcucacaagguggcaagcgagggcaucaaguacaccgaccgaaaguggugcuuugacggggagcgcaacaaccagauucucgaagagaauauggauguugagaucuggaccaaagagggcgagcggaagaagcugcgcccgcgguggcuggacgcaagaaccuacuccgacccccucgcccugaaggaguucaaggacuucgcagccggcagaaagagcaucgcccuggaccuugugaccgagaucggucggguucccagccaucuggccuaccgcacgcgcaacgcgcuggacaaccuggucaugcugcacaccagcgagcacggcgggcgcgcguaccggcaugcaguggaggagcuuccggagaccauggagacacuccugcugcuaggccuaaugauccuucugaccgggggagccaugcuuuuccugaucucugggaaaggcauaggcaaaacauccaucgggcucaucugcgugaucgucagcagcggcauguuguggauggccgacgugccccuacaguggaucgccagcgccauagugcucgaguucuucaugaugguauuacugauaccagagcccgaaaagcagcgcaccccccaggacaaucagcucgcuuaugucgugaucgggauccuuacucuggcugcaauagucgccgccaacgagaugggccuccuggagacuaccaagcgggaccuuggcaugucgaaggagcccgguguggugucuccuaccuccuaucucgacguagaccugcacccagccagugcuuggacccuuuacgcgguagccacgaccgugaucaccccgauguugcgccacaccaucgagaacuccacggccaacgucucucucgccgcgaucgccaaccaggcgguugugcugaugggcuuggacaagggguggccaaucuccaagauggaccuggguguuccccugcucgcucuuggguguuacucgcaagugaacccacugacccucaccgccgcggugcugcuccucgucacgcauuacgccaucaucggcccgggcuugcaggccaaagccacgcgggaagcccagaagaggaccgcggccggcaucaugaagaaccccaccguggacggcaucaugacaaucgaccuggaccccgugauauacgacuccaaauuugagaagcagcucgggcaggucaugcuacuuguccucugcgccgugcaacugcugcucaugcggacgagcugggcccugugcgaggcacugacccuagcgacgggcccgaucacuacgcugugggagggcuccccggggaaauucuggaacaccaccauagccgucagcauggcuaacaucuuucgcggcucuuaucuggccggggcggggcuagccuucucuaucaugaagaguguuggaacuggcaggcguggcacggggagccaaggcgaaacccugggggaaaaguggaagaagaaguuaaaccagcucagccgcaaggaguucgaccucuacaagaaguccgggaucacagaaguggaccgcaccgaggccaaggagggauuaaagcggggcgaaaccacacaccacgccgucagcaggggcucggccaagcugcagugguucgucgagcggaacaugguaauccccgaggggcgcguuaucgaucuuggguguggacgcgguggguggagcuacuauugcgcuggcuugaagaagguuacugagguccggggcuacaccaaaggcggccccggucaugaggagcccguaccgaugucaaccuacgguuggaacaucgugaagcucaugagcgggaaagacguauuuuaccugccccccgagaagugcgauacucugcugugugauaucggcgaguccucccccucccccacugucgaggagagccguaccauacgagugcucaagaugguggagccguggcugaagaacaaccaguucugcauuaaaguccugaauccguauaugccgacugugaucgagcaucucgagcgccuccagcgcaaguacggcgggaugcucgugcgcaauccccucucccggaauagcacgcaugagauguacuggaucuccaauggcacugggaauaucgucagcagugugaauauggugagccgccugcugcucaauagauuuacgaugacccacagacggcccacuaucgagaaggacgucgaccugggggccggcacccgccacguuaaugcggagcccgaaaccccgaacauggacgucaucggggagcggauuaagcggauuaaagaagagcauuccagcaccuggcacuacgacgacgaaaauccguacaagacaugggcuuaccacggcuccuaugaagugaaggccaccgggucugccuccuccaugaucaacggcguuguuaagcugcucacuaagccaugggacguggugcccauggucacccagauggccaugacugauaccaccccguuugggcagcagcggguguuuaaggagaaaguugacacccgcacgccccgaccuaugcccggcaccaggaaggucauggagauaaccgccgagugguuguggcggacccugggccgcaacaaaaagccgcgauugugcacgcgggaggaguucacuaagaaggugcgcacgaacgccgccaugggggcgguguuuacagaggagaaccagugggacagcgcuagagcagccguagaggacgaggaguucuggaaguuaguggaccgcgagcgggagcugcauaagcucggcaagugugguucuuguguguacaacaugaugggcaagagagagaagaaacugggggaguucggcaaggcgaagggcagccgggccaucugguacauguggcuuggagcgcgauaucucgaguucgaagcacuaggcuuccugaacgaagaccacugguuuucccgugagaacagcuacagcggggucgaaggcgaggggcuccauaagcugggcuacauccugcgagacauuucuaaaaucccagggggggcuauguaugcggacgacacagcgggcugggacacccggaucaccgaagacgaccuccacaaugaggagaagauuacccagcaaauggaucccgagcaucggcagcuggccaacgcgaucuucaaguuaacguaucagaacaagguggugaagguccagcgacccacgccgaaagggacugugauggacaucaucucacgcaaggaccagcggggcagcgggcaaguggggacauacggccucaacacguucacaaacauggaagcgcaacugguuagacagauggaaggagaaggcgugcugucgaaggcugaccuagagaacccacacuuacuagagaaaaagaucacccaauggcuggagaccaaaggcguggaacggcugaaacgcauggcuaucagcggcgacgacugcgucgugaagccuauugacgacagauucgcuaacgcgcugcucgcucugaacgauauggguaaagugcgaaaggacaucccacaguggcagccuuccaagggguggcacgauuggcaacagguccccuuuugcagccaccacuuccacgagcucauaaugaaagacggccggaagcucguggugcccugucgaccccaggaugagcuuauagggcgcgcucggaucucccagggagcuggguggagccugaaggagacggcuugccucggcaaggccuacgcacagauguggucccuaauguacuuucaccgccgggaccuucgccucgcgagcaacgcaaucugcagugccguucccgugcacuggaucccuacgagccguaccacauggagcauccaugcccaccaccaguggaugaccacggaagauaugcucaccguguggaaccgcgucuggauugaggacaauccauggauggaggauaagaccccuaucaccacgugggaggaugugccguaccuuggaaagcgcgaggaccaauggugcggcucccugaucgggcugaccagccgcgcgacgugggcccagaacauccuaaccgccauccagcaaguccguucucucaucggggaugaggaguucuuggacuacaugccgucaaugaagcgcuuccgcaaggaggaggagagcgagggcgcgaucugguga

SEQ ID NO: 26104 - RNA, 9873 nt, Artificial Sequence
  derived and/or modified CDS sequence (opt11) from DENV-3__EU482459__SS-prME
acgucccuaugccuaaugaugaugcuacccgccacucuagccuuccaucugacuagccgggacggggaaccccgcaugaucguagggaaaaacgaacgaggcaaaagccugcuguucaagacugcuucggggaucaacaugugcacgcuaauagcgauggaccuaggagaaaugugcgaugauaccgugacguacaaaugcccccuaaucgccgaaguagaaccugaagacaucgacuguugguguaacuuaaccagcacaugggucaccuacggcaccuguaaccaagccggagaacacaggagggauaagagaagcguagcacuggcaccccauguggggaugggccuggauacaaggacucaaacguggaugagcgccgaaggcgcauggaggcaaguggaaaagguggaaaccugggcgcuacgacaccccggcuucacaauacuagcgcuauuccuagcccacuacauaggcacaagccugacucagaaagugguaauauucauucuacugaugcuaguuacacccucuaugaccaugagaugcgugggggugggcaacagggauuucgucgagggccugucaggggccacuuggguggacgucguucuagaacacggaggcugugugacaacgauggcgaaaaacaaaccaacgcuggauauagaacugcagaaaacggaggccacacaauuagcaacgcuucgcaaacugugcauagagggaaaaaucacgaacauaacgaccgacagccgauguccaacacagggcgaggccauucuuccagaggaacaagaccagaacuaugugugcaagcauacguacguggaucgaggcugggggaacggauguggacuauuugggaaaggcagcuuaguaacuugcgcuaaauuccaaugccuagagccgauagaaggcaaaguaguacaauaugaaaaccugaaguacacagucauuauaacagugcacaccggcgaccaacaccaggucggaaacgauacacagggaguaaccguagaaauuacgccccaagccuccacgguggaagcaguucuuccggaguauggcacacucgggcuggagugcuccccgcgaacaggacuggacuucaaugagaugauccuuuuaaccaugaaaaacaaagcauggaugguccaucgacagugguuuuucgaucuaccgcucccauggacauccggugcaaccacggaaacaccaacauggaaccgcaaagaacuccuaguuaccuuuaaaaacgcacaugccaagaaacaggaaguagucguccuugguucucaagaaggggcaaugcauacugcgcuuacgggagccacggaaauucaaaauagcggagggaccaguaucuucgcaggccaucuuaagugccgccugaagauggauaagcuggaacucaaaggcaugucauacgccaugugccucaacacguucguccucaagaaagaggucucagagacgcaacacgggaccauacucauaaaaguggaguauaaaggcgaggacgcacccugcaagauacccuucaguacagaggacggacaaggaaaagcccauaacggccgacucaucacggcgaaccccguagucacaaagaaggaggagccaguaaacaucgaagcagaacccccauuuggagagagcaacauaguaauagggauaggagacaaagcccugaaaaucaauugguacaagaaagggucuucaaucggcaaaauguucgaagccacagcccgaggagcccggcgaauggcuauccucggagacacagcaugggauuucggaaguguggguggagugcugaacucccucggcaaaauggugcaccaaauuuucgggucggcauacacggcccucuucagcggggugagcuggaucaugaaaauaggcaucggaguccuacugacauggauagggcucaacucgaagaauaccagcaugagcuucucauguauugugauuggaauaauuacauuguaccuaggcgcagucguccaagccgacaugggaugugcgauaaacuggaaaggaaaagaacugaaaugugggagcgggaucuuuguaacaaacgagguacacaccuggaccgaacaguacaaguuucaggcagauagcccgaaacgccucgcaacagcaaucgcuggagcaugggagaauggcguaugcggaauaagaagcacaacuaggauggaaaaccuauuauggaagcaaauagccaacgaacucaauuauauccuaugggaaaacaacauaaaacucacgguuguagugggcgacaucauagggguccuggagcaggggaaaaggacacugacgccccagcccauggaauuaaaguacuccuggaaaaccuggggcaaggcaaagaucgugacagcggaaacacaaaacucaucguuuaucaucgacgggcccaacacgccggaaugcccgucugcuucccgcgccuggaaugucugggaaguggaggacuacggauucggaguauucaccacgaacaucuggcuaaagcuaagagagguauacacgcagagcugcgaccaccgccugaugagcgcggcgauaaaagaugaaagggcaguacacgcagauaugggguacuggauugagucgcaaaagaacggaagcuggaaacuggagaaggccuccuucauugaaguaaagacaugcacguggccaaagucacacacccuauggucuaauggcguacucgagagugacaugauaauccccaaaagccucgcagggcccauaucucagcacaaccacagaccagguuaccacacucaaacugccggccccuggcaccuaggcaagcucgagcuagacuucaauuacugcgagggaacaacagucguaauaacagaaaacugcggaacacgaggacccucgcuacggacaacaacaguaagcggcaaacuuauacacgaauggugcugccgaagcuguacacuaccaccucuccgauauaugggcgaggacgggugcugguacgggauggaaauaagacccauuaacgaaaaggaggagaauaugguuaaaucgcuaguaucugcgggcagcgggaaaguggacaauuucacuaugggaguccugugccucgcgauccucuucgaggagguaaugcgugggaaauucgggaagaagcauaugaucgcggguguucuguucacauuuguacuccuccuuucaggacaaauaaccuggcgggacauggcacauacgcucauaaugauaggaaguaacgccuccgacaggauggggaugggcguuacuuaucuagcacugauagccacauucaaaauacaaccguuccuggcgcuaggcuuuuuccucagaaaauuaacaaguagagaaaacuuguugcuaggcgucggacucgccauggcaacaacacugcagcuacccgaggacauagaacaaauggccaaugggauagcucugggauuaaugacgcucaagcuaauaacucaguucgaaacauaucagcucuggaccgcucugguuagcuuaacaugcucaaacacaauauucacccucacaguagcguggaggaccgcaacgcuaaucuuagcaggcgucagucuacucccacugugccaaagcucaucaaugaggaaaacggauugguuaccgaugaccguagccgccauggguguuccaccccuaccacucuuuauuuucucgcucaaggacacgcccaaacgucgauccuggccgcuaaacgagggcguuauggccgucggucuagugagcauacucgcuaguagcuuauugcgcaacgacguaccaauggcaggcccccuaguagcaggcggcuuacucauagcgugcuacguuauaacaggcacgagcgcggaucucacaguagaaaaagccgcagacguuaccugggaggaagaagcagagcaaacaggcgucucgcacaaccuuaugauaacugucgacgacgauggcaccaugcggaucaaggaugaugaaacagagaauauacuaacgguccuguugaagaccgcccugcuuauagugagcgguaucuucccuuacucuauaccugcgacacuccuaguuuggcauacuuggcaaaagcaaacccagcguagcgggguacugugggacgucccaucaccaccagagacacagaaggcagagcuagaggaaggggucuaccgcaucaaacaacaagggauauucgggaaaacccaggucgguguaggcgugcagaaagagggggucuuccauacgauguggcacguuacgcgcggagccguacucacccacaacgggaagcggcuagaaccaaauugggcaagcgucaagaaagaccuaaucucuuaugggggaggauggcggcucucggcacaguggcaaaaaggcgaagaaguucagguaaucgcaguggaacccggaaagaacccuaaaaacuuccagacaaugcccgggauauuucagacuacgacaggcgagauaggagcaaucgcccuagacuucaaacccggaacaagugggucaccaaucauaaaccgagaggggaaagugguaggauuauacggcaauggcguggugaccaaaaacggcggcuaugucagcggaauagcgcaaacgaaugcagagccggacgggcccacgccugagcuggaggaggagauguucaaaaagcgcaacuuaacaauaauggaucuacacccagguuccgggaaaacgcggaaauaccucccagcuaucguucgagaggcgaucaaaaggcgacugcgaacacuaaucuuagcaccaacccgcguuguggcggcagagauggaggaagcgcugaaaggccuaccaaucagauaccagacaacagcuaccaagucggagcauaccggccgagaaauaguggaccugaugugccaugcaacauucaccaugagacugcuauccccaguacgcguaccgaauuacaaccuaauaaucauggacgaagcccacuucaccgaccccgcgucgaucgcugcacgcggauacaucucuacccgaguaggaaugggagaagcagcggcaauauucaugaccgcgacgccucccgguacagcggaagcauucccacagucaaacgcaccgauacaagaugaagaacgggacauaccggagaggaguuggaacuccggcaaugaauggauaacggacuuugucggaaaaaccgucugguucguacccucaaucaaagcagggaacgacauagccaacugccucaggaagaauggcaagaaaguaauacagcuguccagaaagaccuucgacacagaauaccagaaaacuagauuaaacgauugggauuuuguaguaacaacggauauuuccgagaugggggcgaacuucaaagcugaccgagucauagacccccgacgaugccuaaagccaguuauacuaaccgacgggccggagagagucauacucgcggggcccaugcccguaaccgcggccagcgcggcgcaacggcggggacgcgugggccgcaacccgcagaaagaaaaugaucaauacauauucacagggcagccauugaacaacgacgaagaccacgcgcacuggaccgaggcaaaaaugcuacucgacaauauaaacacacccgaaggaaucauacccgcccuauucgaaccagaacgugaaaagagugccgcgaucgacggugaauaucgucugaaaggagagagccggaaaacauucgucgaacucaugcggcggggcgacuuacccguuuggcuugcgcauaaaguggccucagagggaaucaaauauaccgaccgaaaguggugcuucgacggagaacgcaauaaccaaauccuggaggaaaacauggauguggaaaucuggacaaaggaaggcgagcguaagaagcugagaccaagauggcucgacgccaggaccuacagcgacccgcuggcccucaaagaguucaaagacuucgcggcggggcggaagucgaucgcacuagacuuaguaacggaaaucgggcgcguuccaagucauuuagcguaccgaacgcgaaaugcccucgacaaccuaguaaugcuacacacaagugagcacggcggccgagcauaucgacacgcaguagaggagcuacccgaaacaauggagacgcuacugcugcuaggccuaaugauccucuuaacaggaggugccaugcuguuucugaucaguggaaagggaaucgggaaaacaaguauaggacugauaugcguaaucgucucguccggcaugcucuggauggcugauguacccuuacaauggauagcgagcgcgauuguccucgaguucuucaugauggugcuacugaucccagaacccgagaagcagcguacaccacaggacaaucaacucgcauacgugguaauagguauucuuacgcuggcagcaauaguggccgccaacgagaugggcuugcuagaaaccacaaagagggacuuaggcaugagcaaagagccgggaguugucagcccgacaucguaucuagacguagaccuucauccagcauccgcguggacacucuaugcuguugcgacuaccgucauaacgcccaugcuaagacacaccauagaaaauaguaccgcuaacgucucacuagccgccauagcgaaccaagcagugguccucaugggauuagacaagggcuggccaauuucgaaaauggaccucggagugccgcuucuggcgcucggauguuauagccaagugaacccacucacccugacggccgccguacuucuucuugucacacacuacgcgauaaucggcccagggcugcaagcaaaagccaccagagaggcacaaaagcgcacagccgccggaaucaugaagaauccaacaguggacggaaucaugacaauagaccuggacccaguaauauacgacucgaaauucgagaaacaacucgggcaagucaugcugcuaguacugugcgccgugcaauuacugcuaaugcguacaucaugggcacugugcgaagcccuaacauuagccacaggaccuauaacaacccucugggagggaaguccagguaaguucuggaacaccacaauagcuguaucaauggcaaacaucuuccgaggauccuaccuugcgggagcgggacucgcuuucagcaucaugaaaagcgucggcacgggaagaaggggaaccggcagucaaggugagacccucggagaaaaguggaagaaaaaguuaaaccaauugucccgaaaggaauuugaccucuauaaaaaguccggaaucacagaaguggaccgcacggaggccaaagagggauugaagcgcggagaaacgacccaccacgcugugagccgaggauccgcuaagcuacaaugguucguggaaagaaacaugguuauacccgaaggacgagugauugaccuagggugcggcagaggggguuggucguauuacugcgcuggauuaaagaaggucacggaagugcgaggguacaccaaaggaggaccaggccacgaagaaccagucccaaugucuacguauggauggaaccucgucaagcuaauguccggaaaggacguauuuuaccugccacccgaaaaaugcgacacgcuacuaugugacauaggagaaagcucgcccucgcccacgguagaggagucgagaacuauucgcguccucaaaaugguggaacccuggcucaaaaauaaccaguucugcauaaaggucuuaaacccguacaugccuacgguaaucgagcaccucgagagacuacaacgaaaauacggcggaaugcuuguccgcaacccucuauccagaaacucaacucacgaaauguacuggaucucgaaugggacagggaacauaguauccagcgucaacaugguuucgagauuacuccuuaacagguucaccaugacacacagacgcccaaccaucgagaaggacgucgaccucggagccggcacgcgccacgucaaugcggagccggaaacgcccaacauggaugugaucggagaaagaaucaaaaggaucaaagaagaacacagcucuaccuggcacuaugacgacgaaaacccguacaagacgugggccuaccacggaagcuaugaaguaaaagccaccggcucugcaagcagcaugauaaacggaguggugaagcugcugaccaaacccugggacguagugccuauggucacacaaauggccaugacggauacaacaccauucggucagcaaagagucuucaaagaaaagguggacacgcguacaccccgaccgaugccgggaacacgaaaaguaauggaaauaacugccgaguggcuauggcgcacacuaggacggaauaagaaacccagguugugcacacgcgaggaguuuacaaagaaagugaggacgaacgcggcgaugggcgcggucuucaccgaggagaaccagugggauucagcgcgggcagcaguagaagacgaggaguucuggaaguugguagaucgcgagagagagcugcacaaacuuggaaaaugcggcuccugugucuacaacaugaugggcaagcgcgagaagaagcucggcgaguucggcaaagcaaaaggaagccgagcaaucugguauaugugguugggagccagguaccuggaguuugaagcauuaggauuccuaaacgaggaccacugguucucccgagaaaauuccuacucaggaguggaaggugaaggccuacauaaacuagguuacauccuccgugauauauccaagauaccaggcggggcaauguaugcugaugacacugcagggugggauacgcgcauaacagaagaugaucuccauaacgaggagaagauaacgcagcaaauggacccugagcaucgccaacuagcaaaugccaucuucaaacugacauaucaaaauaaaguaguaaaaguccaaagacccacaccgaaagguacgguaauggauaucauuagccguaaagaccagaggggcagcgggcaagucgguacauacggccuaaacacauuuaccaauauggaagcccaacucgugcgucagauggaaggagaagggguccuaucaaaagcagaucucgaaaacccgcacuuacuggagaagaaaauuacacaauggcuugaaacaaaaggaguagaaagauuaaaaaggauggcuauauccggagacgacugcguagugaaaccuaucgacgacagauuugccaacgcgcuacucgcccuaaacgacaugggaaaaguacgaaaggauaucccccaauggcagcccucgaaaggauggcaugacuggcagcaaguaccauucugcagucaucacuuccacgaacuaaucaugaaagacggaagaaagcugguaguacccugcaggccgcaagaugagcugaucggcagggcaagaaucagccagggagcgggcuggagucucaaagagacagccugccuuggcaaagcguacgcccagauguggucacuaauguacuuccaucgccgugaccucaggcuggcauccaacgcgaucugcagcgcgguacccguccauuggauacccacaucgcgcaccaccuggucgauacacgcccaccaccaauggaugacaacagaagacaugcugacaguguggaacagaguauggaucgaggauaaucccuggauggaagauaaaacuccggucacgacaugggaagacgugccguaucuggguaaaagggaggaccaauggugugggucacugauuggacucaccucgagggcgacgugggcacaaaacauccucaccgcuauccaacaggucagaucauuaauaggggaugaagaguuccuagacuacaugcccagcaugaagcgcuuccgaaaagaagaagaaagcgagggggcgaucugguag

SEQ ID NO: 26105 - RNA, 9873 nt, Artificial Sequence
  derived and/or modified CDS sequence (opt11) from DENV-3__EU482460__SS-prME
acgagccugugccucaugaugaugcugcccgccaccuucgcuuuccaccugacgagccgcgacggagaaccucgcaugaucguggggaagaacgaacgggggaaaagccuccuguucaaaacugcguccggcaucaacaugugcacccucaucgccauggaucucggcgagaugugcgacgacaccgucacguauaagugcccccucaucgccgagguggagcccgaagacauagacugcuggugcaacuugaccagcaccugggugacguaugggacgugcaaccaggcaggcgagcaucgccgcgacaaacggucaguggcucucgcgccccacgugggcauggggcucgauacccgcacccagaccuggaugagcgcugagggcgccuggcgccagguggaaaaggucgaaacaugggcgcuucgccacccgggguuuaccauccucgcccuguuccuggcccacuacauaggcacuucccucacacaaaagguggucaucuucauccuccugaugcucgugacgcccagcaugaccaugcggugcgugggggugggcaacagagacuucgucgaggggcucucaggggcaaccuggguagacgugguacuggagcacggcgggugcgugaccacgauggcaaagaauaaacccaccuuagauauugagcugcagaagaccgaagccacccagcuggccacccuucgcaaacuuugcaucgagggcaagaucacaaacaucaccacugacucucgcugccccacgcaaggcgaggccauccugccggaggaacaggaccagaauuauguguguaagcacaccuacgucgacaggggguggggcaauggguguggauuauucggcaagggaucccuggugaccugugccaaguuucagugcuuagagccgaucgagggcaaagugguccaguacgagaaccuaaaguacaccgugaucaucacggugcauacgggcgaccagcaucaggucgguaacgacacccagggggugacugucgaaaucacgccccaggcgagcaccgucgaagcggugcuccccgaguacggcacgcugggacucgagugcucaccgcgcaccggucuggacuucaacgagaugaucuugcucaccaugaaaaacaaggcguggaugguccacaggcagugguucuucgaccugccgcugccauggacgagcggcaccaccaccgagacgccaaccuggaaccgcaaggagcucuuagugaccuucaaaaacgcccaugccaagaagcaagaggucguggugcuggguucccaggagggagccaugcacacugcccucacgggggcgacugagauacagaacagcggcgguaccucgaucuucgcgggccaucuaaagugccggcucaaaauggacaaguuagagcuuaaggguaugucauacgccaugugccuaaacaccuucgugcucaagaaggagguauccgagacgcagcacgguaccauacuaaucaagguagaguacaagggcgaggaugcuccgugcaaaaucccuuucagcaccgaggacgggcaaggcaaggcacauaauggccgccugauaacugccaaucccguggucaccaagaaggaggaaccugugaacaucgaggccgagccgcccuucggggaaucuaacaucguuauuggcaucggugacaaagcucugaagauaaacugguauaagaaaggguccagcaucgggaagauguucgaggccacggcgcggggcgcccggcggauggcuauccucggagacacugccugggauuucggcucugucggcggcgugcuaaauucccuggguaagaugguucaccagauuuucgggagcgcauacaccgcguuauuuagcggcgucuccuggaucaugaagaucgggauaggagucuugcucacguggaucggccucaacucuaagaacaccucaaugagcuucucgugcauagugauugggauuaucacgcuguacuuaggcgccgucguucaggccgacaugggaugcgccaucaacuggaagggcaaagaacucaagugcggcagcgggaucuucgugacuaacgagguccacaccuggaccgaacaguacagguuccaggccgauucacccaagcgccuggcgacggccauugcgggugccugggagaacggggugugugggauccguagcaccacacgcauggagaaccugcucuggaagcagaucgcaaacgagcugaacuauauccuuugggagaacaacaucaagcucaccguggucgugggggacaucauuggcgugcuggagcagggcaagcgugcgcucgccccucagccgauggagcucaaauacaguuggaaaaccugggggaaggccaagaucguaacugcggagacgcagaacagcucuuucauaaucgauggacccaacacgcccgagugucccuccgcgucccgagcguggaacgugugggagguggaggacuauggguucggcgucuucaccacaaacaucugguuaaaguuacgugagguguauacgcaguccugcgaucaccgccucaugagcgccgccaucaaggacgagagagcggugcacgcggacauggguuacuggaucgagucccagaagaacggaucauggaaauuggagaaggccucauucauugaggucaaaaccugcaccuggcccaagagccacacccugugguccaacggcgugcucgaauccgacaugaucauccccaagucucuggccgggcccauuagucagcacaaccaucgcccgggguaccacacccagacggcuggcccauggcaccuggggaagcucgagcuggacuucaacuauugcgaaggcaccacaguggucaucacggagaacugugguacgcgaggacccucccuucgcaccaccaccgugagcgggaagcucauccacgaguggugcugucggucuuguacgcucccaccgcugagauacaugggcgaggacgggugcugguacggcauggaaaucagacccauuaacgagaaggaagagaacauggugaaaucauuagucagcgccggcucagggaagguggauaacuucacgaugggggugcugugccuggcgauccuuuuugaggaggucaugcgugggaaguucggcaagaaacauaugauugccggggucuuauucaccuucguacugcuccuguccgggcagaucaccuggcgugacauggcucacacacugaucaugaucgguuccaacgccuccgaccggauggggaugggcguaacuuaccucgcccugauagccacauuuaaaauccagcccuuccuggccuuaggcuucuuccugagaaagcugaccagccgcgagaaccucuuacugggggucggucucgccauggccacaacccugcagcugcccgaggauaucgagcagauggccaacgggaucgcgcuaggccuaaugacccugaagcucaucacacaguucgagacguaucaacuuuggacugcccugguaagccuaaccugcucaaacacuaucuucacgcugaccgucgcauggcggaccgccacccugauacucgcggggguuagccuacuuccgcucugucagagcagcuccaugcgcaagacugacuggcugccgaugacagucgcagcgaugggggugcccccacugccacucuucauuuuuagccugaaggacacccccaagcgccgguccuggcccuugaacgagggggugauggccgucggccuagugagcauccuggccucuucuuuacuccgcaaugacgucccaauggcgggaccgcuggucgccgggggccugcucauugcgugcuacgugaucacgggcacgagugcugaccugaccguggagaaggcggcggacgucacgugggaggaggaggcggagcagacgggagugagccacaaccugaugaucacgguggacgacgacgggacaaugcggauaaaggacgacgaaaccgaaaacauccucacaguccugcugaagaccgcccuccugaucguguccggcaucuuuccauacuccaucccggcgacgcuacucgucuggcacaccuggcaaaagcagacccaacgcuccgguguuuugugggacgugccgagcccgcccgagacacagaaggcggagcuggaggaggggguguaccgaauaaagcagcagggaauauuuggcaagacucagguuggagugggggugcaaaaggaagggguguuccauacuauguggcacgucacccgcggcgcgguacucacccacaacgggaagcggcuggaaccgaacugggcuagugucaagaaagaccugaucagcuacggggguggcuggcgccucucugcccaguggcagaaaggggaagagguacaggugaucgccgucgagccugggaaaaacccgaaaaacuuccaaacaaugcccggcaucuuccagacgaccaugggggagaucggcgcaaucgccuuggacuucaagcccgggaccagcgggaguccuaucaucaaccgggagggcaaggugguggguuuguacggcaacggggucgugaccaagaacggaggguacgugucagguaucgcccagaccaacgccgagccugauggccccacccccgagcuggaggaggagauguucaagaaacguaaccuuaccaucauggaccugcauccagggagcggcaagacgcggaaauaccuccccgcaaucguccgggaggcaaucaagcgacggcuccguacccugauacuggccccgacgagaguaguagcggcggaaauggaggaggcacucaaggggcugccaauccgguaccagacgacggcgaccaaauccgagcauaccggccgcgaaauugucgaccugaugugccacgccacauucacgaugagacugcugagcccuguccgcgugcccaacuacaaccugaucauuauggacgaggcccacuucaccgaccccgccuccaucgcggcgcgaggguauauaagcacccgcgucggcaugggagaggcugccgcaaucuucaugacugcgacgccaccaggaaccgccgaggccuucccacaguccaacgcgcccauccaggaugaggagagagacaucccugagcggagcuggaacagcggcaacgaauggaucacugacuuuguggggaagaccgucugguucgucccaucuaucaaggcgggcaacgauaucgcgaacugccuccgcaagaacggcaagaaagugauucagcuuucccguaagacguucgauacugaguaccagaagaccagacugaacgacugggacuucgucguuaccacagacauuagcgagaugggcgccaacuucaaagccgaccgagucaucgauccccgcagaugucucaagcccgugauccuuaccgauggaccggagcgcgugauccuggccggcccgaugcccgugaccgccgcguccgccgcccagcggcgcggacggguggggcguaacccccagaaagaaaacgaccaguacaucuucaccggacagccccucaacaacgacgaggaccacgcccacuggacggaggccaaaaugcuucuggacaacauuaacacuccagaggggaucauuccagcauuguucgagcccgaacgggagaaaagcgccgcaaucgacggugaauaccgucugaaaggcgagucccggaagaccuucgucgagcugaugcgcagaggggaccuacccguguggcuggcccacaaaguggcuucugaaggcauaaaauacaccgaccgcaaguggugcuucgauggagagcggaauaaccagauccuagaggagaauauggacguggagaucuggaccaaggaaggggagcggaagaaguugcgcccgcguuggcuggacgcccguacguauagcgacccgcuggcccugaaggaguucaaggacuucgccgccggacggaaaagcaucgcguuagaccuugugaccgagauugggaggguuccaucccaccucgccuaccggacacgcaacgcccuggauaaucuggucauguuacacacguccgagcacggagggcgggcguaccgccaugccguggaggaacugcccgagaccauggaaacccugcugcuacuggggcucaugauccugcuaacagggggugcgaugcuauucuuaaucagcggcaaagguaucgggaagacaaguaucggccugaucugcgucauagugagcuccggcaugcuuuggauggccgacguucccuugcaguggauugccagcgccaucguccuggaguucuucaugaugguacuccugauacccgagcccgagaaacagcggacgccgcaggauaaccagcuggccuacguggucaucgggauucucacgcuagcugcaaucguagccgccaacgagaugggccugcucgagacaaccaaaagggaccugggcauguccaaggaacccggcgucgucagccccacguccuauuuagacguagaccuccaccccgcuagcgcauggacccuguacgccguggcgacgacggucaucacgccgaugcugcggcacaccaucgagaacuccaccgccaacgugucgcucgcugccaucgccaaccaagccguggucuugaugggccuagauaagggauggcccaucaguaaaauggaccucggcgugccccugcuggcccucgggugcuacucccaggucaacccccugacccugacggcggccguacuacugcuggugacgcacuacgccaucaucggacccggccugcaggcaaaggccaccagagaggcccagaagagaaccgccgcagggaucaugaagaaccccaccguggacggcaucaugacuaucgaccuggaccccgucaucuacgacccgaaauucgagaagcagcugggacaggugaugcuucuggugcugugcgcuguccaacuccugcugaugcgcaccuccugggcccucugugaagcgcuuacccuggccacgggcccgaucacaacccucugggaaggcaguccgggaaaauucuggaacaccacgauagccguguccauggcgaauaucuucagaggcagcuaccuggcgggggccggacucgcuuucuccauuaugaaaucaguggggacggggcgcaggggcaccgggucacagggcgagacccucggggagaaguggaaaaagaaacugaaccaguugucucgcaaggaguucgaucucuacaagaaaagcggcaucacugaagucgaccggacugaggcgaaggaggggcugaagcguggggagacuacccaccacgccgugagucggggcagcgcuaaacugcagugguuuguggagcgaaacauggugauuccagaggggcgggugaucgaucucggcugcgggaggggcggaugguccuacuacugcgccggccugaagaaagugacggaaguccgcggcuacaccaaggguggccccggccacgaggaaccggucccuaugagcaccuauggcuggaacauugugaaacugauguccggcaaggacguguuuuauuuaccuccagagaagugcgacacgcugcuuugugacauuggagagagcucccccucacccaccguggaagagucucgcaccauccgcgugcugaaaaugguggagcccuggcuuaaaaacaaccaguucugcaucaaggugcugaauccuuacaugccuaccgugaucgagcaccuagaacggcuccaacgcaaguacggagggaugcugguccggaacccacugucucgaaacuccacccacgagauguacuggaucagcaacggcacggggaacaucguuagcucagugaauaugguuucccgucuccugcugaaccgcuucacgaugacccaccgucgcccgaccauugagaaggauguugaccuaggagccggcacucggcauguuaacgcugagccggagacgccuaacauggacgugaucggggagcguaucaagcggauuaaggaggagcauagcuccaccuggcacuacgacgacgagaacccguacaagacuugggccuaccacggcagcuaugaagugaaggcgacuggguccgcgagcagcaugauaaauggcgucguaaagcugcugacgaagccuugggaugugguccccauggugacgcaaauggccaugacagauaccacgcccuucgggcagcagcgcguguucaaggaaaaggucgacacccggacaccccgcccaaugccgggcacacggaagguaauggagaucacggcggaguggcucuggagaacacuuggccgcaacaagaaaccccggcuaugcacaagagaagaguucacuaagaaagugagaacuaaugccgcaaugggcgccgucuucacagaggagaaccaaugggacagugccagggccgcggucgaagacgaggaguuuuggaagcucguggaccgggagcgggagcuccauaagcugggcaagugcgggucaugcguauacaacaugauggggaagagagagaagaagcucggcgaguucggcaaagccaagggaucccgcgccaucugguacauguggcucggagcucgguacuuagaguucgaggcccucggcuuccucaacgaggaccacugguucucacgcgagaacucauauagcgggguagaaggcgaggggcugcacaagcucggcuauauccugcgcgacauauccaagauccccggaggggcgauguacgccgaugacacugccggcugggacacacgaauaacggaggacgaccugcacaacgaggagaaaaucacccagcagauggaccccgaacaccggcagcucgccaacgcaaucuucaaacugaccuaccagaacaagguggucaaggugcagcgcccaacccccaaggggacggugauggacauaaucagccgaaaggaccagcgcggcuccggccaagugggcaccuacggccugaacacguuuacgaacauggaggcgcaguuaguacggcagauggagggggagggcgucuugucgaaggccgaucuggagaacccucacuugcuggaaaagaagaucacgcaguggcuggaaacuaagggggucgagcgccucaagcggauggccaucuccggggaugacugcguggugaagccuauugacgaccgguucgcuaacgcccugcuagcgcucaaugacaugggcaagguccggaaggacaucccgcaguggcagcccucaaagggguggcaugacuggcaacagguacccuucugcagucaucacuuccacgagcugaucaugaaagacggucgcaagcuggugguccccugccgcccacaggacgagcucaucgggagagccaggaucucccagggggccggguggagccugaaagaaacugccugccuaggaaaagccuacgcgcagauguggagccucauguacuuccauagacgagaccugagacuugccuccaaugccauuugcagcgccgugcccguccacuggauccccacuucccgcaccacguggagcauccaugcgcaccaccaguggaugaccaccgaagauaugcucaccguuuggaaccggguauggaucgaggacaaucccuggauggaggauaagacaccgguaaccaccugggaagacguucccuaucugggcaagcgcgaggaccaguggugcggcucgcuuauaggucuaaccucuagggccacgugggcccagaacauccuaaccgccauucagcagguacgcucguugaucggugacgaggaguucuuggauuacaugcccuccaugaaacgguuuagaaaggaggaggagagcgagggagccauaugguaa

SEQ ID NO: 26106 - RNA, 9873 nt, Artificial Sequence
  derived and/or modified CDS sequence (opt11) from DENV-3__EU482461__SS-prME
acuagccugugccugaugaugaugcuacccgcuacgcucgcguuccacuugacuagccgggacggcgaaccccggaugaucguggggaagaacgagagaggcaagagcuugcuguuuaagaccgccuccgggauaaacaugugcacccugaucgccauggaccugggcgagaugugcgacgacacggugacguauaagugcccucugaucgcugaagucgagcccgaggacaucgacuguuggugcaaccucaccagcaccugggugaccuaugguacgugcaaucaggccggugaacaccggcgcgacaagcgcagcguggcacuagcgccgcacguaggcauggggcuggacacgaggacccagaccuggaugagcgccgagggcgccuggcgccagguggagaagguggaaacgugggcccuccgccacccgggguucaccauccuggcgcuguuccuagcccacuacaucggcaccuccuuaacccagaaggucgugauauuuaucuuacucaugcuggugacgcccucuaugaccaugcgcugcguggggguggggaaccgcgacuucgucgagggccuguccggcgccacguggguagacgugguccucgagcacggcgggugcgugaccacgauggccaagaauaagccgacccuggacaucgagcugcagaagaccgaggccacccaauuggcgacgcugcggaagcuguguauugagggcaagaucaccaacaucaccaccgacagccgcugccccacgcaaggggaggccauccucccggaggagcaggaccagaacuacgugugcaagcacaccuacgucgaccgggggugggguaauggaugcggccuguucgggaagggcucccuagugaccugugccaaguuccaaugucuggagcccauagagggcaaggugguccaauacgagaaccuaaaguacaccgugaucaucacggugcacaccggggaccagcaccaaguaggcaaugacacccaagggguuaccguugaaaucacgccccaggccagcaccguggaagccgugcugcccgaguauggcaccuugggacuggaauguucuccgcgcaccgggcuggacuuuaaugagaugauucuccugaccaugaagaacaaggcguggaugguccaccggcagugguucuucgaccugccccuccccuggacgagcggcgcgaccaccgagacccccacguggaacaggaaggagcugcuggugacguuuaagaaugcccaugccaagaagcaagagguggucgugcucgggucccaggagggcgccaugcacaccgcucugaccggcgcuacggagauccaaaacagcggagggaccagcaucuucgccgggcaccucaagugccgccucaagauggacaaacuugaauuaaagggcaugagcuacgccaugugccucaacaccuucgugcugaagaaggaggucuccgagacccagcacgggacgauccugaucaaggucgaguacaagggagaggacgcgccgugcaagauccccuucaguaccgaggacgggcagggcaaagcgcacaauggccgccuuauaaccgccaaccccguggucacaaagaaggaggagccggugaauaucgaagccgagccgcccuuuggggagagcaacaucgugaucggcaucggagacaaggcccucaagaucaauugguacaagaaaggcuccucuauagguaagauguucgaggccacggcgagaggcgcccgccggauggccauccucggcgacaccgcuugggacuuuggguccgucggcggggugcugaauagccucgggaaaauggugcaccagaucuucggguccgcguacaccgcacuguucagcggcgucuccuggaucaugaaaaucgguaucggugugcugcucaccuggaucggccugaacagcaagaacacguccaugagcuucuccuguaucguuauagggaucaucacccuguaccucggcgcagucgugcaggccgacauggggugcgccaucaacuggaagggcaaggagcuuaagugcggcagcgggauauucgugacgaaugagguccacacguggacagagcaguacaaguuccaagcggauucgccaaagcggcuggccacugccaucgccggcgccugggaaaaugggguuugugguauccgcuccaccacccggauggaaaaccuccuauggaaacagaucgcgaacgagcuaaacuacauccucugggagaacaauaucaaacugacugugguugugggggacaucaucggagugcuggagcagggcaaacgcacguugacaccucagccgauggagcuuaaauacaguuggaaaaccugggggaaagcgaagaucguaacggccgagacccagaauagcuccuucaucaucgacggccccaacacccccgaaugccccagcgccucccgcgcguggaacguaugggagguggaagacuacggcuucggugucuucacaacgaacaucuggcugaagcuccgugagguguacacgcagagcugcgaccaccggcugaugagcgcggcaaucaaggacgagcgcgccgugcacgcagacaugggcuacuggauugagucccagaagaacgggagcuggaaguuagaaaaggccuccuucauugaggucaagacgugcacuuggcccaagagccacacccucugguccaacggggugcuggagagcgauaugauaauccccaagucccuggccggaccaaucagccagcauaaccaccggccgggcuaccacacucaaaccgccgggccauggcacuuagguaaacuggagcuggacuucaauuacugugagggcaccaccguggucaucacggaaaacugcgggacccgcggucccucccuacggaccaccaccgugagcgggaagcugauccacgaguggugcugccgcuccugcacccugcccccgcuccgguacaugggcgaggacgguugcugguacgguauggagauccgccccaucaacgagaaagaggagaacaugguuaagagccugguuagcgccggcagcggaaaaguggacaacuucacgaugggcgugcucugccuagcaauacuuuucgaggaggucaugcgggggaaguuuggcaagaagcacaugauugcaggggugcuguucacguucguucuccuguuguccggacaaaucacguggcgcgacauggcccacaccuugaucaugaucggcagcaacgccuccgaccggauggggaugggcguuaccuaccuagcccugauugcuacauucaagauccaacccuuccucgcucugggguucuuccuccguaaacuuacgucccgggagaaccuacuuuugggcgucggccuugcgauggcaacgacccugcagcuccccgaagacaucgagcagauggcuaacgggaucgcgcugggccugaugacgcucaaacuuaucacgcaguucgagacguaccagcuguggaccgcacugguuagccugaccugcuccaacacgaucuucacccugacggucgccuggcgcaccgccacgcucauccuggccggggugucguugcucccgcucugccaguccagcuccaugcggaagaccgacuggcugcccaugacggucgcggccaugggcgugccgcccuuaccguuauucaucuucagccugaaggacaccccgaagcgccgcuccuggccucucaacgagggggugauggccgucggccuugugagcauccuggcuuccagccuccugcggaacgaugugcccauggcagguccgcugguagcuggcggguuauugaucgccugcuacgugaucacggggaccuccgcugaccugacaguggaaaaggcugccgacgucaccugggaggaggaagcggagcagacgggggugagccacaaccugaugaucaccguggacgacgacgggaccaugagaaucaaggacgacgagaccgagaacauccucaccguccugcugaagacggcucuacugaucguauccggcaucuuccccuacagcauccccgccacccuguuaguguggcacaccuggcagaaacaaacccagcggagcggcguccugugggaugugcccagcccgcccgagacgcagaaggccgaauuggaggagggcguguaccgaaucaagcagcagggcaucuucggcaaaacacagguaggcguaggggugcaaaaggagggcgucuuccacaccauguggcauguaacucggggcgccgugcugacgcacaacgggaagcgccuggagcccaacugggcguccgucaagaaggaccucaucagcuacggcgggggcuggcggcugucugcccaguggcagaagggggaggagguccaggucaucgccguggagcccggcaaaaacccgaagaacuuccagaccaugccaggcauauuccagaccacgacgggggaaaucggcgccauagcccuggacuuuaagcccgggaccagcgguagccccaucaucaaccgugagggcaaggugguggggcuuuacggcaaugggguugugacaaagaacggcggguacguguccggcauagcccagaccaacgccgagccugacggcccgacgcccgagcucgaagaggagauguucaagaagcggaaccugaccauaauggaccugcacccagguucgggcaagacccggaaguaccuccccgccaucgugcgggaggccaucaaaaggcggcugcgcacgcugauucuugcgccgacacgggugguggcggccgagauggaggaggcccuuaagggacugccuauccgcuaucaaaccaccgcuaccaagucggagcacacgggccgggagaucgucgaccucaugugccacgcgaccuuuaccaugcgccugcucucucccgugcgggugccgaacuacaaccuugucauuauggacgaggcccauuucaccgaccccgccuccaucgccgcccguggguacaucagcacgcgggugggcaugggcgaagccgccgccaucuucaugacggcaacgccgcccgggacggcggaggccuucccccaguccaacgccccuauccaggaugaagaacgcgacauccccgagcgcaguuggaacucagguaaugaauggaucacggacuucguaggaaagaccgucugguucguccccagcauuaaagcagguaacgacaucgccaacugccugaggaaaaacgguaaaaaggugauccagcugagcaggaagaccuucgacaccgaguaccagaagacgcggcucaacgacugggacuuugucgucaccacggacaucagcgagaugggcgcgaauuucaaggccgaccgcgucaucgacccucggcgaugccugaagcccguuauccuuaccgacggacccgaacgggucauccucgccgggccgaugcccgugacugccgccuccgcggcccagcgccgaggccgcgucgggcggaacccccagaaggagaacgaccaguacaucuuuacgggccagccccugaacaacgacgaggaccaugcccacuggaccgaggcaaagaugcugcucgacaacauaaacacgccggaggggaucauccccgcccuguucgagccagagcgcgaaaaauccgcggcuaucgacggcgaguaccgguuaaagggcgagucccgcaagaccuucguggagcugaugcggcgcggggaccugcccguuuggcuagcccauaagguugcuuccgagggcaucaaguacacggaccguaaguggugcuucgacggggagcguaacaaccagauccuagaagagaacauggacguggagaucuggaccaaggagggcgagcguaagaaauuacggccgagauggcuggacgcucggaccuacuccgacccccuagcccugaaggaguucaaggacuucgccgcuggccgcaagagcauugccuuggaucuagucacagaaauugggcggguccccucccaccuggcguaccgcacgcggaacgcacuggauaaccuuguuaugcuucauaccagcgagcacggcgggcgcgccuaccggcacgccgucgaggagcuaccggaaaccauggagaccuuacuucugcucggacuuaugaucuuacucaccgguggggccaugcuguuccugaucucugguaaggguaucggcaagaccuccauaggucugauaugcgugaucgugagcagcggcaugcuuuggauggcggacgucccccugcaguggauugccagcgcaaucgugcucgaguucuuuaugauggugcugcugauccccgagcccgaaaaacaacgcacaccccaggacaaccaauuagccuacguugugauagggauccugacccucgccgcgaucguggccgcaaacgagaugggccuccuugagacgacgaaacgggaucuggggaugaguaaggaacccggggucgugagccccaccuccuaccucgacguggaccugcaucccgccagcgccuggacccuguacgcggucgcuacuacugugaucaccccuaugcuccgccacacgaucgagaacaguacggccaacgugagccuggccgcgauugccaaccaggcagucgugcugaugggccucgacaagggguggcccaucuccaaaauggaucugggcgugccccugcucgcccugggauguuacucucaggucaacccccugaccuuaacugccgcggugcuguuacucguaacccacuacgccaucaucggcccgggccugcaagccaaggcuacgcgugaggcccagaaaaggacagcggccggaaucaugaaaaacccuaccgucgacggcauuaugaccaucgacuuggaccccgugauuuaugacuccaaguucgagaaacaacucggccaggucaugcugcugguacucugugccgugcagcugcuccucaugcggaccagcugggcacuaugcgaggcccugacucucgcgaccggccccauuaccacgcugugggagggcuccccggggaaauuuuggaacacaaccaucgccgugagcauggccaacaucuuccgcggcuccuaccuggccggggcgggccucgccuucucgauuaugaaguccguaggcaccggccggcgcggcacggggagccagggugagacccugggggagaaguggaaaaagaagcugaaccagcucagccggaaggaguucgaccuauacaagaaguccgguaucacagagguggaccgaaccgaggcaaaagaggggcugaagcgcggcgaaacaacgcaccacgccgugagccgcggcuccgccaaacuccagugguuugucgagcggaacaugguaauaccugaagggcgcgugaucgacuuagggugcgggcgcggaggguggucguacuacugcgcuggccugaagaaggucaccgaggugcggggcuacaccaaaggcggccccgggcacgaggagccggugcccaugagcaccuacggauggaacuuagucaagcugaugagcgggaaggacguguucuaccugccgccggagaaaugcgauacccugcucugcgacaucggugaguccagccccuccccgacgguggaggagagccguaccauccggguccugaagaugguggagcccugguuaaagaacaaccaauucuguauuaagguacuaaaucccuauaugcccaccgucaucgagcaccuggagcgccugcagcggaaauacggcgggaugcucgugcgcaacccgcugucccggaauagcacucacgagauguauuggauauccaacggcacggggaacaucgucagcagugucaacauggugucgcgccuguuacugaaccgguucaccaugacccaccguagaccgacgaucgaaaaggaugucgaucuuggggccggcacgcgccaugugaaugccgagccagagacccccaacauggacguaaucggagagaggaucaagcgcaucaaagaggaacacucgagcacuuggcacuacgacgacgagaaccccuacaagacgugggccuaccacgggucguaugagguuaaggccacugggagcgccagcuccaugauuaacggcguggugaagcuccuaaccaagccaugggaugucgugccaaugguuacccagauggcaaugacagacacuacaccauucgggcagcagcgggucuuuaaggagaagguugacacccgaacgccccggcccaugccggguacccgcaaggugauggaaauaaccgccgaguggcuguggcggacccucggacgcaacaaaaagccgcguuuaugcacgcgggaggaguucaccaagaaaguccgcaccaacgcugcuaugggggcgguguuuaccgaggaaaaccagugggacagcgcccgggccgccguugaggaugaagaguucuggaagcuggucgauagggagcgggagcuccacaaacugggcaagugcgguucaugcguguacaacaugaugggcaagcgcgagaagaagcugggagaguucggcaaggcaaaggggagucgggccaucugguacauguggcucggcgcccguuaccuggaguuugaagcccugggcuuccucaacgaggaucacugguuuucgcgggagaauagcuacuccgguguggaaggcgaggggcugcacaagcucggcuacauccucagggauaucagcaagauuccgggaggcgccauguacgcggaugacacugccggcugggacaccagaaucaccgaggacgaccugcacaacgaagagaagaucacccagcagauggaccccgaacaccgccaguuggcuaaugccaucuucaaacuuacguaccagaacaaggucguuaagguccagcguccgaccccaaaggggacugucauggauaucauaucacgcaaagaucaacggggcagcggacagguggggaccuacggacugaauaccuuuacaaacauggaggcccaacuggugcgucagauggagggggaaggaguccuuuccaaagcagaucuggaaaacccacaccuccuugagaagaagauaacgcaguggcuggagaccaagggcguggagcgguugaagagaauggcaaucagcggcgacgauugcguggucaagccgaucgacgaccgguucgcaaacgcgcugcuggcccugaacgacaugggcaaggugcgcaaggauauaccccaguggcagccguccaaaggguggcacgauuggcaacaaguucccuuuuguagccaccacuuccacgagcugaucaugaaggacggacggaaacugguagugcccugccgcccccaggacgagcugaucgggcgcgcgcggaucagucaaggcgccgguuggagccucaaggagaccgcgugccugggcaaggcuuacgcccagauguggucccugauguacuuccaccgccgggaccuccgcuuagcgagcaacgccaucugcucggcggucccaguccacuggauccccacuucacggaccaccuggagcauccacgcccaccaccaguggaugacaacggaggacaugcugaccguguggaaccgcgucuggauugaggacaacccauggauggaggacaaaaccccugucaccacgugggaggacguaccguaccucggcaagcgagaggaccaguggugcgguucccuaauuggacugacgagccgcgccacaugggcccagaacauccucaccgccauccagcaaguccggucccugaucggggacgaggaguuccuggacuacaugcccagcaugaagcgguuccggaaggaggaggaaagcgagggcgccaucugguga

SEQ ID NO: 26107 - RNA, 9873 nt, Artificial Sequence
  derived and/or modified CDS sequence (opt11) from DENV-3__EU482462__SS-prME
accagccucugccugaugaugaugcuccccgcgacccuggccuuccaccucacgucccgggauggcgaaccacggaugaucgugggcaagaacgagcgcggcaaaagccugcuauuuaagaccgcgagcgggauuaacaugugcacccugauagccauggaccucggcgagaugugcgacgacaccguuaccuacaagugcccccugauagccgagguggagccugaggacauagacugcugguguaaccucaccagcaccugggugacauacgggacauguaaucaggccggcgaacaucgacgcgacaagcggucaguggcauuggcgccccacguggggaugggccuagauacccggacccagaccuggaugagcgcggaaggcgcuuggcgccagguggagaagguggagacgugggcacuccgccacccgggguucaccauccuggcgcuauuucucgcucacuacaucgguaccuccuuaacgcagaaggugguuauauucauccugcucaugcugguuacgcccagcaugacaaugaggugcgugggggucggcaaccgcgauuucgucgaaggccuaucuggugccaccuggguugacguagucuuggagcacggcgggugcgugaccacgauggcccgcaacaagccaacccuggacaucgagcugcagaaaacagaggccacccagcucgcgacgcuccggaaacuuugcaucgaggggaagaucaccaacaucaccacggacagccggugcccuacucagggcgaggccauccucccggaggagcaggaccagaauuacgugugcaagcauacuuaugucgaucgcggguggggcaacgggugcggccuguucgggaaaggcucgcugguuacuugcgccaaguuucagugccucgagccaauagagggcaaggugguacaguacgagaaccugaaauacaccguaaucaucacgguacacaccggagaccagcaccaggucgguaacgauacccaaggggugaccguagagauaacaccccaggccucaaccguggaggccgugcugcccgaguaugggaccuugggguuagagugcuccccgcggaccggccuggacuuuaacgagaugauucuccugaccaugaaaaacaaagcguggaugguccaccgccagugguucuuugaccuccccuugccuuggacauccggcgccacgaccgagacccccacguggaaccguaaggaacuacuggucaccuucaagaaugcgcacgccaaaaagcaggagguggucgugcucgggucccaggagggcgcuaugcacaccgcgcuuacaggggccacggaaauccagaacucgggcggaaccuccauuuucgccggccaccugaagugccgccucaagauggacaagcuggagcugaagggcaugucguacgcgaugugccuaaacacguucguucuaaagaaggaggucagcgaaacgcagcacggaacgauccugaucaagguagaguacaaaggugaggacgccccgugcaaaaucccguucagcacugaggacggucaaggcaaggcacacaacggccggcugaucaccgccaaccccgucgucacgaagaaagaggagccagugaacaucgaggccgagccgcccuuuggggagaguaauaucguuaucgggaucggggacaaggcccuuaagaucaacugguacaagaaaggcaguagcauaggaaaaauguucgaggcgacggcccguggcgcccggcgcauggcaaucuuaggcgacaccgccugggauuucggguccgucggcgggguccugaacagccucggcaagauggugcaccagauuuucggaucugcguacacggcccuguucagcggcgucuccuggaucaugaagauuggaaucgguguccugcucaccuggaucggcuugaacucgaagaauacgucaaugagcuucaguugcaucgugauagguaucaucacacuuuaccuaggcgcagucgugcaggcagacauggggugcgccauuaacuggaagggcaaggagcugaagugcggcagcggaaucuucgugaccaacgaggugcauacuuggacggagcaguauaaguuccaggcggacucccccaagcgccuggccacugcuaucgcgggcgccugggagaacggggugugcgguauucggagcaccacccgcauggaaaaccuacuguggaaacagaucgcuaaugagcugaacuauaucuugugggagaacaacaucaagcugacaguggucgugggggacaucaucggcgugcucgagcagggcaagcggacccucacgccccaaccgauggacuuaaaauacuccuggaagacgugggggaaggcgaagaucgugacggccgagacccagaacagcuccuucaucaucgacgguccuaacacccccgaaugccccuccgcgucccgcgccuggaaugugugggaaguggaggacuacggguucgggguauucaccacgaauaucuggcugaaacuccgggagguguacacccagagcugcgaccaccgccugaugagcgccgccaucaaggacgagcgggcggugcacgccgacaugggcuacuggaucgagagccagaagaaugggagcuggaaguuggaaaaggcguccuuuauugaagugaagaccuguaccuggccgaaaagccacacccuguggucgaacggugugcuggagagcgacaugaucauccccaagagccuggccgggcccauuagccagcauaaccaccgcccgggcuaccacacccagaccgcgggccccuggcaucucggaaaacuggagcuggacuucaauuauugcgaaggcaccaccgugguaauaaccgaaaacugcggcacgaggggccccuccuugcgcacaaccacgguaagcgggaaacugauccacgaguggugcugccgguccugcaccuuaccaccgcuccgcuauaugggcgaagacggguguugguacggaauggagauacgacccaucaacgaaaaagaggagaacauggucaagagccuggucuccgccggaagcggaaaaguggauaauuucaccaugggggugcugugcuuggccauccuguucgaggaggucaugcgggggaaguucggcaagaagcacaugauugcgggggugcuguuuaccuuuguucuccugcugagugggcaaauaacguggaaggacauggcgcauacuuuuaucaugauuggcagcaaugccuccgaccggauggguaugggcgucaccuaccucgcgcugauagccaccuucaagauccagcccuuccuugcgcuaggguucuuccuccgcaagcugacgagccgagagaaucucuugcugggggucggacucgcgauggcgacaaccuugcaauuaccagaggacaucgagcagauggccaaugggaucgcgcucggccugaugacauugaaguuaaucacgcaguuugagaccuaucaacuguggacggccuuagugucguuaacauguagcaauacuauuuucacccucaccgucgccuggcgcaccgccacguuaguucuugccggugucagccugcugccucucugccagucgagcaguaugcgaaagaccgacuggcuccccaugaccguggcggcuaugggcgugccgcccuugccccuauucaucuucucucuaaaggacacaccuaagcgcagauccuggccucugaacgagggcgugauggccgucggccuugugagcauccuggcuucaucacuccuccggaacgacgucccaauggccggcccacuuguggccgggggccuucuaaucgcaugcuacguaaucaccgggaccuccgccgaucugaccgucgagaaggccgccgacgugaccugggaggaggaggcugagcagacugggguuagccauaaccuaaugaucaccguugacgacgacggcaccaugcgcaucaaggacgacgagaccgagaauauucuaacgguucuucugaagaccgcauuacuuaucguguccgggaucuuucccuacuccauacccgccacacugcucguuuggcacacguggcaaaagcagacccagcgguccggggugcugugggacguccccagucccccugagacccagaaggccgaacuggaagagggggucuacaggaucaagcagcaaggcaucuucgggaagacccaagugggcgucgggguccagaaggagggcguguuccauaccauguggcacgucaccagaggggccguccucacucacaacgggaagcgccuggagcccaacugggcguccgucaagaaggaccuuaucagcuacggugggggauggcggcucucggcacaguggcagaaaggggaggagguacaggucauagccguggagcccgggaaaaacccgaagaacuuccagacgaugcccggcaucuuccagaccaccacgggggaaauaggcgccauugcguuggacuucaaacccgggacaucuggcaguccaauuauuaacagggaagguaagguggucggacuguacggcaacggcguggucaccaaaaacggcggcuacgucuccgggaucgcccagaccaacgcggagcccgacggcccuacgcccgaacuagaggaggagauguucaagaaacggaaccucaccaucauggaccugcacccugggucaggcaagaccagaaaguaccuucccgccaucguccgagaggccaucaagaggagacucagaacccuuauccuggcacccacgcggguugucgccgccgagauggaggaggcccucaaggggcugcccauccguuaccagaccaccgccaccaaauccgagcacacgggccgggagaucguagaccugaugugccaugcgaccuucaccaugcgccuucugaguccgguacggguccccaacuacaaucugaucauuauggacgaggcucacuuuaccgaccccgccuccauagccgcccgcggguacaucagcacgcggguaggcaugggcgaggcggccgccaucuucaugaccgcuacgccaccuggaaccgcggaggcguucccccaguccaacgcuccgauacaggacgaggagcgcgauaucccugagcgcagcuggaacuccgggaacgaguggaucacggacuucguuggcaaaaccgucugguucgugccgagcauuaaggccggcaacgacaucgcaaacugucuccguaagaacggaaagaagguaauucagcucucccgcaaaacguucgacacggaauaucagaagacgcggcuuaacgacugggacuucguagugaccaccgacauaagcgaaaugggcgcgaauuuuaaagccgaccgcguaauugacccccggcgcugccucaaaccggucauccuuacugacggccccgagagaguuauacucgccgggccgaugccggucacggcugccagugcggcacagcgccguggccgcgucgggcgaaacccucagaaggagaaugaccaguacaucuucacgggccagccucucaacaacgacgaagaccacgcccacuggaccgaagccaagaugcugcuggacaacaucaauacccccgaggggaucauccccgcccucuucgaacccgagcgcgagaaaagugcggcgaucgacggugaguaccggcuaaagggggaaucccgcaagaccuuuguggagcugaugcgucgcggggaccuccccguauggcuggcccacaaggucgccagcgagggcaucaaguacaccgaccggaaauggugcuucgauggggaacggaacaaccagaucuuggaggagaacauggauguggagauauggaccaaggagggcgaacggaagaagcuaagaccgcguuggcuggacgcgcggaccuacuccgacccccuggcccucaaggaguuuaaggauuucgcggcgggacgcaagagcauugcacuggaccuggucaccgagauugggcgggugccuucccaccucgcguauaggacgcggaacgcccuugacaaucuggugauguugcacacgagcgagcacggagggcgcgcauaccggcacgccgucgaggagcugccggagacaauggagacccugcuacuguugggccuuaugauccuguugaccggcggggccaugcuguuucugauuagcgggaaggggaucggcaaaaccuccauuggguuaaucugcgucauugugagcuccggcaugcuguggauggcggacgucccgcuccaguggaucgcuucugccaucguacuggaguucuucaugauggugcuccuaauucccgagcccgagaaacaaagaacaccccaggauaaucagcucgccuacgucgugauuggaauauuaaccuuagccgcgauagucgcagccaacgagaugggccugcuugagacgacaaagcgggaccuaggcaugaguaaggagccgggggucgugagcccaaccuccuaccuggacgucgaccuucaccccgccucagccuggacccuguacgcgguagcaacgaccgugaucaccccgaugcugcgccacaccaucgaaaacuccacagccaacgugagcuuagccgcuaucgccaaucaagccguagugcucauggggcuggauaaaggguggcccauuucaaagauggaccugggcgugccgcugcuggcucuagggugcuauagccaggucaacccccugacacugacggccgcggugcuccuccugguaacccacuaugcuaucaucggcccgggccuccaggccaaggccacgcgggaggcccagaagaggaccgcggccgggaucaugaagaaccccacagucgacgguaucaugacgaucgaccuggaucccgugauauacgauucgaaguucgagaagcagcugggccaaguaaugcuucuagucuuaugcgccguccaacugcugcugaugagaacgucuugggcccugugcgaagcccugacccuggccaccggucccauaaccacacucugggagggcucuccggggaaguucuggaacaccaccaucgccgugucaauggccaacauauuccgcggcuccuaccucgccggggcgggcuuagccuucucgaucaugaaguccgucgggacaggucggcgcggcacggggagccagggcgaaacccugggggagaaguggaagaagaagcugaaucagcugucucggaaagaguuugaccucuauaagaaguccggcaucaccgagguggaccgcaccgaggccaaggaggggcuuaagaggggagaaaccacccaucacgccguaagccgcggcucugccaagcugcagugguucguagaacggaauauggucauccccgaggggagggugaucgaccucgguugcgggcgcggaggguggagcuauuacugcgcgggccuuaagaaggucaccgaagugcggggguacaccaaagggggccccgggcacgaggaaccggugccuauguccacuuacggguggaacaucgucaagcugaugucggggaaggauguauuuuaccugccgcccgagaagugcgauacgcuacucugcgacauuggcgaguccucaccuuccccgacaguggaggagagccgcaccaucaggguccugaagaugguggaacccuggcucaaaaacaaccaguuuugcaucaaggugcugaaccccuacaugccuaccgucauugagcaucuggagcgccuccagcgcaaguauggagggaugcuggugcgcaacccgcugucccggaacucuacgcacgaaauguacuggaucucgaacggcacagggaacaucguguccuccgucaacaugguguccaggcuccugcugaauagauuuaccaugacccacaggcgcccuacaaucgagaaggacgucgaccucggcgccggcacccgucacgugaacgccgagcccgaaacuccgaacauggacgugaucggugagcgaaucaaacgcaucaaggaggagcacaguucgacguggcacuacgacgacgagaaccccuacaagacgugggccuaucacgguuccuaugaaguaaaggccaccgggucugcgucuuccaugaucaauggcguggugaagcugcuaacuaaacccugggacgucgucccaauggugacccagauggcgaugacggacaccaccccguucggacaacagcguguuuucaaggagaagguggauacccggacccccagacccaugcccgguacccgcaaggugauggaaauaaccgcugaguggcucuggcggacccugggcagaaacaagaagccacgacuuugcacgcgggaggaguucacgaagaaggucagaacgaacgcggccaugggggcgguuuucacggaagagaaccagugggacagcgccagagccgccguggaggacgaagaguuuuggaaguuagucgaucgcgagcgcgaacugcacaagcugggcaagugcggguccugcguauauaacaugaugggcaagcgcgagaagaagcugggagaguuugguaaagcaaaaggaagccgagcaaucugguauauguggcugggugcccgcuaccuugaguucgaggccuuaggauuucugaaugaggaccacugguucucucgggagaacagcuauuccggcguggagggcgaggggcugcacaagcugggcuauauacugcgcgacaucagcaagauacccgguggggccauguacgcggaugacacugcugggugggacaccagaaucaccgaggacgaucugcauaacgaggagaaaaucacccagcagauggaccccgagcaccgccagcucgcaaacgcgaucuucaaacuuacguaccaaaacaaggucgugaagguucaacggcccacgccuaaggggacggucauggacauaauaucccgcaaggaccaacgggguagcggccaaguggguacauacggccuaaauaccuucaccaacauggaggcccagcucgucaggcaaauggaaggggaggggguucuguccaaggcggacuuagagaacccccaccuacuggaaaagaagauaacucaauggcuggaaacaaagggaguugagcggcucaaacgcauggcaaucagcggcgacgacugcguggucaaacccaucgacgaccgguuugccaacgcccugcuggccuuaaacgacauggggaaggugagaaaggacauaccccaguggcaaccguccaagggguggcacgauuggcagcagguccccuucugcagccaccacuuccacgagcugaucaugaaggacggccggaagcuggucgugcccugccgcccccaagacgagcucaucgggcgcgcucggaucucccaaggcgccggguggagccucaaggagacagcaugccugggcaaggccuacgcccagauguggucacugauguauuuccaccgccgggaccugcgcuuggccucuaacgccaucugcuccgccgucccgguccacuggauccccaucagccggacuacauggucuauccacgcacaucaccaguggaugaccacagaggacaugcucacaguguggaacagaguguggaucgaggacaacccguggauggaggacaaaacgcccgucaccaccugggaggacgugccguaucucggaaagcgugaggaccaguggugcgggucccugaucggccucacgagccgcgcgaccugggcccagaauauccugacagccauccagcaaguucggucccuuaucggggacgaggaguuccuugacuauaugcccucgaugaaacgcuuccggaaggaggaagaauccgagggcgccaucugguga

SEQ ID NO: 26108 - RNA, 9873 nt, Artificial Sequence
  derived and/or modified CDS sequence (opt11) from DENV-3__EU660407__SS-prME
accucccugugccucaugaugaugcuccccgccacuuuggccuuccaccucacuagccgggauggagagccgcguaugaucgucgggaaaaacgaaaggggcaagagccuccuguuuaaaacggcgucugggaucaacaugugcacccugaucgccauggaccucggcgagaugugcgacgacaccgugacguacaaaugcccccugaucgccgagguggagccugaggacaucgacugcuggugcaauuugaccagcaccugggugaccuaugggaccugcaaccaagccggcgagcaucgacgggacaagcgguccgucgccuuagcgccccacgugggcaugggccuggacacccgcacgcaaaccuggaugagcgccgagggcgccuggcgccagguggagaaagucgagacuugggcccuccggcacccgggguucacuauucuggcguuauucuuggcccacuacaucgggacaagccugacccaaaagguggugaucuucauucuguuaauguuagucacgcccagcaugaccaugcggugcgucgggguggguaaucgcgauuucgucgagggcuuguccggcgccacauggguggacguuguucucgagcacggcgggugcguuaccacgauggccaagaacaagcccacccuggacaucgagcuccaaaagacugaggccacccaguuagcgacacuucgaaagcuguguaucgagggcaagaucaccaacaucaccaccgacucucgcugccccacgcagggcgaagccauucucccggaggaacaagaccagaacuacguaugcaagcacaccuacgucgaucggggcuggggcaacgggugcggccuguuugguaagggcucgcuggugaccugcgcgaaauuucagugccucgagcccauugagggcaaagugguccaguacgagaaccugaaguauaccgucaucaucacggugcacaccggggaccagcaccagguaggcaaugacacccagggggugaccguggagaucacgccccaagccuccacaguagaagccgugcugcccgaguacgggacacucgggcuggagugcuccccgcgcacuggccuggacuucaacgagaugauccuccuaacgaugaagaauaaggcuuggaugguccaccgucagugguucuucgaccugccccucccauggaccagcggcgccaccaccgagacccccacguggaaucgcaaggaacugcucgugaccuucaagaacgcccacgccaagaagcaggaggucguugugcucgggucccaggagggcgccaugcacacagcccugaccggggccacggagauccagaauagcggcgggacaucaaucuucgccgggcaccugaaaugccggcucaagauggacaaguuagagcugaaggggaugagcuacgcgaugugccucaacaccuucgugcugaagaaggaaguaucagagacccaacacgggacaauccugaucaagguggaauacaagggagaagacgccccgugcaaaauuccuuucagcacagaagacgggcaggguaaggcgcacaacggccgccugaucacggccaaccccguggucacuaaaaaggaggaacccgugaauaucgaggccgagccgcccuucggugagagcaauaucgugaucggcaucggggacaaagcgcucaagaucaacugguacaagaagggauccaguaucgguaagauguucgaggcgacggcccggggugcccgccggauggccauccucggcgacaccgccugggacuucgggagugucggaggggugcucaacagccucggcaagauggugcaccaaaucuucggauccgccuacacggcccuguucagcggagucuccuggaucaugaagauuggaauuggggugcugcuuaccuggaucggucugaacucgaagaacacgucaaugucuuucuccugcaucgugaucggcauuaucacccuguaucucggcgccgucgugcaggccgauauggggugcgucaucaacuggaaggggaaagagcugaagugugguagcgguaucuuugucaccaacgagguacauaccuggacggagcaguacaaauuucaggccgacagucccaagcgccuggccacggcuaucgcaggcgccugggagaacgggguguguggcauccgcucuaccacccggauggagaaccuccuguggaagcagaucgcgaacgagcugaacuacauccugugggagaacaauaucaaacugacugucguggugggggauaucauuggcguccuggagcagggcaagcgcacccuaaccccacagccgauggagcugaaguacucuuggaagacaugggggaaggcgaagaucguaacggccgaaacccagaacagcagcuucaucaucgauggcccaaacacgcccgaguguccaucagccucccgggccuggaacgugugggaaguugaggacuacggguucgguguguuuacgaccaacaucuggcugaaacuccgcgaaguuuauacccagagcugcgaucaccggcucaugagcgcggccaucaaagaugagcgcgccguccacgccgacaugggauacuggaucgagagucagaaaaacgggagcuggaagcuggagaaggcuuccuucauugaaguaaagacaugcacauggccgaaaucgcacacccucugguccaacggcguucuggagaacgacaugaucauccccaagagccuggcggggcccaucucccagcacaaccaccgcccgggauaccauacucagacagccgggcccuggcaucucggaaagcuggagcuggacuuuaacuauugcgaaggcaccacagucgucaucaccgagaacugcggaacccggggccccucgcuuaggaccaccacggugagcgggaagcugauccacgaguggugcugccgcagcugcacccugcccccgcuacgguacaugggcgaggacgggugcugguacgguauggagaucagacccaucaacgagaaggaagagaacauggucaagucccugguguccgccggauccgggaaaguggacaacuucacgaugggaguccugugccucgccauccuguucgaagagguaaugcgggggaaauuuggcaagaagcauaugaucgccgggguacucuucacuuuuguccuucugcucaguggccagauaacguggcgcgacauggcgcacacccugaucaugauaggcuccaacgcaagcgaccguaugggaaugggaguaacguaccuggccuuaaucgccacauucaaaauccagcccuuccucgcccugggguucuuccuucgcaagcucacgucccgggagaaccuccugcucggcgugggucuggcgauggccaccacccugcagcuccccgaggacauugagcagauggccaacggaauagccuuaggccugaugacccucaagcugaucacgcaguucgagacauaccagcuguggaccgcgcucguaucgcugaccugcuccaacacgaucuucacacuaaccguggcauggaggaccgccacgcucauccuggccggcgucucccuucucccacuaugccagagcuccagcaugagaaagacagacuggcugcccaugacaguggcggcgaugggcgugccaccccucccacuguucaucuucucccugaaggacacccccaaacgccgcagcuggccccucaacgaggguguuauggcgguugggcugguguccauccuggccagcucccuccugaggaacgauguccccauggcaggaccucugguugccggcgguuuacugaucgcaugcuacguaaucacggggaccagcgccgaccugaccgucgagaaggccgccgacgucacgugggaggaagaggccgagcagacgggcgugucccacaaccucaugaucaccguugaugacgacgggaccaugcgcauaaaagacgaugagaccgagaauauccuaacagugcugcucaagacggcuuuacuaauagugagcggcaucuuccccuacuccauucccgccaccuuacuggucuggcacaccuggcagaagcaaacccagagaagcggcgugcugugggacgugccuuccccucccgagacgcagaaggccgagcucgaggagggugucuaccgcaucaaacagcagggcaucuucgggaaaacccaggugggcguggguguccagaaagaaggcguauuccacaccauguggcauguaacuagaggggccguccugacgcacaacgguaagcgccuggagccgaacugggcuagcgugaagaaggaccucaucuccuauggcgggggcuggcgucugagcgcccaauggcagaagggggaggaagugcaaguuauugccgucgagccaggcaagaaucccaagaacuuccagaccaugccaggcaucuuccagaccacgacgggggagaucggcgcgaucgcccuggacuucaagcccgggaccuccggcagcccuaucaucaauagggagggcaaggucgucgggcuguacggcaacgggguggugaccaagaacggcggguaugugucggguauugcacagaccaacgccgagccagauggccccacaccagagcuugaggaagaaauguucaagaagcggaaccuuaccaucauggacuugcauccgggguccggcaagaccagaaaguaccuccccgccaucgugcgggaggccaucaagcgccgguugcggacgcuaauccucgcccccacacggguggucgcggcugagauggaggaggcccugaaaggacugcccauccguuaccaaaccaccgccaccaagagcgagcauacgggccgagaaauagucgaucuuaugugccaugccaccuucaccaugcgccugcugagcccgguacgcguccccaacuauaaccucauaauuauggacgaggcgcacuucaccgaccccgccagcaucgccgcccguggguacauuucgacacgggugggaaugggagaggccgcggcaaucuucaugaccgccacgccucccgggaccgcggaggcguucccccagucuaacgcccccauccaggacgaggaacgcgacaucccagagcgcucuuggaacucuggcaaugaauggaucacggacuucguggggaagaccgucugguucgugcccuccaucaaggcgggcaacgacaucgccaacugcuuacggaagaacggcaagaaaguuauccagcuaucucgcaaaaccuucgacaccgaguaucagaaaacuaaacuuaacgacugggacuuuguuguaaccacugacaucuccgagaugggcgcuaauuucaaggcggaucgggugaucgacccacgcagaugccugaaacccgucauccuaaccgacggcccggagcgcgugauucucgcugggccgaugcccgugacggccgccagcgcugcgcaacggagaggccgggucgggcgcaacccccagaaggaaaacgaccaauauaucuuuaccggccagccccuaaacaacgacgaggaccacgcccacuggaccgaggccaagauguugcucgacaacaucaacaccccggaggggaucaucccggcucuguucgagccugagcgggagaaguccgcggcgaucgauggcgaguaucgacugaaaggcgagagccggaagaccuucguggagcugaugagacgcggggaccugcccgucuggcuagcucacaaaguggccuccgagggcaucaaauauacggaccgcaaguggugcuuugacggggagcggaacaaccagauacucgaagagaacauggacguggaaaucuggaccaaagaaggggagaggaagaaacuucggccgcgcuggcuggacgcccgcacauacagcgacccgcucgcucugaaggaguucaaggauuucgcugccgggcggaaguccaucgcccuggaccucgugaccgagaucggcagaguccccagccaccuggccuacagaacccgcaacgcguuggacaaccucgugaugcugcauaccuccgagcacggagggcgggccuaucgccacgcugucgaggaacuuccugagaccauggagacccuccuccugcucggccugaugauuuuacucacgggaggcgccaugcuguuccucaucagcgggaagggcaucggcaagaccucgaucggcuugaucugcgugaucguaagcaguggcaugcuguggauggccgacguaccgcugcaguggaucgcguccgccaucgugcuugaguucuucaugauggugcugcugauccccgagccagagaagcagcgcaccccucaagauaaccagcucgccuacgucgugaucgggauccugacccuagccgcuaucguggccgccaaugagaugggacuccuggagacgaccaagcgcgaccuggguaugagcaaggaaccugggguaguuaguccgacgucauaucuggauguggacuuacaucccgcguccgccuggacccuguacgcuguugcgacgaccgugaucaccccaaugcuccggcacaccauugagaauaguacggccaacgugucacuggccgccaucgcgaaccaggcuguggugcugaugggcuuggacaagggguggcccaucucaaaaauggaccuaggcguuccccuccucgcccuggguugcuauucccaggucaauccccugaccuuaaccgccgccgugcugcuguuagugacccauuacgcgaucaucgguccgggccugcaggccaaggccacgcgcgaggcccagaagcggacagcugcgggaaucaugaagaauccaacuguugaugguauaaugacaaucgaucuagaccccgugaucuaugacagcaaguucgagaagcaguugggccaggugaugcugcugguccucugcgccgugcagcugcugcucaugcgcaccuccugggcccugugcgaggcccugacguuagccacuggcccuaucaccacgcugugggagggcagcccggggaaauucuggaacaccaccaucgcgguauccauggccaacaucuuccgggggagcuaccuggcuggugccggccucgcauucuccauuaugaaguccgucgggaccgguagacgggggacggggucccagggcgagacccugggcgagaaguggaagaagaaacuuaaccagcucagccgcaaggaguucgaccuguauaagaaguccggcaucaccgagguggaccggacagaagccaaggaggggcugaagaggggugaaaccacgcaccacgcugugucccguggcuccgccaagcuccagugguuugucgagagaaacauggugauccccgaggggcgggugaucgaccuagggugcgggcgcggagggugguccuacuacugcgccggacugaagcgcgucaccgagguacggggcuacacuaagggcggacccgggcacgaggagccagugccgaugucaaccuacggcuggaacaucgucaagcucaugagcgguaaggacguauucuaccugcccccggagaagugcgauacgcuacuuugcgauauaggcgagaguucccccagcccgaccguggaagagucccgcaccauccguguccucaaaaugguagagcccuggcugaagaacaaccaguucugcaucaaggugcugaaccccuacaugcccacggucaucgagcaccucgagcgccugcagaggaaauacggcggcaugcuggugcgcaacccgcucagccguaacucgacgcaugagauguacuggauuagcaacggcaccgggaacaucgugagcagcgucaauauggugucccgccuguuauuaaaucgguuuaccaugacccaccgccggcccacgaucgagaaggacguugaccugggagcgggcacacgccaugugaacgccgagcccgaaacccccaauauggaugugauaggggagcggaucaagcgcaucaaggaggagcacagcuccaccuggcacuacgacgaugagaacccguacaaaacgugggccuaccacggcagcuacgaggucaaagccacaggguccgccagcagcaugauuaacggcguggucaagcuguugaccaagcccugggaugucgugcccaugguaacccagauggcgaugacggacaccacccccuucggacaacagcgggucuucaaggagaagguggauacccgcacgccgaggcccaugcccggcacucgcaaggugauggagaucaccgcagaauggcuguggcggacccucggccgcaacaagaagccgaggcuaugcacgcgugaggaguucaccaagaagguccgcacgaaugcagccaugggcgccguguucaccgaggagaaccagugggauucugcgcgggccgcgguggaagacgaggaguucuggaaacugguggaccgcgagcgggagcugcacaagcucggcaagugugggagcugcguguacaauaugaugggcaaaagggagaagaaacugggugaguucggcaaggcuaagggcucccgggccaucugguacauguggcucggggccagauaccucgaguucgaggcucugggcuuccugaacgaagaucacugguuuagccgggagaacagcuauagcgggguagagggcgaggggcuccacaagcuaggcuacaucuuacgggacauuucaaaaaucccuggcggggcgauguacgccgacgacacggcgggcugggauacucggaucaccgaggacgacuugcacaacgaggagaaaauuacgcagcagauggaccccgagcaucgccaacuggccaacgccaucuuuaagcugacguaccagaauaaggucgugaaggugcagcggcccaccccgaaagggaccgucauggacaucaucagccgcaaggaccagcggggcuccggacagguugggaccuauggacucaacaccuucaccaacauggaggcucagcuggugcgccaaauggagggggagggcguccugagcaaggccgaccucgagaacccucaccuccuagagaaaaagaucacgcaguggcuugagaccaagggcguggagcgguuaaagcgcauggcgaucucaggcgaugacugcguagucaagcccaucgacgaucgauucgccaacgcccugcucgcccugaacgacauggggaaggugaggaaggacaucccccaguggcagccgagcaagggguggcacgacuggcagcagguucccuucugcucucaucauuuccacgaacuaaucaugaaggacggccggaagcucgucgugcccugucgcccccaggacgagcugauugggcgcgccagaaucagccagggcgcaggguggagcuuaaaggagacggcuugcuuaggcaaggcuuacgcccagauguggucgcugauguacuuucaccgccgggaccugcgacucgcguccaacgcgaucugcagcgccgugccagugcacuggauucccacgucccggacuacuuggagcauccaugcgcaccaccaguggaugacaaccgaagacauguuaaccguguggaaucgaguguggaucgaggacaaucccuggauggaagauaaaaccccggucaccacgugggaggacgugcccuaccugggcaagcgggaagaccaguggugcgguagccucauaggccugacaucacgcgcuaccugggcgcagaauauucugaccgccauccagcaaguccggagccucaucggggacgaggaguuccuggacuacaugcccagcaugaaacgcuuccgcaaagaggaggagagcgaaggcgccauaugguga

SEQ ID NO: 26109 - RNA, 9873 nt, Artificial Sequence
  derived and/or modified CDS sequence (opt11) from DENV-3__EU660409__SS-prME
accagccugugccucaugaugaugcugcccgccacccuggccuuccaucucaccagccgggacggcgagccccggaugauaguggggaaaaaugagcggggcaagucauugcuguuuaagaccgcgucggggauuaacaugugcacccugaucgcuauggaccugggcgagaugugugacgacaccgugaccuacaaaugcccauuaauagccgagguggagccugaggacauagauugcugguguaaccuuacuagcaccugggugacauacgggacguguaaccaggcaggcgagcacagacgugacaaacgguccgucgcccuggcgccccacgugggcauggggcuggacacccggacacagacguggaugucggcagagggcgccuggcgccaaguggagaaggucgagacgugggcccuccgucaucccggguucaccauccuggcgcuguuccucgcgcacuacaucgggaccucccugacccagaagguggugaucuucauccugcucaugcuggucacgcccagcaugaccaugcgguguguaggggugggcaaucgcgacuuugucgaaggcuuaucuggugcaaccuggguggacgugguacucgagcacggcgggugcgugacgacgauggccaagaacaagccuacgcuggacaucgagcugcagaagaccgaggccacccggcucgcgacgcugcggaagcugugcaucgagggcaaaauuacaaacaucaccaccgacagccgaugucccacgcagggcgaggccauccucccggaagaacaggaccaaaacuacgugugcaagcacaccuacgucgaccgaggguggggcaacgggugcggccuguucgggaaggguuccuuggugaccugcgcgaaguuucagugccuugagcugauugagggcaaagugguccaguacgagaaccugaaguacaccgugaucaucacggugcacaccggggaucagcaccagguaggcaacgacacccagggcgcaaccguggagaucacgccccaggccucuaccgucgaggcggugcuccccgaguacggcacccuggggcuggagugcagcccgcggaccggccucgacuucaacgagaugauucugcugaccaugaagaacaaggccuggaugguccaccgucagugguucuuugaccucccgcugcccuggacgagcggcgccaccaccgagacacccaccuggaaucggaaggaacugcucgucaccuucaagaacgcccaugcuaagaaacaggaggucguaguccuggggucccaggagggcgcgaugcacaccgcacugaccggggccacggagauccaaaacucaggcgggacgaguaucuucgccggccaccucaagugcaggcugaagauggacaagcucgagcucaaaggcaugucguacgccaugugccugaacaccuucgugcugaagaaggagguguccgagacccagcacgggacgauccugauuaaggucgaguacaagggcgaagacgcgcccugcaagauaccguucagcaccgaggacgggcagggcaaggcccacaacggccggcuuaucaccgccaaccccgucgugaccaagaaggaggaacccgugaauaucgaggcagagcccccguucggggagagcaacaucgugauuggcaucggggacaaggcgcugaaaaucaacugguacaagaagggcuccuccaucgggaagauguucgaagccacggcccgcggggcccggcgcauggccauucucggcgacaccgcgugggacuucggguccgucggcgggguccucaauagccugggcaagauggugcaccagaucuucggaucagccuacacugcccuguuuagcggcguuaguuggaucaugaagauuggcaucggggucuuacuuacguggaucggccugaauagcaaaaacacgagcaugagcuucuccugcauugcaaucgggauuaucaccuuauaccuuggcgccguggugcaggcggacauggggugcguuauaaacuggaagggcaaggagcugaagugcggcagcggcaucuuugucaccaacgagguacacaccuggacugagcaguacaaguuucaggccgacucacccaagcgcuuggcuaccgccaucgcaggcgcaugggagaacggugucugcggcauucggagcacaacccgcauggagaaccugcuguggaagcagaucgcgaacgagcucaacuacauccugugggagaacaacaucaagcucacgguaguggucggggacaucaucggcguacuugagcagggcaagcggacucuuacgccccagccaauggaacugaaguacucguggaagaccugggggaaggccaaaaucguaacggcagagacccagaacaguagcuucaucauagacggcccgaauacccccgagugcccgagcgccucccgcgccuggaacgucugggaaguggaggauuacggauucggcguguucaccacuaacaucuggcucaagcugcgcgaagucuacacacagagcugugaccaccgauugaugagcgcagccauaaaggacgagcgggccgugcacgcggauaugggcuacuggaucgagucucagaagaacgggucauggaaacuugagaaggccuccuucaucgaggugaagaccugcacguggcccaagagccacaccuuaugguccaacggggugcuggaaagcgacaugaucaucccgaagucccucgcugggcccaucagccagcacaaccaccgccccggcuaccauacgcagaccgccgggccguggcaucucggcaaguuggagcucgacuucaacuacugcgagggcaccaccguggugaucacggagaacugcgggacccggggccccucccugcgcaccacuacggucagcgggaagcugauccaugaauggugcugcagauccugcacccugccgccccuccgcuacaugggcgaggacgggugcugguacgggauggagauccggccgaucaaugagaaagaggagaacaugguaaagucccucguguccgcugggucugggaaggucgacaacuuuaccaugggcgcgcucugcuuggcuauacuguucgaagaggucaugcgcgggaaguucgguaagaaacacaugaucgccgggguucuguucaccuucguccugcuacugucuggccagaucacguggcgggacauggcccacacccugaucaugaucggcagcaaugccuccgaucgcauggguaugggcgugaccuaccuggcgcucauagccacguucaagauccagccauuccuggcccuuggauucuuccuccggaagcugacuagccgcgaaaaccugcuccugggcguggggcuggccauggcgaccacccugcaguuaccugaagacauagaacaaauggccaacggaaucgcauugggccucaugacccugaagcugaucacgcaguuugaaaccuaccaguuauggaccgcgcuggucagcuugaccugcuccaacacgaucuucacgcucaccgucgccuggcggacugcgacgcugauacuggccggggugagccuccugccccugugucagucgagcuccaugcgcaagacggacuggcucccgauggccgucgccgccaugggagugccgcccuugccccuguucauauucagccuaaaggacacacccaagcgccgguccuggcccuugaaugagggggucauggcggucggacuggugagcauccucgccuccagccugcugcgcaaugaugugcccauggccggcccccucguagccggagggcugcucaucgcuuguuacgugaucaccgggacguccgcggaccuaacugucgagaagguugcugacgugacaugggaggaggaggccgagcagaccggagucagccacaaccugaugaucacgguggacgacgaugggaccaugcggaucaaggacgacgagacggagaacaucuugaccgugcuccugaagaccgcccugcucaucgucucaggcauuuucccguacagcauucccgcaacgcugcucguguggcacaccuggcagaagcagacucagcgauccggugugcuuugggacguccccagcccgccggagacccagaaggcggagcucgaggaagggguguaccggauaaagcagcagggcaucuucgggaagacccaagugggcgucggggugcagaaggagggcguguuccacaccauguggcacguaacccguggugccguccuaacccacaacgggaaacggcuagagcccaacugggccuccgugaagaaggaccugauaagcuacggcgggggcuggcgccuguccgcccaguggcagaagggggaagagguacaggugauagcgguggagcccggcaaaaaccccaagaacuuccagacgaugcccggcaucuuccagaccacgaccggggagauuggcgcgaucgcccuggauuucaagccaggaaccagcggaagccccaucaucaaccgcgagggcaaggucgugggucucuacggcaacggggugguuaccaagaauggcggguacgugagcgggaucgcgcaaaccaacgccgagccggacggucccacgcccgaacuggaggaggagauguucaaaaagaggaaccuuacgaucauggaccuccaccccgggagcggcaagacccggaaguaucugccggcgauaguccgcgaagcuauaaaacggcgccugcggacccuaauccuggcccccacccgcgucguggccgccgagauggaggaggcgcugaagggucuccccauccgguaccagacgaccgccaccaaguccgagcacaccggucgcgagaucgucgaccugaugugccacgccacguucaccaugcggcuucucagcccgguccgcgugccgaacuacaaccugaucauaauggacgaggcccauuucaccgacccugccucgauugcggcuagggguuacaucagcaccagagucggcaugggcgaagccgccgcaauuuucaugacggcuacgccgcccgggaccgccgaagccuucccgcaguccaacgcccccauccaggacgaggaacgcgacaucccugagcggucguggaacucuggcaacgaauggaucacagacuucgucgggaagaccgugugguucguucccucgaucaaggcgggcaacgacauagccaacugcuuacgcaagaacgggaagaaggucauccagcucucccggaagacguucgacaccgaguaccagaagacccgucugaaugacugggacuucguggugacgaccgacauuucugagaugggugccaacuucaaggccgaucgcgucauagacccgcgccggugccugaagccggugauccucacagacgguccagagcgcgugauccuagcggggcccaugccagucacggcagccucugccgcccagaggcgcggccggguagggcgcaauccccagaaggagaacgaucaguacauuuucaccggccagccccugaacaacgacgaggaccacgcccacuggaccgaggcgaagaugcuccuggacaauaucaacacccccgaggggaucaucccugcacuguucgaacccgagcgggagaaguccgccgcuauagauggcgaguaccgauuaaagggcgaaucccggaagaccuucgucgagcugaugcgccgcggggaccugccugucuggcucgcucacaagguugcuagugaaggcaucaaguacaccgaccgcaaguggugcuuugauggggagcggaacaaccagauucuugaggagaacauggauguggagaucuggacgaaggagggagagcgcaaaaagcugcgcccccgguggcucgacgcccgcaccuacuccgacccgcuggcacugaaagaauuuaaggauuucgccgcgggccgcaaguccauugcccucgaccuggugaccgagaucgggagaguacccucccaccuggcguaccggacccgcaacgcccucgacaaccuggucaugcugcacacgagcgagcacggcgggcgugccuaccgccacgcuguggaggagcuuccugagacuauggagacacuucugcuccuggguuugaugauccuguuaaccgggggcgccaugcuguuccugaucagcggcaaagguaucggcaagacgucuaucgggcugaucugcgugaccgugaguuccggcaugcuguggauggccgacgugccccuccaguggaucgccagcgccaucgugcuggaguucuuuaugaugguccugcucauccccgagcccgagaaacagcggacgccccaagacaaccagcuggcguacguaguaaucgggauccugacccuggcagccaucgucgccgccaaugagaugggacugcuggaaaccacuaagcgcgaccucgggauguccaaggagccgggaguggugucaccgaccaguuaccuggacgucgaccugcaccccgcgagcgcguggacccucuacgcuguggccacgaccgugaucacccccauguuacggcacaccaucgagaacuccacggcgaacgucagccuagcagccaucgccaaucaagccguggugcucauggggcuggacaagggguggccgaucucgaaaauggaccugggugucccccuucuugcgcugggaugcuacagccaagugaacccccucacccugaccgcagcagugcugcuccucgucacccacuacgccaucauuggccccggccugcaggccaaagcgacgcgcgaggcccagaagcggaccgccgccgggauaaugaagaacccaacgguugacggcaucaugaccauugaccucgaccccgugauuuaugacuccaaguuugagaagcaguuagggcaggucaugcugcucguucugugcgcagugcagcugcucuugaugagaacgagcugggcgcugugcgaggcccucacacuggccaccgguccuaucaccacauuaugggagggcucccccgggaaguucuggaacaccaccaucgccgucagcauggcgaauaucuuccggggcucguacuuagccggcgccggccuggccuucucuaucaugaaaagcgugggcaccggccgccggggcacggggagccagggcgaaacccuuggggagaaguggaagaagaagcucaaccagcugucgcggaaggaguucgaccuguauaagaaauccggaauuaccgagguggaccggaccgaggccaaggaaggacucaagcgcggcgagacuacgcaccacgcggucagccggggauccgccaaacugcagugguucguggagcgcaacaugguaaucccggaggggcgcguuaucgaccugggcugcggacggggaggguggagcuacuacugugcgggacucaagaaaguaaccgaagugcgcggcuacaccaagggcgggcccgggcaugaggagcccguccccauguccaccuacggcuggaacaucgugaagcugaugagugggaaggacgucuucuaccugccgcccgagaaaugcgacacgcugcucugcgacaucggagaguccucucccucccccaccgucgaggagagccggaccauccgcgugcucaagaugguggagccguggcugaagaauaaccaauucuguaucaagguccucaaccccuauaugcccaccgugaucgagcaccuggagcgguuacaacggaaauacggcgggauguuagugcggaauccccugucccgcaacucgacgcacgagauguacuggauauccaacggaacagggaacaucguuagcuccguaaauauggugucccggcugcuguuaaacagguucaccaugacccaccggcgcccgacgaucgagaaggacgucgaucugggcgccggcacccggcaugugaacgccgaacccgagacccccaacauggacgucaucggcgagcgcaucaagaggaucaaagaggagcacuccagcacuuggcacuacgacgacgagaacccguacaagaccugggcguaccacggcuccuacgaggucaaggccacagggagcgccucauccaugaucaacggcgugguaaagcuccugaccaagcccugggacguggugccuauggucacccagauggccaugacggacaccacccccuucggacagcaacgcguguucaaagagaagguggauacaaggaccccgcgccccaugcccggcacccggaagguuauggagaucaccgcugaguggcuguggcgcacccucggccgcaauaagaagccacggcugugcacgagggaagaguuuaccaaaaaggugcggaccaacgcggccaugggggccguguucaccgaggagaaccaaugggauagcgcccgcgcggccgucgaggacgaggaguuuuggaaacugguggaccgggagcgcgaacuccauaaacugggcaagugcggcuccugcguguacaauaugaugggcaagcgcgagaagaagcugggcgaauuuggaaaggccaagggcagccgcgcgaucugguacauguggcucggugcccgguaccuggaguucgaggcgcugggcuuccucaacgaggaucacugguuuucccgcgaaaacagcuacuccggggucgagggugaggggcugcauaaacugggcuacauccugcgggacaucagcaagauaccaggcggggccauguaugccgacgacacugcuggcugggacacgcgcaucacagaggacgaccugcacaacgaggagaagaucacccagcagauggauccggagcaccggcagcuggccaacgcgaucuuuaagcugacguaccagaacaaggucgugaagguacagcgccccacgcccaaggggaccgugauggacaucaucagccggaaggaccagcgcggcucgggccaggugggcaccuauggccugaacaccuucacgaacauggaggcgcagcuaguccggcaaauggagggggagggcgugcucuccaaagccgaccuggagaacccgcaccuucuugagaagaaaauaacccaguggcuggaaaccaaggguguggagcgccugaagcgcauggccauaagcggcgacgauugcgucgugaagccuaucgacgaccgcuucgccaacgcgcuccuggcgcugaacgacauggggaaggugcggaaggacaucccacaguggcagcccuccaagggguggcacgauuggcagcaggucccguucugcagccaccacuuccaugagcucaucaugaaagacggacgcaagcugguggugcccugccgcccucaggacgagcugauugggcgggcccgcaucucgcagggcgccggguggucucuaaaggagaccgcuugccugggcaaggcguaugcccaaauguggucgcugauguacuuccaucggcgcgaucuccggcuggccagcaacgcuaucugcuccgcgguccccgugcacuggaucccgacgagccgcaccacguggagcauccacgcccaccaccaguggaugaccacggaggacaugcugaccguguggaaccgggucuggaucgaggacaaccccuggauggaggacaagacccccgugaccacgugggaagaugugcccuaccuaggcaagagagaggaccaguggugcggcuccuuaaucggccugaccagcagggcaacaugggcucagaacauccuaaccgcuauccagcaggucagaucccugaucggggacgaggaguuccuggauuacaugccgagcaugaagcgguucaggaaggaggaagaguccgagggcgcaauuugguga

SEQ ID NO: 26110 - RNA, 9873 nt, Artificial Sequence
  derived and/or modified CDS sequence (opt11) from DENV-3__EU660410__SS-prME
acgucacuaugccucaugaugauguuaccggcgacgcuagcuuuucaccuaacgagccgugacggggaaccaagaaugauagugggcaaaaaugaacgagggaaaucacuacucuuuaaaacggcuucaggcaucaacaugugcacgcuaauagcgauggaucucggcgaaaugugcgacgauacggucaccuacaagugcccccugaucgcagaaguagaacccgaagauauagacugcugguguaaccucacuucgacuuggguaacauaugguacgugcaaccaagcgggcgaacaccgaagagacaaacgcuccguggcccuagcuccucacgucgggauggggcucgacacccguacacaaacuuggaugagcgcagaaggggcauggaggcaggucgaaaagguagaaacaugggcccugcggcaucccggcuucacuauuuuggcacuauuccuggcgcacuauauugggacuagcuuaacacaaaaggucguaauuuucauacuccucaugcuagucacccccucuaugacuaugcggugugugggggucggaaaccgagacuucgucgaaggguuaagcggggcgacauggguagacgugguacuagaacauggcgguugcgucacaacgauggcacgcaauaagccaacucuagacauagaacuccagaaaacggaagcgacacaauuggcaacccuaaggaaacuguguauagaaggcaaaauaacuaacauaaccacugacagcagaugccccacgcaaggagaagcaaucuugcccgaagaacaagaccaaaauuauguauguaagcauacauacgucgacaggggguggggaaacggcuguggacucuucggaaaagggagccugguaacgugcgccaaguuccaaugccuagaaccaauugaaggcaagguuguacaauaugaaaaucuaaaguacacggucauaauaaccguacauacaggcgaucaacaccaaguaggaaacgacacccaaggagugaccguggaaaucacuccgcaggcgucaaccguggaagccgugcugccugaauacgguacccuaggccucgagugcagccccaggaccggccuagacuucaacgaaaugauccuauugacgaugaagaacaaggcuuggaugguacaccgacagugguucuucgaccucccacucccguggacgucgggggccacaacagaaacgccgaccuggaaucgaaaagagcuacuggucacguucaaaaacgcgcaugccaagaaacaagaggucguaguuuugggcucccaagagggagccaugcacaccgcccuuacgggagcaaccgaaauccaaaauagcggagggacgagcaucuucgcuggccacuugaaaugcagguuaaaaauggacaagcuagagcuuaaaggcaugagcuaugcuaugugucucaauacuuucgugcucaagaaagaagucucagagacacagcacggaacgauacugaucaaaguagaguacaaaggcgaggaugcacccugcaaaaucccuuucagcaccgaagacggccaagggaaggcacauaauggaagacuaauuacagcuaaccccguagucacuaagaaagaggagccuguaaacaucgaagcugagccacccuucggcgagagcaacauagucauagggauuggggacaaggcccugaagaucaauugguacaagaaggggucguccauagggaaaauguucgaagcuaccgcaagaggcgcacgccguauggccauacuaggggauacggcgugggacuucggaagcguagggggugucuuaaacucacuaggaaaaaugguacaccaaauauucggguccgcauacacggcauuauuuagcgggguguccuggaucaugaaaaucgggauagguguccuccucacauggauagggcucaacagcaagaacacaaguaugagcuucucguguaucgucauuggaaucauaacauuauaucugggggccguaguacaagcagacaugggaugcgccaucaacuggaaaggaaaagaacuaaaaugcgguagugggauuuucguaaccaacgagguacacacauggacagagcaauacaaauuccaggcggauucuccaaagcgccucgcaaccgccaucgcaggagccugggagaacggcgugugcggcauacgaucaacgacccguauggagaaccugcuauggaaacaaauagcaaacgagcugaacuacauacugugggaaaacaacauaaaauugacaguaguggucggagacauaauaggcguacucgagcaaggaaagcggacccugacaccacaacccauggaacucaaguacagcuggaaaaccuggggcaaggcaaagauagugacggcggaaacacaaaauuccuccuucauuaucgauggccccaacaccccggaaugucccagcgcaagcagggccuggaacgucugggaaguagaagacuacgguuucgguguguuuacgacuaacaucuggcucaaauuacgcgagguguauacgcagagcugcgaccacaggcuuaugagcgcagccaucaaagacgaacgggcuguccacgcggacaugggauacuggauugaaucacaaaagaacgguagcuggaaauuggaaaaggcguccuucauagaagucaaaacaugcacguggccaaaaucacauacccucugguccaacggcgucuuagagucggauaugauuaucccuaagagucuggcggggccaaucagucagcacaaccacagaccagguuaucacacacagacggcaggacccuggcaccucgggaagcuggagcuggacuucaauuacugugaagguaccaccgucguuauuacggagaacugcggcacacggggacccagucugaggaccacgacagugagcggcaagcuaauccacgaaugguguugccgaucaugcacacuaccaccgcuccgcuacaugggggaagacggauguugguacggcauggaaauccgccccauaaaugagaaggaagaaaacauggugaaaucgcugguuagcgcaggaucgggaaaagucgauaacuucaccaugggaguacuaugccuggccauccuuuuugaagaaguaaugagaggaaaguucgggaaaaagcacaugaucgccgguguguuauucacauuuguacuacuucugagcgggcagauaacguggcgagauauggcgcacaccuucauaaugauaggaaguaacgcgagcgacaggaugggcaugggagugacauaccuagcccucauagcaaccuucaagauacaaccauuccucgcuuugggauucuucuuaagaaaacucacgucacgcgaaaaucuuuuauuaggaguagggcucgcaauggcaaccacgcuacaacucccggaagauaucgaacaaauggcaaacgggaucgcacugggucugaugacacuaaagcucaucacacaguucgaaacguaccaacucuggacggcguuaguaucgcugaccugcucuaacacaauuuuuacccuaacgguagccuggagaaccgcgacccuaguacuagcaggcgucagccuacucccucucugccaguccucaucgaugcggaaaaccgauuggcugccuaugaccguugccgcaaugggaguaccgccacucccuuuguucauuuucagccuaaaggacacaccaaaaagaagaagcuggccccugaaugaaggcguaauggcaguaggucucguaucgauacucgcaucaucgcuacuacgcaacgacgucccaauggccggaccccuagucgcagggggccuacucaucgcaugcuacgucaucaccgggacauccgcagaucucacgguggagaaagcagcagacgucaccugggaagaggaggcagaacaaacgggagucagccacaaucuaaugaucacgguggacgacgaugggacaaugcgcauaaaagacgacgagaccgagaacauccucacuguccuacuaaagaccgcccuccuuauagucucggggauauucccauacucuauaccagccacccuccuaguauggcacacauggcagaaacagacacagagaagcgggguucucugggacgugcccuccccaccagagacacagaaagccgaacuggaagaaggcguauauaggaucaaacaacaaggaauauucggaaaaacgcagguaggcgugggcguccaaaaagaaggcguuuuccacacuauguggcacguaacuagaggcgcaguacugacccacaacggcaaaaggcucgaaccaaauugggccaguguaaagaaagaccuuauaucauacgggggaggcuggcgacucuccgcccaguggcagaagggcgaggagguacaggucaucgcuguugagccgggaaagaaccccaaaaauuuccagacaaugccuggcauauuccaaacaaccaccggggagauaggugcgauagcgcuagauuucaaacccgguaccagcggguccccaaucaucaaccgagaagggaaggucguaggccucuaugggaacggcguaguaacuaagaacgguggcuaugugucagggaucgcgcagacgaacgcggaacccgacggaccaacaccggaacuagaggaagaaauguuuaagaagcgcaaccugacaauaauggaccuccacccuggauccggaaaaacacggaaguaccuuccagcaaucguucgagaagccauaaagcgacgccugaggaccuugauccuagcuccaacgagaguggucgcagcagaaauggaagaagcacugaaaggacuacccaucagguaccaaaccaccgcaacaaaaagcgagcauacaggucgcgaaaucguggaccuaaugugccaugcgacguucaccaugagacugcuaucacccguccguguacccaacuauaaccucauaauaauggaugaggcucauuucacugauccggcgagcauagccgcacggggauacauuuccacacgagucggaaugggcgaggcggcggcgauuuuuaugacugccacacccccaggaacggccgaggccuuuccacaaagcaacgcgcccauacaagacgaggaacgcgacauaccggagcgcagcuggaacucaggaaacgaguggauuacugacuucguggguaagaccguuugguuuguaccaaguauaaaggcggggaaugacaucgcgaacugccuccguaaaaauggcaagaaaguuauacaauugucacggaaaacauuugauaccgaguaccaaaagacucggcuaaacgacugggacuuuguugugacgacagacaucagugaaaugggggcgaacuucaaggcagaccgaguaauagaccccagaaggugcuuaaagccuguaauacugacagacgggccggagagaguuauccucgcaggaccgaugccaguuacagcggcaucggcagcacagaggagagggcgcguaggaagaaacccccaaaaggaaaacgaucaauacauauucacagggcagcccuuaaacaacgacgaggaucaugcccacuggacagaagccaaaaugcuauuggauaacauuaauacacccgagggaauuauuccggcgcuauuugaaccggagagagaaaagagcgccgccauagacggggaauaccgacuuaagggagaaagccgaaaaaccuuuguagagcugaugcggagaggcgaucuccccguauggcuggcacauaaaguagcgagcgagggcaucaaguauacagaccguaaauggugcuucgauggagagcgcaacaaucaaaucuuagaagaaaacauggacgucgaaauauggacgaaagagggggaacggaagaaacuacggccccgcuggcuggaugccaggacguacagugacccgcuggcguuaaaagaguucaaggacuucgccgccgguagaaaaagcaucgcgcuggaccucgucacagaaauuggacgaguucccagccaucuugccuaccgaaccagaaaugcgcuggacaaucucguaaugcuccacacauccgaacacggaggacgagcguaccgccacgcuguggaagaguugccggaaacgauggaaacauuacucuuacuaggccuaaugauacugcucacaggaggggcaauguuguuccuaauaagcggcaaggggaucgggaaaacauccauagggcugaucugugucaucgucaguagcggaaugcuguggauggcagacgucccucuccaauggaucgcaagugcaauaguccuagaguucuuuaugaugguacuucucaucccagaaccagaaaagcagaggacgccacaagacaaccaguuggccuacgucguaaucgggauccugacacuugcagcaauaguagcggcgaacgagaugggcuugcucgagaccaccaaacgagacuuaggcaugaguaaagaaccgggcgucgucagcccgaccaguuaccuagacguggacuuacacccagccucagccuggacacuauacgcaguugcaacuacaguaaucacgccaaugcuucggcacaccaucgagaacagcacggcaaacgucucgcuggcggccauagccaaccaggccguaguguugaugggccuagauaaaggauggccgauuuccaaaauggaccucggggcgccccuccuggcccuuggguguuauucacaggucaaucccuugacccugacagcggcuguacuucuacucgugacgcacuaugccauaauuggaccgggccuacaggcgaaagcgacgagggaagcacagaaacgcacggcagcgggcauaaugaagaacccaacgguagauggcauuaugacaauagacuuggaccccgucauauacgacaguaaauucgaaaagcaguugggccaagugaugcuacucgucuugugcgcgguccaacuacuacugaugcgaaccagcugggcccugugugaggcccucacccuugcgaccggaccgauaaccacgcuaugggagggaagcccagguaaauucuggaacaccaccauagcagucaguauggcaaauaucuucagagggucauaccuagcgggugcuggccuggccuucagcaucaugaaaagcgucggcacaggaaggcggggcacagguucacaaggggaaacucugggagagaaauggaagaagaaacucaaccaacugucaagaaaggaguucgaccucuacaaaaagagcggaauaacggaaguugauaggacagaagcaaaagagggcuugaaacggggagagacgacacaccacgccgucaguagaggcagcgcgaaacuucaaugguucguggagcgcaauaugguaaucccagaagggcguguaaucgaccuggguuguggacgggguggauggucuuacuauugugccggcuuaaagaaaguaacagaagucagaggcuacacgaaagggggccccggccacgaggaaccagucccgaugucaacauauggguggaacauaguuaagcucaugagcggaaaggacguguuuuacuuaccgccugaaaagugcgauacacuccucugcgacaucggagagagcucgcccucaccuacaguagaagaaagccggacgauccggguccuuaaaauggucgagccguggcucaaaaauaaccaauucugcaucaaagugcucaauccguacaugccgacggucaucgagcaccucgaacgacuacaacggaaauacgggggcaugcucgugagaaauccccugagcagaaacuccacacaugaaauguauuggauuagcaacggaaccggcaacaucguaaguuccgugaacauggugagccgucucuuacuaaacagauuuacuaugacucauaggcgacccacuauagagaaagacguggaccucggcgcagguacgagacauguaaacgcggaaccggagacaccgaacauggaugucaucggagagcgcaucaagcggaucaaagaagaacacagcaguacauggcacuacgacgacgaaaacccguacaaaacaugggcguaccacgggucguacgaagucaaagcgaccgggagugcguccucgaugaucaacggcgugguaaaacuuuuaacaaagccgugggacgucguuccgaugguaacacagauggcaaugaccgacacgacuccauucggacagcaacgcgucuucaaggagaaaguggacacacggacgccuagacccaugcccgguaccagaaagguaauggaaaucacagcugaguggcuauggcguacgcuaggucggaauaagaaaccucggcuaugcaccagagaagaguucaccaagaaaguaaggaccaacgcugcaaugggugcgguguucacagaagaaaaccaaugggacuccgcgcgagcugcgguagaggacgaggaguucuggaaauugguugaccgggagagggaauugcacaaacucgggaaaugcgggaguugcguguauaauaugaugggaaagcgagaaaagaaacuuggcgaguucggcaaagcaaagggcucgcgggcaauaugguacauguggcuuggagcgagauaccucgaguucgaagcgcucggauuucuaaacgaagaccauugguucagcagagaaaauucguacuccggaguagagggagaaggccuucacaaacugggguacauuuuacgcgacaucuccaaaaucccgggaggggccauguaugcagacgacacagccgguugggacacaagaaucaccgaagacgaccuacacaacgaagagaagauaacccagcagauggaccccgagcaccggcaacucgccaacgccauauuuaaacuaacauaccagaacaaaguagucaaaguccagcgaccuacaccgaagggcaccguaauggacauuauaaguaggaaagaucaacguggaucaggacagguaggcaccuauggacugaacacuuucacaaacauggaggcgcaacucguaagacaaauggagggugaaggcgugcucucgaaagcagacuuagaaaacccacaucuuuuggagaagaaaaucacccaauggcuagagacaaaggggguugagaggcugaaaagaauggcgauuagcggggacgacugcguagucaaaccaauagaugaccgcuuugccaacgcgcuccuggcccugaacgacauggggaagguacggaaagacauaccacaauggcagcccucaaaaggcuggcacgacuggcaacaagugccauuuuguagucaccacuuucaugagcuaaucaugaaagacgggcggaagcuaguagucccgugccgaccucaagacgaauugaucggccgagcgagaauaagucaaggugcuggguggucguuaaaggaaaccgccugccuagggaaggccuacgcccagauguggagucuaauguauuuccaccgucgugaucuacgacuagcgucaaacgcgauuugcagugcgguuccaguacacuggauccccaucagccggaccacauggagcauccacgcgcaccaccaauggaugacgacggaagacaugcuuaccguauggaaccgcguauggauagaagauaauccuuggauggaagacaagacaccggucacaacgugggaggacguacccuaucugggaaaaagagaggaucaguggugcgggucauuaauaggccucacaagccgagccacaugggcgcagaauauuuuaacagcgauccaacagguacguagucugauaggagacgaggaguuccuugacuauaugccaucgaugaaacgauuccguaaagaagaggaauccgagggcgccaucugguga

SEQ ID NO: 26111 - RNA, 9873 nt, Artificial Sequence
  derived and/or modified CDS sequence (opt11) from DENV-3__EU660411__SS-prME
acaagccuuugcuugaugaugaugcugcccgcaacccuagccuuccacuugacaagccgggacggggagccacggaugaucguggguaaaaaugaacgcggaaaaagccuguuguucaagacagcguccgggaucaacauguguacccucaucgccauggaccugggcgagaugugcgacgacaccgugacguauaaaugcccccugaucgcugagguggagccagaagauaucgauugcuggugcaaucucacaaguaccugggugaccuacgggacaugcaaccaggccggggagcaccggcgcgacaagcgaaguguggcccuggcuccccauguaggcaugggucuugauacccgaacccagaccuggaugucagccgagggcgcguggcgccagguugagaaggucgagacgugggcgcugaggcacccugguuucaccauccuugcgcucuuccucgcgcacuauaucggcacaucauuaacacagaaggugguuaucuuuauccugcucaugcuggucacgccuagcaugaccaugcgaugcgugggggugggcaaccgcgacuucgucgagggccuguccggagccaccuggguggacgugguccuagagcacggcgggugcgugaccacuauggccaagaacaagcccacccucgacauugagcugcaaaagacggaggccacccagcucgcgacgcugcggaagcuguguaucgagggcaagauuacaaacauaaccaccgacagcaggugccccacccagggagaggccauccucccugaggagcaagaccagaacuacguuugcaagcacaccuacguggacaggggguggggcaacggguguggacuguucgggaagggcagucuggugacgugcgccaaauuucagugccucgagcccaucgaggguaaggugguccaguacgagaaccugaaguacacggugaucauuacgguacauaccggggaccaacaccagguaggcaaugacacccagggggugaccguagaaaucacgccccaggccagcaccguggaagcugugcugcccgaguacggcacgcuugggcucgagugcuccccgaggaccgggcuagacuuuaacgagaugauucuacugaccaugaagaacaaagcguggaugguccaccggcagugguucuucgaccugccccucccuuggacuuccggcgccaccaccgagacucccacuuggaaccgcaaggaacuucuagugaccuuuaaaaacgcucacgccaagaagcaggagguggucguacucgguucccaggagggcgccaugcacaccgcgcugaccggggcaacggaaauccagaacagcggcgggaccuccaucuucgccggccaccugaagugccggcucaagauggacaagcuggaacugaaggguaugucuuacgcaaugugucucaacaccuucgugcugaagaaagaggucuccgagacccagcacgggacuauacugaucaagguggaguauaagggcgaagacgccccuugcaagauccccuucagcacagaggaugggcagggcaaagcgcacaacggucgccugaucacggccaacccgguggugaccaagaaagaggaacccgugaacaucgaggcugagccgccauucggggaaagcaacaucgucaucgggauuggugauaaggcgcucaagauuaauugguacaaaaagggcuccagcaucgggaagauguucgaggcgacggcucguggcgcccgccggauggccauccugggcgacaccgccugggauuuuggcuccguuggcggggugcugaacucgcucggcaagauggugcaccagaucuucggguccgcguauaccgcccucuucagcggcgucuccuggauaaugaagauuggcaucggggugcugcucaccuggaucggacugaacagcaagaacacguccaugagcuuuuccugcaucgugaucgggaucauaacccucuaucucggugccgucgugcaggccgacauggggugugugaucaacuggaaaggaaaggagcugaagugugggagcgggaucuuuguuacgaacgagguacauaccuggacggagcaguacaaauuccaagccgacucccccaagcgccuggcgacagccaucgccggcgcuugggagaauggaguguguggcaucaggagcaccacccggauggagaaucugcuguggaaacaaauagcuaacgagcugaacuacauacucugggaaaacaacaucaagcugacgguagucgugggugacaucauuggcguucuggagcaaggcaagcgcacccucacgccccagccgauggaguugaaauacuccuggaagacguggggcaaggcgaagaucgugacagccgaaacccagaacucuuccuucaucaucgacggucccaacacccccgaguguccaagcgccucccgggccuggaacgucugggagguagaggauuacggcuucgguguuuucaccacgaacaucuggcucaagcuccgcgaaguguauacccagagcugcgaccaucggcugaugagcgcggccaucaaggacgagcgcgccguccacgccgacaugggcuacuggaucgagucccagaagaacgguagcuggaaacuggaaaaggcuuccuucauugaggugaaaaccugcaccuggcccaagagccacacccuauggaguaauggcgugcuggagagcgacaugauaauuccuaagucgcuggcgggacccaucagucagcacaaccaccggccgggcuaccacacgcagacugcuggacccuggcaccucgggaagcucgagcuugacuucaacuacugcgaggguaccaccgucgugauuacggagaauugcgggacccgcggccccucucuacggacuaccaccgugucggggaaguugauccaugaguggugcugccgcuccuguacccugcccccgcuccgguacaugggcgaagacgggugcugguacggcauggagauccgccccauaaacgaaaaggaggagaacauggucaaaagccuggugucggccggaagcgggaagguggacaacuucaccaugggcguccugugccucgccaucuuauucgaggaagugaugcgggggaaguucggcaagaagcauaugaucgccggggugcuuuucaccuucguacuccugcuguccggccagaucacguggcgcgauauggcgcacacccucaucaugauaggcagcaacgccuccgaccggaugggaaugggcgugaccuaccuggcgcugaucgcuaccuucaagauccagcccuuccucgcccugggguucuuccugaggaagcucacgagccgggagaacuugcuguuaggcgucggucuggcuauggccacuacccuccagcuccccgaggauauagagcagauggccaacgguaucgcccugggguuaaugacacucaagcugaucacgcaguucgaaaccuaccagcuguggaccgcgcucgucucucugacauguuccaacacgaucuuuacacugaccguggccuggcggaccgccacccucauccuggccggugucagccuuuugccgcucugccaguccucuuccaugagaaagaccgacuggcucccaaugaccguugcugcaaugggcgugccgccccugccgcucuuuaucuucagucugaaggacaccccgaaacgccgguccuggccccucaaugagggggucauggcaguggggcugguaagcaucuuggcuuccagccuauugcguaacgaugucccuauggccgggccucugguggcaggcggccuccugauugcaugcuacgugaucacggggacguccgccgaccugaccgucgagaaggccgccgacgugaccugggaggaggaggccgagcagacuggcguaagccacaaccucaugaucacugucgaugaugacgggaccaugcgcaucaaggacgacgagaccgagaauauccuaaccgugcugcucaagaccgcgcuguugauaguguccggcauuuuccccuacagcauccccgccacucuccuggucuggcacaccuggcaaaagcagacccagcgguccggugugcugugggacguacccucgccgccggagacccagaaggccgaguuggaggagggggucuaccgaaucaagcagcagggcaucuuugggaagacccaagugggcguggggguucagaaagagggcguuuuccacaccauguggcacgugacccggggcgccguccugacgcacaacgggaagcgccuagagcccaacugggccuccguaaaaaaagaccuaaucucauacggcgggggcuggaggcuguccgcgcaauggcagaaaggggaggaggugcaggucaucgccgucgagcccggcaagaacccgaagaacuuccaaaccaugccugggaucuuccagacaaccacuggggagaucggcgcaaucgcccuagacuuuaaacccgguaccucgggcagcccgaucaucaaccgcgagggcaagaucguggggcuguacggcaauggugucgugacaaagaauggcggguacguguccggcaucgcgcagaccaacgccgagccagacggaccaaccccagaauuggaggaggagauguucaagaagcgaaaccugacgauaauggaccugcaccccgggagcggcaagacgcgcaaguacuuacccgccaucguccgggaggccaucaagcgccggcugagaacccuuauccucgcccccacgcgggugguggcggccgagauggaagaggcucugaagggucugcccaucagauaccagacaaccgccaucaaguccgagcacaccggacgggagauugucgaccucaugugccacgccacguucacaaugcgccuguugagcccggugcgggugcccaacuacaaccucaucaucauggacgaggcgcacuucaccgacccggccagcaucgccgcacgcggguacaucagcaccagagucggcaugggcgaagccgcggccaucuucaugaccgccacgccaccggguaccgccgaagcguucccccaguccaaugcccccauccaggaugaggagcgcgacaucccggaaaggucguggaacuccggcaacgaauggaucaccgacuuuguaggcaaaacgguuugguucguucccagcaucaaggccggcaacgacaucgccaacugccugcguaaaaacgggaagaaagucauccagcugucucgcaaaaccuucgacaccgaguaccagaagacccggcucaacgacugggacuucguggucacgacagacaucagcgagaugggcgccaacuucaaggcugaucgcgugauagacccucgacgcugccuaaagccagugauccucaccgacggaccagaacgggucauccuagccgggccaaugcccgugaccgccgccuccgccgcgcagagacggggccgcguggggcggaauccgcagaaggaaaacgaucaguacaucuucacgggacagccccugaauaacgacgaggaccacgcccacuggaccgaggccaagaugcugcuagacaacaucaacaccccggaggggauaauaccugcccuguucgagcccgagcgcgagaagucagcugcgauagacggugaguaccggcugaagggcgaguccagaaagaccuucgucgagcucaugcggcgcggagaccugcccguguggcucgcccacaaggucgccucagagggaaucaaguacaccgacaggaaguggugcuucgacggagaacgcaacaaucagauccucgaagagaauauggacguugagauuuggacuaaagagggagagcgcaagaaguugcgcccccgcuggcuggacgcccggaccuauuccgauccccuggcgcugaaggaguucaaggauuucgcggcgggccgcaaaagcauagcccuggaucucgugaccgagauagggcggguccccagccacuuggccuaccgcacccggaacgcgcuggacaaucucgugaugcugcauacaagcgagcacggcgggcgcgccuauaggcacgccgucgaggagcugccggagacgauggagacccuccuacugcucggauugaugauccugcucaccgggggcgccaugcuguuucugauuagcgguaaggggaucggcaagacguccaucgggcuuaucugcgucaucgugucuucgggcaugcuauggauggcugacgugccccugcaguggaucgccagcgcgaucguccuggaguuuuucaugaugguccugcugauccccgagcccgagaagcaacguaccccgcaggacaaccaguuagccuacguggucaucgggauauugacgcuggcagccaucguggcggcgaacgagaugggccuccuggaaaccacgaagcgggaccugggcauguccaaggagcccgggguagugagccccaccaguuaccucgacguggaucugcaccccgccagcgcuuggacccuguacgccguggcgaccacggucaucaccccgaugcucaggcacaccaucgaaaacuccaccgccaacgugagccuggcagcuaucgcgaaucaggcugucguccugaugggccuagacaagggguggccaaucuccaagauggaccugggugugccccugcucgcccuggggugcuacagccaagugaacccucugacgcucacugccgccguccugcugcucgucacccacuacgcgaucaucggaccgggccugcaggccaaggcgaccagggaggcacagaagagaacggccgccggaaucaugaagaaccccaccguugacggcaucaugaccauagaccuggaccccguaaucuacgacuccaaauucgagaagcaauuaggccaaguuauguugcuugugcucugcgccguccaacugcuacucaugcggaccagcugggcccugugcgaggcccugacucuggccacgggcccaaucacuacccugugggagggcuccccggguaaguucuggaauacgaccaucgcgguuagcauggccaacauauuucgcggauccuaccuggccggggccggccucgcguucagcaucaugaagucgguggggacaggccgucgagggaccggaagucagggcgagacgcugggggagaaguggaagaagaaacuuaaccagcucaguaggaaggaguucgacuuauacaagaagucuggaaucaccgaggucgacagaaccgaggccaaggagggacugaaacggggugagacgacccaccacgcugugagucgcggcuccgccaagcuccagugguucguggagaggaacauggucaucccggaggggcgcgucauugacuuaggcugcggucgcgguggguggagcuacuacugcgcaggccugaagaaagugacggagguccguggcuacaccaagggcgggcccgggcacgaggaaccugugccaaugucuaccuauggcuggaacaucgugaagcugaugucggggaaggacgucuucuaucugccgccggaaaagugcgacacccugcugugcgacaucggugaauccagccccuccccgaccguggaggagagcagaacaauccgugugcucaagaugguugagcccuggcugaagaacaaccaauucugcauuaagguucugaaucccuacaugcccaccgugaucgagcaccucgaaagacugcagcgaaaguacggugggaugcugguccgcaacccgcucuccaggaacucgacccacgagauguacuggaucucgaacgguaccgggaacaucgugagcuccgugaacauggucucgcgccugcuucucaaccgcuucacgaugacccaccgccggcccacuaucgagaaggacguggaccugggugccggcacgagacacgucaacgccgagcccgagacuccgaacauggacgugaucggggagcggauaaagcgcaucaaggaggagcacuccuccaccuggcacuacgaugacgagaaccccuauaagaccugggcguaccacggcuccuacgaggucaaggccacggggagcgccagcucuaugaucaacggcguggugaagcuccucacuaagccaugggacguuguccccauggugacccagauggcgaugaccgacacgaccccguucgggcaacagaggguguucaaggagaaggucgacacccgaacgccccggccuaugcccggcacacgcaaggugauggagauaaccgcagaguggcuguggaggacucugggucguaacaagaagccgcgccucugcacccgggaggaguucacgaaaaaggugcgcaccaaugccgccaugggggccgucuucaccgaggaaaaccagugggacucugcgcgggccgccguggaggacgaggaguucuggaagcuuguggaucgcgagcgggagcuacauaaacucggcaagugcgggucgugcgucuacaacaugaugggcaaacgcgagaagaaguugggugaguucggcaaggcgaagggcagccgggcgaucugguacauguggcugggggccagauaucuagaauucgaagcccucggcuuccuuaacgaggaucacugguucuccagggagaacagcuacuccgggguugagggcgaggggcugcacaaacugggcuacaucuugcgcgacaucagcaaaauacccggcggggccauguacgccgacgacaccgcgggcugggacacgcgcauaaccgaggacgaccuucauaacgaggagaagaucacccagcagauggauccagagcaucgccagcuggccaacgccauauucaaguuaacuuaucagaacaaagugguaaaaguucagcggcccacaccgaaagggaccgugauggacaucaucucccgcaaggaccagcggggcagcggccaaguggggacuuacggacucaacacuuucaccaacauggaggcucaacugguacgacagauggagggagagggcguacuguccaaggccgacuuagagaauccccaucuccuggagaagaagauuacgcaauggcucgagaccaaaggggucgagaggcugaagcgaauggccaucucgggcgacgacuguguggugaagcccauagacgaucgguucgcgaacgcacuguuggcccugaacgauaugggcaagguccgcaaggacaucccccaguggcaaccguccaagggguggcaugacuggcagcaggugcccuuuuguagccaccacuuucacgagcucaucaugaaggacggcagaaaguuagugguccccugccgcccccaggaugagcugaucgggcgcgcccgaauaagucagggcgcgggguggagccucaaagaaaccgccugccucggcaaggccuacgcccaaaugugguccuuaauguacuuucaucgcagagaucugcgccuagccagcaacgcgaucuguuccgccguuccggugcacuggauccccaccagccggacgaccuggucuauccacgcccaccaccaguggaugaccacugaggacaugcugacggucuggaaccgcguguggaucgaagacaacccuuggauggaggauaagacccccgugaccacaugggaggauguccccuaucuggggaagcgcgaggaccagugguguggcucccucaucggccugacaagccgcgcaaccugggcgcagaacauacugacggcgauccagcagguccguucccugaucggggacgaggaguuucucgacuacaugcccagcaugaagcgcuuccggaaggaggaggaguccgagggcgccaucugguaa

SEQ ID NO: 26112 - RNA, 9873 nt, Artificial Sequence
  derived and/or modified CDS sequence (opt11) from DENV-3__FJ432722__SS-prME
accucacuuugucucaugaugaugcugccugcgacacuggccuuccaucucaccagccgggacggcgagccgcgcaugaucgugggcaagaacgagcggggcaagucucugcuguucaagaccgcguccgggaucaacaugugcacccucaucgccauggaccugggcgaaaugugcgaugacaccguuacguacaagugcccccugaucgccgaaguagagcccgaggacaucgacugcuggugcaaccucaccagcaccugggugaccuacgggacuugcaaccaggccggcgagcaccggcgggacaaacgguccgucgcccuggcgccccacgugggaauggggcuggacacccgcacccagaccuggaugagcgcggaaggugccuggcgccagguggagaagguugaaacuugggcccugcgccacccgggcuucacuauccuggcgcuguuccucgcccauuacaucggcaccucccuuacgcagaaggugguuaucuucauucugcucaugcuggugacgcccagcaugacgaugcggugcguggggguuggcaaucgcgacuucgucgaaggacuguccggggccaccuggguggacgugguccucgagcacggcgggugcgugaccacgauggcgaagaacaagcccacucuggacaucgaacugcagaaaaccgaggccacccaguuggccacgcugcggaagcugugcauugagggcaagaucaccaacaucaccacagacagccgcugccccacgcaaggagaggcaauccucccggaagagcaggaccagaacuacguguguaagcacaccuacgucgaucggggcuggggcaacgggugcggccucuucgggaagggcucccuggucaccugcgccaaguuccagugccucgaaccuaucgagggcaaggugguccaguacgagaacuuaaaguacacugugaucaucacggugcacaccggggaucagcaccagguuggaaacgacacccaaggggugaccguagaaauuacgccccaggcaagcaccgucgaggcggugcugcccgaauacgggacacucggccuggagugcucaccgcgcacaggccuagauuucaacgaaaugauccuccugacgaugaagaacaaagcguggaugguucaccgacagugguuuuucgauuuaccccuccccuggacgagcggcgcgaccaccgagacccccacguggaaccgcaaggagcugcuggugaccuucaagaacgcccacgccaagaagcaggagguggucgugcucgggucccaggagggagcgaugcacaccgcgcugaccggggccacggagauccagaacagcggcgggaccuccaucuucgccggccaccucaagugucggcucaagauggacaagcuagagcugaaggguaugagcuacgccaugugucucaacaccuucgugcugaagaaggaggucagugagacccaacacggcacgauacuuaucaagguugaguacaagggcgaggacgccccgugcaagauccccuucagcaccgaggacgggcagggcaaggcucacaacggccgccugauaaccgccaaucccguggucaccaagaaagaggagccugugaacaucgaggccgaaccgcccuucggggagagcaacauagugaucggcauaggggacaaagcccucaagaucaacugguacaagaagggcucgucaaucgggaagauguucgaggcgacggccaggggcgcccggcggauggcuauccugggcgacacugccugggacuuuggguccgucggcgggguucuuaacagccucggcaagauggugcaccagaucuucgguuccgcuuauaccgcccuguucaguggcgucaguuggaucaugaagaucggcaucggcguacugcucaccuggauaggccugaacuccaagaacacgagcauguccuuuucgugcaucguaauagggauuaucacccuguaucucggcgccgucgugcaggccgauauggggugcgugaucaacuggaagggcaaggagcugaagugcggcagcgggauuuucguuaccaacgaggugcacaccuggacggagcaguacaaauuccaggccgauucacccaagcgcuuagcgaccgccaucgccggcgccugggaaaacggagugugcgggauccgcagcacgaccagaauggagaaccuccuguggaaacagaucgccaaugagcugaacuacauccucugggagaacaacaucaagcuaacggucgugguaggugacaucaucggcgucuuggagcaagguaagcgcacccucacgccccagccgauggagcugaaguacuccuggaaaaccuggggcaaggcgaagaucgugacugccgagacccagaauagcucguucauaaucgauggccccaacacacccgagugccccucugccucucgggccuggaacgugugggaggucgaggacuacggguucggcguguucacaacgaacauuuggcugaagcuccgcgagguguauacacagagcugcgaccaccggcugaugagcgcggccaucaaagacgagcgugccguccacgcggauaugggcuacuggaucgaaucccagaaaaacgguagcuggaagcuggagaaggcguccuucaucgaggugaagaccugcaccuggcccaagucccacacccuauggucaaauggcgugcuggagagcgacaugaucauccccaaaucccuggcggggcccaucagccagcacaaccaccggccgggcuaccacacgcagaccgccgggcccuggcaccucggcaagcuggagcucgauuucaacuacugcgagggcacuaccgucgugauaacggagaacugcgggacccggggaccuucuuugcggaccaccacggugagcgggaagcugauccacgaauggugcugccgcuccugcacucuaccgccgcuucgguacaugggcgaagacgggugcugguacggcauggagauacgccccauuaacgagaaggaggagaacauggucaagagccugguguccgccggcucggggaagguggacaacuuuaccauggggguacugugucucgccauccuguuugaagaggugaugcgggggaaguucggcaagaagcacaugaucgccggggugcuguucaccuucguccuccucuuguccggucagaucacauggcgugacauggcgcacacucucaucaugaucggcagcaacgccuccgaccguauggggaugggagugacauaccuggcacugaucgcuaccuucaagauccaacccuuucucgcccugggguucuuccugcgcaagcucacaagccgggaaaaccugcugcucggcgugggccuggccauggccaccacccugcagcuucccgaagacauagaacaaauggccaaugggaucgcccugggccugaugacccucaagcugaucacgcaguucgagaccuaccagcuguggacggcgcucgucagccugacaugcucgaauacgaucuucacccugacaguggcauggcgcaccgcuacacugauacuggccggugucagccugcucccgcugugccaguccagcuccaugcggaagaccgacuggcuucccaugaccguggccgcuaugggcgugccgccccugccguuauuuaucuucagucugaaggauacccccaagcgccgcuccuggccccucaacgaggggguaauggccgugggccugguaagcaucuuagccuccagccuccugcgaaaugacguccccauggccggcccgcugguagcagguggccuccugauagcgugcuacgugaucacggggacaagcgccgaccuuaccgucgagaaagccgccgacguaaccugggaggaggaggccgagcagacgggcgugagccacaaccucaugaucaccgucgacgacgacgggaccaugcgcaucaaagacgacgagaccgagaacauccugacuguacugcugaagacggcgcugcugaucgugucaggaaucuuccccuacagcauccccgccacccuccuggucuggcauaccuggcagaagcagacccagcggucggguguucugugggacgugccaucgccgccggagacgcagaaggcugagcucgaggagggcguauaccgcaucaagcagcagggcaucuuugggaagacccagguagggguggggguccagaaggagggcguguuccauaccauguggcacgucacccgcggcgcggucuuaacucacaacgggaaaaggcuggagcccaacugggccuccgugaaaaaggaccucaucagcuacggcggcggcuggcgucuguccgcgcaguggcagaagggcgaggaggugcaggucauugccguggagcccggcaagaacccgaagaacuuccagaccaugcccggcaucuuccagaccaccacgggggagaucggcgccaucgcccuggacuucaagcccgguaccagcggcaguccgaucaucaaccgcgaaggcaagguggucggguuauacggcaaugggguggugaccaaaaauggcggcuacguuagcggcaucgcgcaaacaaacgcggagcccgacggcccgacgcccgagcuggaggaggagauguucaaaaagcggaaccugaccaucauggaccugcacccggggagcggcaagacccgaaaauaccuccccgccaucgugcgggaggccauuaagcgacggcugcggacccugauccuagcgcccacucgggugguagcggccgagauggaggaggcgcugaaagggcuccccauccgcuaccagacaacagccaccaagagugagcacacgggccgcgagaucguggaccucaugugccacgccaccuucacaaugcgccugcugagcccggugcggguccccaacuacaaccucaucauuauggacgaggcgcacuucaccgaccccgccuccaucgccgcccgcggguacauaagcacgcgggugggcaugggcgaggccgcggccaucuuuaugaccgccacuccgccaggaaccgcagaagcguucccccaguccaacgcuccgauccaggacgaggagagggacauccccgagcgcagcuggaacuccggcaacgaguggauaaccgacuucguggggaagaccgucugguucgugccgagcaucaaggccgguaacgacauugccaacugccugcggaagaacgggaagaaggugauccaacuguccaggaagaccuuugauaccgaguaccagaagacuaaacucaaugacugggauuucguuguuacaacagacaucagcgagaugggcgccaacuuuaaggcggaccgggugauugacccccgcaggugucugaaaccggucaucuuaaccgacgggcccgagcgcgugaucuuggccgggccgaugcccgugaccgccgccuccgccgcccagcgacgcggccgggucgggcgcaacccccagaaggagaaugaccaauacaucuucacuggccagccccugaacaacgacgaggaccacgcgcauuggaccgaggccaagaugcugcucgacaacaucaacaccccugaagggaucauccccgcccuguuugagccugaacgggagaaauccgcagcgaucgauggggaguacaggcugaagggcgaaucccggaaaaccuucguggagcugaugcgccgaggggaccugcccguuuggcuggcccacaagguggccagcgagggcaucaaauacacggaccgaaaguggugcuucgauggggaacggaacaaccagauccucgaagaaaacauggacgucgagaucuggaccaaggagggcgagcgcaagaagcugcggccgcgcuggcuggacgcccgcaccuacuccgacccucucgcuuuaaaggaguucaaggacuucgccgcaggucgcaagagcaucgcccuggaccucgucaccgagaucgggcgcguacccucccauuuggccuaccggacgcgcaacgcgcuggacaauuuggugaugcugcacaccagcgagcacggcgggcgagcuuaccgccaugccgucgaggagcugccggagaccauggagacccucuugcugcucggccugaugauucugcucaccggcggggccaugcuguuccugaucagugggaaggggaucggcaagaccuccaucggucucaucugcgugaucgugagcuccggcaugcuguggauggccgacgucccccugcaguggaucgccagcgccaucgugcucgaguucuuuaugauggugcuauugauccccgagccggaaaagcagcggaccccgcaggacaaccagcucgccuacgucgugaucgggauccugacccuggcugccaucguggcggccaacgagaugggccuccuggagacaaccaagcgcgaucuggggauguccaaggagcccggcgucgugagccccacguccuaccucgacguggaccugcaucccgcgucagccuggacccuguacgccgucgcgacgaccguuaucaccccuauguuaaggcacaccaucgagaacuccacggcuaacguuagccuggccgcuaucgcgaaccaggccgucgugcugaugggccucgacaagggguggccuaucaguaagauggaccugggcguuccgcugcucgcucugggguguuacagccaggucaacccccugaccuuaacggccgccgugcugcuccuagugacccacuacgcgaucaucggccccggcuuacaggccaaggccacccgugaggcccagaagcggacagccgcggggaucaugaagaaccccaccgucgacggaaucaugaccaucgacuuggacccagugaucuacgacaguaaguucgagaagcagcucggacagguuaugcugcugguccucugugcggugcaacugcugcucaugcgcacgagcugggcccugugcgaggccuugacccucgcaaccggccccaucaccacgcugugggagggcucccccgggaaguucuggaacacaaccauugcggugagcauggcgaacauauuccgaggcuccuaccuggccggggcuggccucgcguucagcaucaugaagucagucgggaccggccgcaggggcacggggagccaaggcgagacccugggggaaaaguggaagaagaagcuaaaccagcugucucgcaaggaguucgaccuuuacaagaagagcgggaucacugagguggaucggaccgaagccaaagaagggcucaagcgcggcgagaccacgcaccacgccgugagccguggcagcgccaagcuccagugguucgucgagcggaacauggugauccccgagggccgggugaucgaccugggcugcgggcgcgguggguggagcuacuacugcgccgggcugaaaaaggucaccgaggugcgcggcuacaccaaaggugggccugggcacgaagagcccgugcccauguccaccuauggcuggaacaucguuaagcucaugucugggaaggacguguucuacuugccgcccgaaaagugcgacacgcugcugugcgacaucggugaguccucacccucuccgaccguggaggagagccggaccauccguguccucaagaugguggaacccuggcugaagaauaaccaauucugcaucaaggugcuuaaccccuacaugcccaccgucaucgagcaccucgagcgccugcagcggaaguacggcgggaugcuggugcggaauccgcucagucgcaacagcacgcacgagauguacuggauuucaaacggcacugggaacaucgugagcuccguaaacauggugucccggcugcugcucaaccgcuucaccaugacccaccggcgccccacgaucgagaaggacgucgaccugggcgcgggcacgaggcaugugaacgccgaacccgagaccccaaacauggauguaaucggggagaggaucaagcggauaaaggaggaacacagcagcacguggcacuacgaugacgagaaccccuacaaaacgugggccuaccacggguccuacgagguuaaggccacugggagcgccucguccaugaucaacgguguggugaagcugcucaccaagccgugggaugucgugcccauggugacccagauggcgaugacggacaccaccccguucggucagcagcgcgucuucaaggagaagguggacacgcggacgccgagaccuaugccuggcacccggaaggugauggagauuaccgccgaguggcuguggcgcacccugggccggaacaagaagccucgccucugcacgcgcgaggaguuuaccaagaaaguaagaaccaacgccgccaugggugccguguucaccgaggagaaccaaugggacagcgcgcgcgcugccguggaggacgaggaguucuggaaguuagucgaccgugagcgcgagcuacacaaacucggcaagugcgggucuugcguguacaacaugauggguaagcgcgagaagaagcugggggaguucggaaaggcaaagggcagccgcgcgauaugguacauguggcugggggcccgguaccucgaguucgaagcccuaggcuuccugaaugaggaccacugguucucucgcgaaaacuccuacucugggguggagggcgaagggcuccacaagcugggcuacauccugcgggacauaagcaagaucccggggggggccauguacgcggacgauacggcgggcugggacacccgcaucaccgaggacgaccuccacaacgaggagaagaucacccaacagauggaccccgagcaucggcagcucgccaacgccaucuucaaacugacguaccagaacaaggucgugaagguacagcgcccaacccccaaagggacggucauggauaucaucucccggaaggaccagcgcggcucaggccagguggggacauacggccucaauaccuucacgaacauggaggcccagcugguccggcagauggaaggcgagggcgucuuauccaaagccgacuuggagaauccccaccuccuggagaagaagaucacccaaugguuggagaccaaggggguggagcgccugaagcggauggcgauaagcggcgacgacugcguggucaaacccaucgacgaucgcuucgccaaugcccugcucgcccugaacgacaugggcaaggugcgcaaggacaucccccaguggcagccgucuaagggcuggcacgacuggcagcagguucccuucugcagccaccacuuccacgagcugaucaugaaagacggccguaaacucguugugccgugccggccccaagacgagcugaucgggcgcgcacgaaucucccagggcgcgggguggagccugaaggagaccgccugccucggcaaggccuacgcccagauguggucucugauguacuuccaccggcgcgaccugcggcucgccuccaacgcaaucugcuccgccgucccgguacauuggauccccacaagccgcaccacguggaguauccacgcccaccaucaguggaugaccacagaggacaugcugaccguuuggaaccggguguggauugaggacaacccauggauggaggacaagaccccuguaacaacgugggaggacguuccguaccugggaaagcgcgaggaccaguggugcgggucucucaucggacugaccagccgggccacgugggcucagaacauccucaccgccauacagcagguccgaucccucauaggggacgaggaguuccuggacuacaugcccagcaugaagcgguuucgcaaggaagaggaguccgagggcgucauuugguga

SEQ ID NO: 26113 - RNA, 9873 nt, Artificial Sequence
  derived and/or modified CDS sequence (opt11) from DENV-3__FJ432728__SS-prME
accucacugugccucaugaugaugcugccagcgaccuuagccuuccaccucacuagccgggacggcgagccgcguaugaucguggggaagaacgagaggggcaagagccugcuguucaagacugcguccggaaucaacauguguacccucauugcuauggaccugggcgagaugugcgacgacaccguaacguacaaaugcccccugaucgccgagguggagcccgaggacauugacugcuggugcaaccucaccagcaccugggucaccuaugggacuugcaaccaggccggcgagcaucggcgcgauaagcggaguguggcgcuggcgccgcacgugggcauggggcuggacacccgcacccagaccuggaugagcgccgagggcgcauggcgccagguggagaagguagagacgugggcccuccgccacccgggguucaccauccuggcacuuuuccucgcccacuacaucggcaccucccucacccaaaagguggugaucuucauccugcucaugcuggugacgcccagcaugaccaugaggugcgugggcguugggaaccgcgacuuuguggagggccucuccggugccaccuggguagacgugguccucgagcacggcgggugcgugaccacuauggccaagaauaagcccacccucgacaucgaacugcagaagacugaggcgacccaacucgcgacgcugcggaagcugugcauagaggggaaaaucaccaacaucaccaccgacagcaggugccccacccagggcgaggccauccuaccagaggagcaagaccagaacuacgugugcaagcacacuuacguggaccggggguggggaaacgggugcggcuuguucgggaagggcucccuggugaccugcgccaaauuccaaugccucgagccuaucgaaggcaagguugugcaauaugagaaccuuaaguacaccgugaucaucacggugcacacaggggaccagcaucaagucggcaacgacacccagggcgugaccgucgagaucacgccccaagcuucaaccguagaagccgugcugccugaguacggcacccucggguuggagugcuccccgcgcacaggccuggacuucaacgagaugauacugcugaccaugaagaacaaggcguggaugguccaccgacagugguucuucgaccuucccuuacccuggacgucuggcgccaccaccgagacccccacguggaaccgcaaggagcugcuggugaccuucaagaacgcucaugccaagaagcaggaggugguggugcucgggucgcaagagggugcaaugcacaccgcgcugaccggggccacggaaauccagaacagcggcgggacuaguaucuucgccggccaccugaagugccgacucaagauggacaagcuugaacugaaggggaugagcuacgcgaugugccuaaauaccuuugugcugaagaaggagguauccgaaacccaacaugggacgauccugaucaagguggaguacaagggcgaggacgccccguguaagauccccuucucgaccgaggaugggcagggcaaagcgcacaacggacgccugaucaccgcgaaccccguggucaccaaaaaggaggagcccgugaacauugaggccgagccgcccuucggggagagcaacaucguuaucggcauaggugauaaggcccucaagauuaacugguauaagaagggguccagcauagggaagauguuugaggcgacggcccggggcgcccgucggauggccauucuuggcgacaccgccugggacuucggguccgucgggggugugcugaauagccucggcaaaauggugcaucaaaucuucgggagugcguacaccgcccuguucucgggcgucucuuggaucaugaagaucgggaucggggugcugcucaccuggaucggccugaacagcaaaaacacauccaugagcuucucaugcauaguuauuggcaucaucacccuguaccucggcgccgucgugcaggccgacauggggugugccaucaacuggaagggcaaggaacugaagugcggcagcggcaucuucgugaccaacgaaguccacacguggaccgagcaguacaaguuccaagcggacagucccaaacgccuggccaccgccaucgcaggcgccugggaaaacggggugugcggcauaagaagcaccacccggauggagaacuuacuuuggaagcagauagcaaacgagcuaaacuacauccuaugggagaacaacaucaaacucacgguggucgugggggacaucauuggcgugcuagagcagggcaagaggacccucaccccucagccuauggaacugaaguacuccuggaagaccugggggaaagccaagaucgucacggccgagacacagaacagcuccuucauaaucgacggccccaacaccccugagugccccagcgcaucgcgggcguggaaugucugggagguagaggacuacggguuuggcgucuucaccacgaacauuuggcugaaauuacgcgaggucuacacccagagcugcgaccaccggcugaugagcgcagccaucaaggaugagcgcgccguccacgccgacaugggcuacuggauagagucccaaaagaacgggagcuggaagcuggagaaagcguccuucaucgaagucaagaccugcaccuggcccaagucccacacccucugguccaacggagugcuggagagcgacaugaucauccccaagucccuggccggccccaucucccagcacaaccaucggccgggcuaccacacucagaccgccgggccguggcaccuaggcaaacuggaacuggacuuuaauuacugcgaaggcaccaccguugucaucacggaggacugcgggacgcgcggccccucacuccggaccaccacggugagcggaaaacugauacacgagugguguugccgcuccugcacucuacccccgcuccgguacaugggugaggacgggugcugguacggcauggagauccgccccauaaacgagaaggaagagaacauggucaagagucugguuucggccggcagcggcaagguggacaauuucaccaugggugugcugugccucgccauucuguuugaggaggucaugcgggggaaguucggcaagaagcacaugaucgcugggguguuguucaccuucgugcucuugcuguccggccagaucacguggcgcgacauggcccacacccucaucaugaucggcagcaacgcgagcgaccggaugggaaugggagucaccuaccuggcccugaucgccaccuucaagauccaacccuuucucgcgcugggauucuuucugaggaagcuaacaagccgggagaaccugcugcugggcgugggccuggcuauggccaccacacugcagcuccccgaagacaucgagcagauggccaacgggauagcgcugggccugaugacccuaaagcugaucacgcaguucgagaccuaccagcuguggaccgcgcucgugagccugaccugcuccaacacgaucuucacccugaccguugccuggcgcaccgcgacccucauccuggccggggucucgcugcucccgcugugccaguccagcuccaugcguaagaccgacuggcugcccaugaccguagcagcgaugggcgugccgccccugccgcuguucaucuucagccugaaggacaccccuaagcgccguagcuggccccucaacgaggggguuauggccgucggccugguaagcauuuuagccucuagccuccugcggaacgaugugcccauggcaggcccgcugguagccggggggcuccugaucgccugcuacgugaucacggggacguccgccgaccugaccguugagaaggcagccgacgucacaugggaggaggaggcggaacagacgggggugagccacaaucucaugaucacuguggacgacgacggcacgaugcgcaucaaggacgacgaaaccgaaaacaucuuaaccguccugcucaagacggccuuguuaaucgucuccggcaucuuccccuacagcauacccgccacccuccugguguggcauaccuggcagaagcagacccagagauccgguguccucugggaugugcccuccccgcccgagacgcagaaggccgagcucgaggagggggucuaucgcaucaagcagcagggcauauucgggaaaacccaggucgguguggggguacagaaggagggggucuuucacacgauguggcacgucaccagaggcgccgugcugacgcacaacgggaagcgccuggagccuaacugggcguccgugaagaaggaucucaucagcuacggcgggggcuggcggcuguccgcacaguggcaaaagggcgaggagguccaggugaucgccguugagcccggcaagaauccgaagaacuuccagacuaugccuggcaucuuccaaaccaccacgggggagaucggcgcuaucgcacuggacuuuaagcccgggacuagcggcagcccgaucaucaaccgcgagggcaagguuguugggcuguacgggaacgguguggugaccaagaauggcggguacguguccggcaucgcccagacgaacgccgaacccgacggccccacgcccgagcucgaggaggagauguuuaagaagagaaaccugaccaucauggaucugcacccggggagcgggaagacgcgcaaauaccuccccgccaucguccgggaggcaaucaagcgccgacugagaaccuuaauucucgcuccaacgcgaguggucgccgccgagauggaagaggcccugaagggucugcccauccgcuaccagaccaccgccaccaaguccgagcacacgggccgggagaucgucgaccucaugugccacgcgaccuuuaccaugcgccuccucagcccugugcgggugcccaacuacaaccucauaaucauggacgaggcccacuucaccgacccggccuccaucgcagcgcgcggcuauaucagcacgcgcgucggcaugggagaggcggccgccauuuucaugaccgccacgccgccggggaccgcggaggccuucccacaauccaacgcccccauccaagaugaggagagggacauccccgagcgcaguuggaacuccggcaaugaguggaucacggacuuugugggcaaaaccgucugguucguacccagcaucaaggccgggaaugacaucgccaauugucugcgcaagaacgggaagaaagugauucagcuuagucgcaaaaccuucgacaccgaguaccagaaaacgcggcucaaugacugggacuucguggugaccaccgacaucagcgaaaugggcgcgaacuucaaggcggaccgcgugaucgacccccggcgcugccugaagcccgugauucugaccgacgggcccgagagggucauccucgccgggccgaugcccguuacggccgccuccgcggcccagcgccggggcagaguagggcggaacccacagaaagaaaacgaccaguacaucuucaccggccagccccugaacaacgacgaagaccacgcccacuggaccgaggcaaagaugcugcucgacaauaucaacaccccggaagggaucauccccgcccuguucgagcccgagcgcgagaagucugcugccaucgacggcgaauaccggcuuaagggcgagagccgcaagaccuucgucgaacucaugcggcgcggggaucugcccguguggcuagcccacaagguugcgagcgagggcauaaaauacacggaccggaaguggugcuucgacggggagcgcaacaaccagauccucgaagaaaacauggacguggagaucuggacgaaagagggcgagcgcaagaagcugcguccgcgguggcuggaugcgcggaccuacuccgacccgcuugcccucaaggaguucaaggauuucgccgccggccgcaagagcaucgcucuggaccucgugacggagaucggacggguacccucccaccuggcguaucggacacggaacgcgcuggacaauuuagugaugcugcacaccuccgagcacggcgggcgcgccuaccgucaugccgucgaggagcugccggagaccauggagacccuccuacugcucggacuaaugauccuguuaaccgguggggccauguuguuucugaucucggggaaggggaucggaaaaaccuccaucgggcucauaugcgucauagucagcuccggcauguuauggauggcggacgugccccugcaguggaucgccagcgccaucguauuagaguuuuucaugauggugcugcugauccccgagcccgagaaacagcgcaccccgcaggacaaccaacucgccuacguggucaucgggauccugacucuggccgcgaucguggccgcuaacgaaaugggccuccuggaaacgacgaagcgggaucugggcauguccaaggaacccgggguagucagcccaaccagcuaccucgacguggaccugcaccccgccagcgcauggacccuguacgcgguggccacaacgguuauaaccccgaugcucaggcacaccaucgaaaacuccacugccaacgugagccucgccgcgauagccaaucaggcugugguccuuaugggccucgacaagggguggcccaucuccaagauggaccugggcgugccccugcuagcccuggggugcuacagccaggugaacccccuuaccuuaaccgcagcgguucugcugcucgugacccacuacgccaucaucggcccgggccuccaggccaaagccacgcgggaagcccagaagagaaccgcggccgggaucaugaagaaccccacgguggacgguaucaugaccaucgaccuggacccagucauauacgauagcaaguucgagaagcaacucggccagguaaugcugcuugugcucugugccguccagcugcuccucaugcggacgagcugggcccugugcgaggcccugacucucgcgaccggccccaucaccacguugugggagggcuccccuggcaaauuuuggaacaccaccaucgccgugagcauggccaauaucuuccgcggauccuacuuggccggggcggggcucgccuucagcaucaugaagucuguggggacaggccggcgcggcaccgggagccagggcgagacccugggugaaaaauggaagaagaagcugaaccagcucagccggaaagaguucgaccuguacaagaagucuggcaucacggaggucgacaggaccgaggccaaggagggucuuaagcggggcgagaccacgcaccacgccgugagcagaggcuccgcgaaacuccagugguucguggagcggaacauggucauccccgaagggcgagugauugacuuagguugugggcgcggagggugguccuacuacugcgcgggccuuaaaaaagucaccgagguccggggcuacaccaagggaggcccagggcaugaggagcccguuccgauguccaccuacggcuggaaccugguuaagcugaugagcgggaaggacgucuucuaccugccgccggagaagugcgacacucuacuaugcgacaucggcgagucuagcccauccccgaccguggaggagagcagaaccauccgggugcugaagauggucgagcccuggcugaagaacaaccaguucugcaucaaggugcucaaccccuacaugcccaccgugauagagcaucuggagcgcuugcagcggaaguacggcggcaugcucguccgcaacccgcugucccgaaacuccacgcacgagauguacuggauauccaacggcaccgggaauaucguuagcucggugaacaugguuucgcgcuuacuccugaaccgguucacuaugacccaucgccggcccacgauagagaaggacguggaucugggcgcuggcacccgccacguaaacgccgagcccgagaccccgaacauggacgugaucggggagcggaucaagcgcauaaaggaggagcacagcagcacuuggcacuacgacgacgaaaaccccuacaagacgugggcguaccacggcuccuacgaggugaaggcgaccgggagcgcgagcucuaugaucaacggcguggugaagcuccugaccaagccuugggaugugguccccauggugacccagauggccaugacagacaccaccccguuuggacagcagcgaguguucaaggagaaggucgacacccgaacgcccagacccaugccgggcacgcgcaaggugauggagaucaccgccgaguggcuguggcggacgcucggccgcaacaagaagccacgcuuaugcacgcgggaggaauucaccaagaaggugcgcacuaacgccgcuaugggggcugucuuuacggaggagaaucaaugggacucugcccgcgccgccguggaggacgaggaguucuggaagcuugucgaccgcgaacgcgagcuccacaaacuaggcaagugcggauccugcgucuauaacaugaugggcaagcgcgaaaagaagcugggggaauuuggcaaggcgaagggaagccgugccaucugguacauguggcugggggcccgcuacuuggaguucgaagcacuuggcuuccucaacgaagaccacugguucucccgggagaacagcuacuccggggucgagggugaggggcugcacaaacugggcuacauccuccgcgacaucucgaagauacccggcggggccauguacgcggacgacacggccggcugggacacccguaucaccgaggacgaccugcacaaugaggagaagaucacacaacaaauggauccggagcaccgccaacuggcaaacgcuaucuucaagcucacguaucagaacaaaguugucaaggugcagcggcccaccccgaaggggaccguuauggacaucaucucacggaaggaccagcggggcagcggccagguagggacauacggcuuaaacaccuucacuaacauggaggcccagcuggugcgccagauggagggagagggagugcucuccaaggcggaccuggagaacccgcaccuccucgagaagaagaucacacaguggcuggagaccaagggcguggagcggcuuaaacgcauggcaauaagcggcgacgacugcguggugaagccgaucgaugaccgauuugcuaacgcccuccuggcauuaaacgauaugggcaagguccgcaaggacauaccccaguggcagccauccaaaggguggcacgacuggcaacagguccccuucugcagccaccacuuccacgagcucaucaugaaggacggccggaaguugguggugcccugccggccccaggacgagcugaucgggcgggcgcggaucucccagggcgcuggguggagccucaaggagaccgccugccugggcaaggcauacgcccagauguggucccugauguacuuccaccgccgggaccuccggcuggcgagcaacgccaucugcuccgccgugccggugcacuggauccccaccagccggaccacuuggagcauccacgcccaccaccaguggaugacgacggaagacaugcugaccguuuggaaucgcguguggaucgaggacaaccccuggauggaggacaagaccccggugacgacgugggaggacgucccauacuuggggaaaagggaggaccaguggugcggaucccuuaucggucugaccagccgcgcgaccugggcccagaauauacucaccgccauacaacagguccgcuccuugaucggagacgaggaguuccuggauuacaugcccagcaugaagcgcuucaggaaggaggaggaguccgagggggccaucugguga

SEQ ID NO: 26114 - RNA, 9873 nt, Artificial Sequence
  derived and/or modified CDS sequence (opt11) from DENV-3__FJ432731__SS-prME
acgagcuuaugccucaugaugaugcucccagccacccuggccuuccaccugacaagccgggacggggagccgcggaugauuguggggaagaacgagcgcggcaagagcuuauuauucaagaccgcuuccggcaucaacaugugcaccuugaucgcuauggaccugggcgagaugugcgaugacacugugacguauaagugcccucugaucgccgagguggagccagaggacauagacugcuggugcaaccucaccuccaccuggguaacuuacgguacgugcaaccaagccggcgaacaccggcgcgauaagcgguccgucgcccuugcgccccaugugggcaugggauuagacacccgcacccagacauggaugagcgccgagggggccuggagacagguggagaaggucgagaccugggccuuacgccacccgggguucaccauccuggcgcuuuuccucgcgcacuacaucggcaccucucugacccagaaaguggugaucuucauccuacugaugcugguuacccccagcaugaccaugcggugcguaggggugggcaaccgggacuucguggaaggcuuguccggggcgaccuggguggacgugguucuugagcauggcggcugugugaccacgauggccaaaaacaagccuacccuggacauagagcuccaaaagaccgaggcaacacaacucgcgacgcugcgaaagcugugcaucgagggcaagauuacaaacauuacuacugacagccgcugcccgacgcagggagaggccauccucccggaggagcaggaccaaaacuacgugugcaagcacaccuacgucgaccggggguggggaaacggcugcggccuguucgggaaaggcucccugguuacgugcgccaaguuccaaugccucgagcccaucgagggcaaggugguacaguaugagaaccugaaauacaccgugaucaucacgguacacaccggggaccagcaccaggucggcaaugauacccagggggugaccgucgagauaacuccucaggccagcacaguggaagcugugcugccugaguacggcacccucgggcuagagugcuccccgcgcaccggccuggacuuuaaugagaugauccuacuuaccaugaagaacaaagcguggaugguccaccgacaaugguucuucgaucuuccucuccccuggacgagcggcgccacgaccgaaacccccacguggaaccgaaaagagcugcucgugacauuuaaaaacgcccacgcgaagaagcaggagguggucgugcucggaucccaggagggcgccaugcacaccgcucuuacgggugcaacugagauucaaaacagcggcgguacauccaucuucgcgggccaccugaaaugccgucucaagauggacaagcuggagcugaagggcauguccuacgcaaugugcuugaacacguucguguuaaagaaggaggucuccgagacucagcaugggacgauccugauaaagguugaguacaaaggcgaggacgccccuugcaagauccccuucagcacggaagaugggcagggcaaggcgcacaacggcagguugaucaccgcaaacccaguagucaccaagaaggaggaacccgucaacaucgaggccgagccgcccuuuggcgagaguaacaucgugauuggcaucggggacaaggcccucaagauaaacugguacaagaaagguuccucaauugggaaaauguucgaagcgacggcccggggcgcgcgucgcauggcgauccugggagauaccgcuugggacuucggguccguuggcgggguucugaacagccucgguaagauggugcaccagaucuucggguccgccuacaccgcuuuguuuagcggcgugucguggaucaugaagauugggauuggggugcugcucaccuggauaggucugaacagcaagaacacauccaugucauucuccugcauagucauagggaucaucacccuguaccucggcgccgucguucaggcggauauggggugcgccaucaacuggaagggcaaggagcugaagugcgggucugggauuuucgucaccaacgagguacacaccuggacagaacaauacaaauuucaggcggacucuccgaaacgccuggccaccgccaucgccggcgccugggagaaugggguaugcggcaucaggagcaccacccguauggagaacuugcuguggaagcagauugccaacgagcugaauuacauccucugggagaauaacaucaagcuaaccguggucguaggggacaucaucggagugcuggagcagggcaagcgcacccucacgccgcagccgauggaguugaaauacucuuggaagaccugggggaaggccaagaucgucaccgccgagacccagaacagcucauucaucaucgacggccccaacacccccgagugucccucagccucgcgggcguggaacgugugggagguagaggacuauggguucggcgucuucacuacgaacaucuggcuaaaacuccgugaaguguacacccaaagcugcgaucaccggcugaugagcgccgccaucaaggacgagagggccguccacgcggacaugggcuacuggaucgagucccaaaagaacgggagcuggaagcuggaaaaggcguccuucaucgagguaaagacuugcacuuggccaaagagccacacguugugguccaacggagugcuggagagcgacaugaucauacccaagucccuggcuggccccaucagccagcacaaucaccggccgggcuaccacacacagaccgcugggcccuggcaccucggcaagcuggaacuggacuucaacuacugcgagggcaccacgguggugauaacggaaaacugcgguacgcgcggccccucccuccgcaccacgacaguaagcggaaagcugauccacgaguggugcugccguucauguacguugcccccgcuccgguacaugggcgaggaugguuguugguauggcauggagauucgccccauaaacgagaaggaggagaacaugguuaaaagccuugucuccgcgggcagcgggaagguggacaacuucaccaugggagugcucugccucgcaauucuguuugaggaagucaugcgggggaaguucgggaagaagcauaugaucgcggggguguuguucauguucguacuccuucuguccggucagaucaccuggcgcgauauggcccaaacgcucauaaugaucggcagcaacgccucagaccggaugggaaugggagucacuuaccuggcgcuaaucgccaccuucaagauccagcccuuccucgcgcugggguucuuccugaggaagcucaccagccgggagaaccugcugcucggcgucggccuggccaugaccaccacacugcaguugccagaggacaucgagcagauggccaacgggauagcccugggccuaaugacgcuuaagcugaucacacaauuugagaccuaucagcuguggaccgcgcuggucagcuuaaccugcuccaacacgaucuucacccugacggucgcuuggcgcaccgcaacguuaauucuggccggcgugagucugcucccacuaugccaguccagcuccaugcggaagaccgauuggcugccaaugaccguagccgcgaugggcgugccgccacugccguuauucaucuucucacugaaggauacccccaagcgccgcucguggccccucaacgagggggucauggccgugggcuuggugagcauccuggcguccagccuccuucggaacgacguaccgauggcuggcccgcugguggccgguggacuauuaauugcgugcuacgugaucacgggaaccuccgccgaccugaccguugagaaggccgccgacgucaccugggaggaagaagccgagcagaccggagugagccauaaccucaugauuacaguggaugaugacggaaccaugcgcaucaaagacgacgagaccgagaacaucuuaaccguccugcucaagacggcacugcugauaguuuccggcaucuuccccuacagcaucccggccacccuuuuagucuggcacacuuggcaaaaacagacgcagagaagcggcguccugugggacgugcccaguccgcccgagacgcaaaaggccgagcucgaggaagggguguaccgcaucaagcaacaggggaucuucgggaagacgcagguuggcgucggggugcagaaagagggcguauuccacaccauguggcacgugacucguggagcugugcugacucacaaugggaagcgccuggaaccuaacugggccucagucaaaaaggauuuaauaucguauggggguggcuggcggcuguccgcgcaguggcagaagggggaggagguccaaguaaucgcgguugaacccgggaagaaccccaaaaauuuccaaaccaugccuggcaucuuccagacgacaacgggggaaauaggcgcaaucgcccuagacuucaagcccggcaccucuggcagcccuauaaucaaccgcgaaggcaagguaguggggcucuacggcaaugguguggucaccaagaacggcgguuacguguccggaauagcgcagaccaacgccgaaccggacggacccacgcccgagcuggaggaggagauguucaagaagcggaaucuuaccauaauggaccugcacccggguucgggcaaaacccguaaguaccuacccgccauaguccgggaggcgauuaagcgacggcugcggacucugauccucgcccccacccggguaguagcugccgaaauggaagaggcccugaagggcuugcccauaagguaccagaccacugccacuaaaagugaacauacuggucgggagaucguggacuuaaugugccaugccaccuucacgaugcgucugcugagucccgugcggguaccuaacuacaacuugaucaucauggacgaggcgcauuucacagacccugccucgaucgccgcccgaggguacaucagcacccgggucggaaugggugaggcugcggcaaucuucaugacugcaaccccgcccgggacagcagaggcguucccccaauccaaugccccaauccaggacgaagaacgcgacaucccagagcgcagcuggaacucagguaacgaguggaucacggacuucguagggaaaaccgugugguucgucccgagcauuaaggcuggcaacgauaucgcuaauugccugcguaagaacggcaagaagguaauccagcugucccggaaaaccuucgacaccgaguaccagaagacccggcucaacgacugggacuucguagucaccaccgacaucucagagaugggcgccaacuucaaggcggaucgcgucaucgacccacggcgcugccuuaagccagugauccugaccgacggccccgagcgcguaauccuagccggcccgaugcccgugacggcugccagcgccgcucagcgccggggccguguggggcgcaacccucagaaggaaaacgaccaauacaucuuuaccggucagccccugaauaacgaugaggaucacgcccacuggaccgaggccaaaaugcugcuagacaacaucaacacccccgaggggaucaucccugcccuguucgagcccgagcgcgagaaguccgcugcgauagacggugaauauaggcugaagggcgagucccgaaagacuuuugucgagcuuaugcgacguggagaucugccgguguggcuggcucauaaggucgccucagaggguaucaaauacacggaucggaaauggugcuucgacggagagaggaacaaucagauccuagaggagaacauggauguggagaucuggaccaaggagggcgagcgcaagaaacuucguccgcgcuggcuggacgcacggaccuacuccgacccgcucgcucugaaggaguucaaggacuucgccgcuggccgcaagagcaucgcgcuggaccuugugaccgagaucgguagagucccaucccaucucgccuaccgcaccagaaacgcucuggacaaccucguuauguugcauaccagcgagcacggaggucgugccuaucgccacgcuguagaggaacugccugaaaccauggagaccuugcucuuacucggccugaugauucugcucaccggcggggcaaugcuguuccugaucagcgggaaggggaucgggaagacguccauugggcucaucugcgucaucgucucguccggcaugcuguggauggccgacgucccccuacaguggaucgcgucugcuauuauccuugaguuuuucaugaugguccugcuuauccccgagcccgagaagcagaggaccccgcaggacaaccagcucgccuacgucgucauaggaauacugacccuggccgccaucgucgcggccaacgagaugggccuccuggagacaacaaagagggauuuggggauguccaaggagccugggguuguaucaccaacguccuaccucgacgucgaccugcaccccgcgagcgcuuggacccuguacgccguugcgacuacgguaaucaccccgaugcuccgccacacaauagagaacuccacugccaaugucagccuggccgccaucgccaaccaggccguggugcuaaugggccucgacaaaggauggcccauaucgaagauggaccucggcgucccauuacucgcucuggggugcuacagccaggugaacccucugacccucaccgccgccgugcugcucuuagucacccacuacgcaauaaucggcccgggccugcaggccaaggccacucgcgaggcgcagaagcgcacggcggcggggaucaugaagaaccccaccgucgacggcauaaugaccaucgaccuggacccggugaucuaugacuccaaauucgagaagcagcucggacagguaauguuacuugugcucugcgccguccaguugcuccugaugcggacgaguugggcucugugcgaagcccugacccuggccaccggcccaauuacgacgcugugggaaggcaguccggggaaguucuggaacacaacgauagcggucucgauggcaaauaucuuccgcggcucuuaucuagccggggccggccucgcguucagcauaaugaagucgguuggaaccgggcggcgcggcacggggagccagggcgagacacugggugagaaguggaagaagaaguuaaaucagcuuagccguaaggaguucgaucuauacaagaaauccggcaucaccgagguggaccggacugaggcaaaggagggucugaaaaggggcgagaccacgcaccacgcagucagccgcggcuccgccaagcuccaaugguucguggagcguaacauggugauccccgaagggcgcgugaucgaccuggggugcgggaggggcgggugguccuacuacugugcaggccucaaaaaggugaccgaggugcggggcuauacuaaaggcggucccggccaugaggaacccgucccgauguccacuuauggcuggaaccuagugaaacuuaugucggggaaggacguguucuaccugccaccggagaagugcgacacuuugcugugcgacaucggcgaguccagcccgucuccaaccgucgaggaaagcaggaccauucgagugcugaagaugguggagcccuggcugaaaaacaaccaguucuguaucaaaguccuaaacccguauaugccaaccgugaucgagcaccuggagcgcuuacaaaggaaguacggagguauguuagugcgcaacccgcuuagucggaacagcacgcacgagauguacuggauauccaacggaaccggcaacauagucucguccguaaacaugguaagccggcucuuacuuaaccgcuucacaaugacgcacagacgacccacgaucgaaaaggacgucgaccugggagcgggaacccgacacgugaacgcagagcccgagaccccaaacauggacgugaucggggagcggaucaaacgcaucaaggaggaacauuccuccaccuggcacuacgacgaugaaaaccccuauaaaacgugggccuaccauggcuccuaugagguuaaggccacaggguccgccagcuccaugauaaacgguguggugaagcuccugacuaagcccugggacguggugcccauggucacgcagauggcaaugacggacaccaccccguuuggacaacagcggguguucaaggagaagguggauacgcgcacgccccggccgaugcccggcacacgcaaaguaauggagaucacggccgaauggcuguggaggacccucgggcgcaacaaaaagccgcgccuuuguacgcgggaggaguucaccaaaaaggugcgcaccaaugcagcgaugggggccguguucaccgaggagaaccagugggauuccgcgcgggcggcagucgaggacgaggaguuuuggaagcugguggaccgagagcgggagcuccacaagcugggaaagugcggauccugcguguacaacaugaugggcaagcgcgagaagaagcugggugaguuuggcaaggcgaaaggcagccgggcgaucugguacauguggcuuggggcccgcuaccuggaauuugaggcccuuggcuuccucaacgaggaccacugguuuucccgggagaacucuuacaguggagucgagggugagggucugcacaagcugggcuacauucuccgcgauaucucuaagauccccgguggggcuauguacgccgacgacacggcgggcugggacacucgcaucacggaagacgaccugcauaacgaggaaaagauaacacaacagauggaucccgaacaccgccagcuggccaacgccaucuuuaagcucacguaucagaacaagguagugaaaguccagcggcccaccccaaaggguacaguaauggauauaaucucacgcaaggaccagcgggguucaggccaggugggaaccuacggccugaacacuuucacaaauauggaagcccagcuggugcgccagauggagggggagggcgugcucuccaaggccgaccucgagaacccucaccuccucgaaaagaagaucacccaguggcuggagaccaaggggguugagcggcugaagcgaauggcgaucaguggcgacgacuguguuguaaagccaaucgaugaccguuucgccaacgcccuccuggcgcugaacgacaugggcaaggugcgcaaggauauaccgcaguggcagccgaguaagggauggcacgacuggcaacaggucccguucugcagccaccauuuccacgagcucaucaugaaggacggcaggaaacuggucguccccugccguccccaagacgagcuaauaggacgcgcacggauuucgcagggcgcgggguggagccucaaggagacugccugucucgggaaagccuaugcucaaauguggucccucauguacuuccaccgccgggaccuuagacuggcuagcaacgcgauuugcuccgccgucccggugcacuggaucccuaccucucguacgaccuggagcauccacgcucaucaccaguggaugaccacagaagacaugcuuacgguguggaaccgcgucuggaucgaagacaaccccuggauggaggacaagacucccgugaccacgugggaagacgugccguauuuaggcaaacgggaggaccaguggugugggucccucaucggccugaccagccgcgccaccugggcgcagaacauauuaacggcuauccagcagguccguucucugaucggggacgaggaguuucuggauuacaugccaucuaugaagcgcuuccgaaaagaggaggaguccgagggggccaucugguag

SEQ ID NO: 26115 - RNA, 9873 nt, Artificial Sequence
  derived and/or modified CDS sequence (opt11) from DENV-3__FJ562097__SS-prME
accucccuaugccugaugaugaugcucccagcuacgcuggcauuccaccugacuagccgagacggggaaccucguaugauuguaggcaaaaacgaacgcgggaaaagucuuuuauucaaaacagccuccggcauaaauaugugcacacuaauagccauggaccuuggggaaaugugugaugacacggucacauacaaaugcccucuuaucgcagaaguggaaccagaagacaucgauugcuggugcaaucuuacuagcacauggguaacauaugggacauguaaccaagcuggggaacaccgccgagacaaacggucaguagcacucgcaccgcaugucggcaugggccuagacacucggacacaaacauggaugagcgcugaaggagcauggaggcaagucgaaaaaguggagaccugggcgcuccggcaccccggauucacgauccucgccuuauuccucgcccauuauauagguacgucuuugacgcaaaaagucgugauauucauccuacuaaugcugguaacacccagcaugaccaugaggugcgugggcgucggcaacagagacuucgucgaaggccucagcggagcaaccugggucgauguggugcuagaacacggagggugcguuacaacaauggccaaaaacaaaccgaccuuggauaucgaacuucagaaaaccgaggccacgcaacuagcaacccuacgaaaacugugcauagaggguaaaaucacaaacauaacaaccgacucgcgaugccccacgcaaggcgaagcgauauuacccgaagaacaagaucaaaacuacgucugcaaacauacauauguggaccgaggcugggggaacggcugcggccucuuuggcaaagggucacugguaaccugcgcuaaauuucaaugccuugaaccaaucgaaggaaaaguaguccaguacgaaaaucuaaaauacacggugaucauaaccguccacacaggagaucagcaccaaguugggaacgacacgcaaggagugacaguugagauuaccccucaagcaagcaccguagaagcaguacugccagaauacggaacccuaggccuugaaugcucaccacgcacaggacucgacuucaacgaaaugauacugcucacaaugaagaacaaagcauggauggugcaucgacaaugguucuucgaccuacccuuacccuggaccagcggugcgacuaccgaaacgccaacguggaaucguaaagaauuacucgucacauucaagaacgcgcacgccaagaaacaggaagucgucgugcuaggcagccaagaaggggccaugcacaccgcauuaacaggugccacagaaauccagaauagcggggguacaucaaucuucgcggggcaucuuaagugucgucucaagauggacaagcuagaguugaagggcaugagcuacgcgauguguuuaaacaccuucgugcuaaagaaagaagugucugagacucagcacgguaccauacuaauuaagguugaguacaaaggagaagacgcccccugcaaaauacccuuuuccacagaagacgggcagggaaaagcacacaacgggaggcuuauaacagccaacccaguggucaccaagaaggaagaaccaguaaauaucgaggccgaacccccuuucggcgaaagcaauauagucaucggcaucggcgacaaagcucucaaaauaaacugguauaagaaaggaucauccauaggaaagauguucgaggcaacggcaagaggugcgcgccgcauggccauacucggagacacggcaugggacuucgggucugucggaggaguacugaacagccucgguaaaaugguccaccaaauauucggaagcgccuacacggcacuguuuuccggaguaaguuggaucaugaaaauagguauuggagucuugcuuaccuggaucggcuuaaacagcaagaacaccagcaugagcuucucgugcauugugauagguauuauaacccuguaccucggcgccgucguucaggccgacaugggcugcgucaucaacuggaaggguaaagaacucaaaugcggaaguggaaucuucgucacgaacgaaguccacacauggaccgaacaguacaaauuccaagcagacagccccaaacgcuuagccaccgcaaucgcgggagccugggagaauggagucugcggaauccgcuccacaacacgcauggaaaaccuguuauggaaacagaucgcgaacgaacucaacuacauccucugggagaacaacauaaaguuaacuguaguugugggcgacauaaucggaguccuagaacaagggaaacgaacucuaacaccccagcccauggaacugaaguacuccuggaaaaccuggggcaaagccaaaaucguuacugcagaaacccaaaauuccagcuucauaaucgacgggccgaacacuccagagugccccuccgcgagucgugcguggaacgucugggaagucgaagacuacggcuucgggguguucacaacgaauauaugguugaaacugagagaagucuacacgcaauccugcgaccaccgucugaugucagcagcuaucaaggaugagagagccguacaugcagauaugggguacuggauagagucacagaagaacggcucauggaaacucgagaaggccucauucauagaagugaagacaugcacguggccgaaaucccauacccuuugguccaauggcguacuggagagcgacaugauuaucccaaagagccucgcgggccccauuagccaacacaaucaccgaccagguuaccacacgcagacagcgggaccguggcaucucggcaagcuggaguuagauuucaacuacugcgagggcaccacaguggugauuacggaaaacugcggaacgcgaggcccgucgcuucguaccaccacgguguccgguaaacuaauacacgaauggugcugccgaagcugcacgcucccaccccuccgguacaugggugaagauggauguugguacggcauggaaauacggcccauuaacgaaaaagaagagaacaugguaaaaaguuuagucagcgccgguuccggcaagguagacaauuucacaauggggguccuaugucucgcgauccuauucgaggaaguaaugcgaggcaaguuugggaagaaacacaugauagcgggagugcuguuuacguucguccuccucuuaucugggcagauuaccuggcgcgacauggcgcacacgcucauaaugauugggagcaacgcaagugaccgcaugggaaugggcguaaccuaccuggcguuaauugcuacauucaaaauccagcccuuccuggcacuuggauucuuccugcguaagcugacaucacgcgagaaucuacuacuaggcgugggccuggcaauggcggcgacacuacaguuaccggaagacauagaacagauggcgaacggcauugcccuaggccuaaugacccuaaaauugaucacgcaauucgagaccuaucagcucuggaccgcucucgucagcuugacaugcucgaacaccaucuuuacccucaccguggcauggcgcaccgcgacacugauccucgcggggguaagccuacucccucucugccaaucgaguagcaugcgcaaaaccgacuggcuucccaugacugucgccgcaaugggggugccaccacuaccgcuauucauauucagucuuaaagauacaccuaaacgacgaagcuggccauugaacgaagguguaauggccgucggccuagugagcauucuugcaucgagccuacugagaaacgaugucccgauggcuggaccauuaguagcaggaggucuccucaucgccugcuacgugauaacggggaccucggcagaccucaccguagaaaaggcugccgauguaacgugggaagaggaggcggaacaaacaggcguaagucacaaccuaaugaucacggucgacgacgacggcacaaugcgcaucaaagacgacgagacggaaaacauacuaacggucuuacucaaaacggcucuuuuaauugugucaggcguuuucccauacucaauccccgccacccugcucguguggcauaccuggcaaaaacagacacagcgauccggggugcuaugggaugugccauccccgcccgaaacucaaaaagcagaacuagaagagggcgucuacagaauuaagcaacagggaauuuucggcaagacgcaaguaggagucgggguucagaaagaaggcguauuccacacaauguggcacgugacgagaggggcgguacucacacacaacggaaaaagacuugaacccaacugggcgagcguaaagaaagaccugaucuccuacggaggaggauggagguuaucugcucaauggcaaaaaggggaagaggugcagguaaucgcaguggagccagggaaaaaucccaagaacuuccaaacaaugcccgguauauuccagacaaccacgggagaaauaggcgcgauagcccuggacuucaaaccggggacaagcgggagcccaauaauaaaccgugaagggaagguagugggcuuguacggaaauggcgucguuacuaaaaauggcgguuacgucagcgggaucgcacagaccaaugccgaaccagauggacccacaccggaacucgaggaggaaauguucaagaaaaggaaucugaccaucauggaccugcaccccggcagcgggaaaaccagaaaauaccuccccgccauaguccgggaagcaauaaagcgucgacugcgcacacucauacuagccccaacgagagugguagcugcagaaauggaagaagcccucaaaggccuacccauaagauaccaaaccaccgccacaaaaagugaacacaccggccgcgagaucgucgaucugaugugucacgccacuuucaccaugcguuugcucucgcccgugcgagucccaaauuacaaccucauaauaauggacgaagcccacuucacagaccccgcgaguauagccgcgaggggauauaucucgacaaggguaggcaugggcgaggcggcugccaucuucaugaccgccaccccacccggcacggcagaggccuucccccaaagcaacgcccccauacaagacgaggaacgcgacaucccagaacggagcuggaauaguggaaacgaauggauaacugauuucgugggaaagacaguuugguucgugcccucuauaaaagcuggaaacgacauagcuaauugccuucggaaaaacggaaagaaggugauccagcucucacggaaaacauucgauacggaguaccagaagacuaaacuaaaugacugggauuucguaguuaccaccgacaucagcgaaaugggagcgaacuucaaagcugaccgcgucauagacccacgccgauguuugaaacccguaauauuaacggauggcccagagcgcgugauacuggccgggcccaugccagucacagcagcuagcgcagcccagaggaggggccgaguaggcaggaauccgcaaaaagaaaacgaccaguacauuuucacuggccagccauugaauaacgaugaggaccacgcacacuggacagaagcaaaaaugcuccuugacaauauaaacaccccugaaggcauaauacccgcccucuuugagccagaacgcgagaaaagcgcggcgaucgacggcgaauacagacuaaaaggagaaucaagaaaaacuuucgucgagcucaugagacgaggcgaucuaccggucuggcuagcacacaagguugcgagcgaagggaucaaguauaccgacagaaagugguguuucgacggcgagagaaacaaccagauacuggaagagaauauggauguagaaaucuggaccaaagagggagaacggaagaaacuccgcccaagaugguuggacgcgaggaccuacucugauccgcuugcauuaaaagaauuuaaagacuucgcagcaggcaggaaaucaaucgcacuagaucucguaaccgagauaggccgggugcccucgcaucuggcguaccgaacaagaaacgcccuggacaaccuugucaugcuccacacaagugagcacgggggacgcgccuaccggcaugccgucgaggaacuacccgaaacuauggaaacgcuccugcugcuaggguugaugauacuucuaacaggcggcgccaugcuguuccugaucagcggcaaaggaaucggcaagacgagcauuggcuugaucugugucauugucuccagcggaaugcuauggauggcggaugucccacuccaguggaucgcguccgcaaucguucuagaguucuucaugauggugcuacuuaucccagaaccugagaaacaacgaacaccgcaagacaaucagcucgccuauguagucauaggcauccugacacucgcagcuauuguggccgcaaaugaaauggggcuacucgagacaacaaaacgagaccugggaaugagcaaagaacccggggucgucagcccgacuagcuaucuagauguugaccuacauccagccagcgccuggacacucuaugccgucgccacuacugucauuacgcccaugcugcggcacacaaucgaaaauucaacggcaaauguaaguuuagccgcgauagcaaaccaagcagucguccuaaugggacucgauaagggauggccaauaagcaaaauggaucugggcguuccucuacucgcgcuaggcugcuacucucaggugaacccacugacccuaacagcugccgucuuauuacuggugacacauuacgccauaaucggccccggucuacaagcaaaggcuacaagagaagcgcagaaaaggaccgcagcaggcaucaugaagaaucccacuguggacggcauaaugaccauagaccuugacccagugaucuacgacagcaaauucgaaaaacagcuaggacagguaaugcuacugguccugugcgccguacaacuucucuuaaugagaaccagcugggcguuaugcgaggcacucacacuagcaacaggcccuauuaccacccucugggaggggucuccggguaaguuuuggaacacgaccauagcugucagcauggccaauauauuccggggauccuacuuagcaggagcgggccucgcauucagcaucaugaaaagcguagggacgggccgucguggaaccggaagucagggagaaacacugggggaaaaguggaagaagaaacuuaaccaacucagccgaaaggaguucgaccucuacaagaaaagcggcauaacggaagucgaucggacagaagcaaaggagggacucaagcgcggcgaaacuacccaccacgccgucucacgcggcagcgccaaauugcagugguuuguagaacguaauauggugaucccagaaggccggguaaucgaucuuggauguggcaggggcggcugguccuauuauugcgcaggacuaaagaaaguuacggaggucagaggguacacaaaaggagggccagggcaugaggaaccaguccccaugagcacguauggcuggaauauuguaaaguuaauguccggaaaagacguguucuauuugcccccagaaaagugcgacacuuugcugugcgacauaggugaauccucacccucacccacggucgaagaaucucgcacgauacgaguccucaagauggucgaaccauggcuuaaaaacaaucaauucugcauaaagguacuaaaccccuauaugccaaccguaauagagcaucuggagcgucuccaaagaaaauacgggggcaugcucguccgaaauccucucucgcggaacagcacccacgagauguacuggaucucaaacggaacaggcaacauuguuucaagcguaaauauggucagcaggcucuugcucaaccguuucacuaugacacaccggagacccacaauagagaaggacgucgaccucggcgccgggacccgucacguaaacgccgaaccggaaacgccgaacauggacgucaucggagaacgcauaaagcggaucaaagaagaacacuccucaaccuggcauuacgacgacgaaaaccccuacaaaacuugggcguaucacggcucauacgaagugaaagccacagggucagcaaguucuaugauaaacgggguagucaaacuacucacgaaaccuugggaugucguccccaugguaacacaaauggccaugaccgacacaacuccguucggccagcaacgaguauucaaagaaaaaguagacacuaggacaccacguccuaugcccggaacgcgcaagguaauggagauuacagcagagugguuguggaggacauuaggaagaaauaagaagccgcggcugugcacaagagaagaguucacuaagaaaguacguaccaacgcagcaaugggcgcugucuucacagaggaaaaucagugggacucagcccgagccgcaguggaggacgaggaguucuggaaacucguagaccgagaacgggaacuucacaaacucggaaagugcggaucauguguguacaacaugauggggaaacgcgagaagaaacuuggagaauuuggaaaagcuaaggggucuagagccaucugguacauguggcucggggccagauaccuagaguucgaagcccucggauucuuaaaugaagaccacugguuuagccgugaaaauagcuacucaggcguagaaggcgagggccugcacaaacucggcuacauccugagggacaucucgaagauacccggcggcgccauguacgccgacgauaccgcagggugggacacaagaaucacagaggacgacuuacacaacgaggagaaaauaacacaacagauggacccagagcaccgccaguuggcgaaugccauauuuaagcugacuuaucaaaacaaagugguaaagguucagagacccacuccgaaaggcaccgugauggauauaauaagccgcaaagaucaaagagggucaggucaaguggguacuuaugggcuaaacacguucacuaacauggaggcacaguuaguacgucaaauggaaggcgagggaguccuuaguaaagccgaccuugaaaauccacaucugcuggagaagaaaauaacgcaguggcucgaaacgaaaggugucgagcgccuaaagaggauggccauuuccggcgacgacugcguggugaagccaauagaugaccgguuugcgaacgccuuacuagcccugaaugacaugggcaaagugcgaaaggauaucccacaguggcaaccuucaaaaggguggcaugacuggcagcaggucccuuuuugcucccaccacuuccaugaguugaucaugaaagauggucggaagcuagucguuccaugucgcccccaagaugagcugaucggucgagcacgaaucagucaaggcgccggcuggucgcucaaagaaacagccugccuuggaaaagcauacgcgcagauguggagccuaauguacuuccaccgucgcgaucuccggcuagccaguaacgcgauaugcucggcaguaccgguccauuggauaccgacuucaagaacgaccugguccauucaugcgcaccaucaguggaugacgacugaagauaugcugacuguauggaaccgagucuggauugaagacaacccauggauggaagauaagacacccguaacaacgugggaggauguaccauaccugggcaaacgagaagaccaauggugcggaagccugauaggacucaccagccgagccacuugggcacaaaacaucuuaacagccauacaacaaguacgaucgcucauaggugacgaagaguuccuggacuacaugccgucuaugaagcgguuccgcaaggaggaggaaagcgagggggcaauuugguaa

SEQ ID NO: 26116 - RNA, 9873 nt, Artificial Sequence
  derived and/or modified CDS sequence (opt11) from DENV-3__FJ432741__SS-prME
accuccuuaugccugaugaugaugcuacccgcgaccuuagcuuuucacuugacgucccgggauggggaaccgcggaugaucguugggaagaacgagcgaggcaaaagccugcuuuucaaaaccgcguccgggauuaacaugugcacgcucaucgcgauggaccugggcgagaugugcgacgacaccgugacguauaagugcccccugaucgccgagguggagcccgaagacaucgauugcuggugcaaccugaccucuaccugggugaccuacgggacgugcaaccaagccggugaacaccgucgcgacaagcgguccguggcacuggcgccccacguggguaugggguuggacacccgcacccagaccuggaugagcgccgagggggccuggcgccagguugagaagguugaaacgugggcacuccgccacccgggauucaccauccuggcgcuguuccuggcgcacuacauaggcacgucccugacgcagaaagucguuauuuucauccugcucaugcuggucacgcccucuaugaccaugcggugugugggggucggcaaccgcgacuucguagagggccucuccggggccacguggguagacguaguccuugagcacggcgguugcgugacaacgauggcuaaaaauaagcccacucuggauauagagcugcaaaagaccgaggccacacagcucgccacgcugcgaaaacuaugcauagagggcaagaucacgaauauaaccacugacagccgaugccccacgcagggcgaggccauccuaccggaagagcaggaccagaauuacgugugcaagcauacuuacguggaccgggggugggggaacgguugcggccuuuucgggaagggcucccuaguaaccugcgcaaaauuccagugccucgaacccaucgaggggaagguggugcaguacgagaaccugaaguauaccguaaucauaacggugcacacaggcgaccaacaccaggucggcaacgauacacagggggugaccguggagauaaccccccaggccagcaccgucgaggccguauugcccgaguacggcacccucggacuggagugcuccccgcgcaccggucuggacuucaacgagaugaucuuacucaccaugaaaaacaaggcguggaugguccaucggcagugguucuuugaccugccacuccccuggacgagcggcgccaccaccgagacucccacguggaauagaaaggaguuacuggugaccuucaaaaacgcccacgccaagaagcaggaggugguagugcucgggucucaggagggagcgaugcacacugcccugaccggcgccacggagauacagaacagcggcgggacuucuaucuuugccggccaccugaaaugccgacucaagauggacaaauuagagcugaagggcaugucguacgcaaugugccucaacaccuucguucucaagaaggaggucuccgagacucagcaugggacuauucuaaucaagguggaauacaagggcgaggacgccccgugcaagauucccuucagcaccgaggacgggcaaggcaaagcucauaauggucgcuuaaucacugccaacccgguggucgccaagaaagaggagccggucaacauagaagccgagccgcccuuuggggagagcaacauugugaucggcauuggugacaaggcgcucaagaucaauugguacaaaaagggcaguaguaucgggaagauguucgaggcuaccgcccggggcgcccgccggauggccauacugggcgacacugcgugggacuucgggucagucggcggcgugcugaacagccucggcaaaaugguacaccagauauucggguccgccuauaccgcccucuucucuggcgucuccuggaucaugaagaucggcaucgggguucuguugaccuggauuggccugaacucaaagaacacuaguaugagcuucucguguaucguuauagggaucauuacacuguaccucggcgccguggugcaagcagacauggggugcgcgaucaacuggaaaggcaaggagcugaagugcggcagcgggaucuucgugacaaacgagguucacacauggaccgagcaguauaaguuccaggccgauuccccuaagcggcuggcaacggccauugccggcgcaugggagaacggggugugcggaauccgcucaaccacgcgcauggaaaaccuccuuuggaagcaaaucgccaacgagcugaacuauauuuuaugggagaacaauaucaagcugacuguggucgugggggauaucauaggagugcuagagcaggggaagcgaacgcucacgccucaaccgauggagcugaaguauucauggaagacgugggggaaggccaagaucgucaccgccgagacgcagaacuccuccuuuaucaucgacgggcccaacaccccugagugcccaagcgcgucccgggccuggaacgugugggaggucgaggacuacggauucggaguuuucacuacgaauaucuggcugaagcuccgcgaggugcacacacaaagcugcgaccaccgccugaugagcgccgccaucaaggaugagcgcgcggugcaugcggacaugggcuacuggaucgagucccagaagaacgguagcuggaagcuggaaaaggccuccuucaucgaggucaagacaugcaccuggcccaagucacauacucucugguccaacggggugcuagagucugacauggugauacccaagucucuggcagggcccaucagccagcacaaucaccggccgggguaccacacgcagacggccgggccguggcaccuaggcaaacuggaacuggauuucaauuauugugaggggacuacgguugugaucacggagaacugcgggacccgcggccccucccuccggacaaccacagugagcgguaagcugauccaugaguggugcugucgaagcugcacguugcccccucuccgguacaugggcgaagacgggugcugguacggcauggagaucaggcccaucaacgagaaggaggagaauaugguaaaaagucugguguccgcagggagugggaagguggacaauuuuaccaugggcguccucuguuuagccauauuguucgaagaggugaugcgggggaaauucggcaagaaacacaugauugcggggguacuguucacuuuuguacuccugcugucaggccagaucacuuggcgcgacauggcacacacucucauaaugaucggcagcaacgcgucugacaggaugggaaugggcgugaccuaccucgcccuaaucgcgaccuucaagauacagccauuccuagcccugggguucuucuuacgcaagcucaccucacgggagaaccuguuacucggggugggccuggcaauggcaacuacccugcaguuacccgaggauauugagcagauggcgaacgggaucgcccugggccugaugacgcucaagcugauaacccaguucgaaacguaccaacuguggaccgcacuaguuagccucaccugcuccaacaccaucuucacgcuaaccguggcauggcguaccgccaccuuaauucucgcagggguaucacugcucccacuaugccagucgaguagcaugagaaagacggacugguugcccaugaccguggcagccauggggguuccgccccugccgcuguuuaucuucagccugaaggacacccccaagcgccgcuccuggccccuuaacgagggggucauggccguuggccuggugucgauacuggcaagcagccuccugagaaacgauguccccauggcgggaccgcugguggcugggggccuccugaucgcaugcuaugugaucacagggacgucagccgaccugaccgucgagaaggcggcggaugugacuugggaagaggaagccgagcagaccggcgugucucauaaccucaugaucacggucgacgacgacgguaccaugcgcauaaaagacgacgaaaccgagaauauccugaccguguuacucaaaacugcacuucuuaucgucaguggcaucuuccccuacagcaucccagcuacucuccugguuuggcacaccuggcagaagcagacccagcgguccgguguucuuugggacgugccuucgccgcccgaaacgcagaaggcggagcucgaggagggggucuaccgcaucaagcagcagggcaucuucgguaagacccaggugggcgugggcguacagaaagagggaguuuuccacaccauguggcacguuaccaggggcgcgguccugacccacaacgggaagcgucuggaaccaaauugggcgucggugaaaaaggaccucaucucguacggcggcggcuggcggcuguccgcccaguggcagaaaggggaagaggugcaggucaucgccguggagcccggaaagaacccgaagaacuuccagacgaugcccggcaucuuccagacgaccaccggagagaucggcgcgaucgcuuuagacuucaagccugggacuagcggcagcccgaucauuaaucgagagggcaagguggucgggcuguacggcaacggggugguaacuaagaacgguggguaugucucuggcaucgcccagaccaacgccgaacccgacggccccaccccagagcuugaggaggagguuuucaagaagcggaaccugacgaucauggaucugcacccggggagcggcaagacgcgcaaguauuugcccgccaucguccgggaggcgaucaagcggaggcugcgcacccugauccucgcccccaccagagucguggcugcagaaauggaggaggcccugaaagggcugcccauucgauaucagacaaccgcgacuaaguccgaacacaccgggagggagaucguggaccucaugugccacgcaacuuuuacaaugcgccuacugagcccgguccggguaccuaacuacaaccugauuaucauggacgaggcccacuucaccgaccccgccuccauagcugcgcgaggguacaucucuacccggguggguaugggcgaggccgcagccaucuucaugacggcgacgccgcccgggacugcggaggccuucccccaauccaaugcacccauccaagaugaggagcgcgauauccccgagcgcagcuggaacuccggcaacgaauggaucaccgauuucgucgggaagacggugugguucgugcccaguaucaaggcgggcaacgauaucgcgaacugucugcggaagaaugggaagaagguuauccaauuaucccgcaagaccuucgacacugaauaccaaaagaccagguuaaacgacugggauuucgucguuacgaccgauauaagcgagaugggagcaaacuucaaggcggaccgcgucaucgacccccggcgcuguuuaaaacccgugauccugaccgacggaccggagcggguaauacucgccgguccgaugccugucaccgcugcgucagccgcccagcgccgaggccgcgucgggcgaaacccccaaaaagagaacgaccaguauaucuucaccggccagccccuuaacaacgacgaggaccacgcucacuggaccgaggccaaaaugcugcucgacaauauaaauaccccggaagggauaaucccggcucuguucgagcccgaacgcgaaaaauccgccgccaucgauggcgaguaccggcugaaaggcgaaucccgcaagaccuucguagagcucaugcggcgcggggaccugcccguauggcuggcccacaaaguggcuagcgagggcaucaaauacaccgaccgcaaauggugcuuugacggggagcgcaacaaccagauccucgaagagaacauggauguugagaucuggacaaaagagggggaacggaagaagcugcgaccacguuggcuggaugcccggacauacucagacccccucgcacuuaaggaguucaaggacuucgccgccggccgcaagaguauugcgcuggaucuugucacggagauaggucgugugcccucccacuuggccuaccgcaccaggaacgcucuggauaaccucguuaugcuccacacaagcgaacacggcggaagagcauaucggcacgcaguggaagagcugccggagacuauggagaccuuacugcuccuuggucugaugaucuugcucaccgggggcgcgaugcuuuucuugauaagcggcaaggggaucgguaaaacuuccaucgggcucaucuguguuaucgucagcuccggcaugcuguggauggcugacgugccgcugcaguggaucgccucugccaucauucuggaguucuuuaugauggugcuccugauacccgagcccgagaagcagcguaccccgcaggacaaccagcucgccuacgucguaauugggauucugacccucgcggccaucguggcggccaacgagaugggccuccuggagacuacgaagagagaccugggcaugaguaaggagcccggagucguaagccccaccuccuaucuugacguggaucugcaucccgccagcgcguggaccuuguacgccgucgccacuacagugaucacuccgauguuaaggcacaccaucgagaacuccaccgcuaacgucaguuuggcggccaucgccaaccaggcggucguucugauggggcucgacaaagguuggccuaucucgaagauggaccugggcgucccccugcucgcccuaggcuguuacucucaggucaauccccugacgcucaccgcugccgugcugcuauuggugacccacuacgccaucauuggccccggccugcaggccaaggccacccgagaagcgcagaaacgcacggccgccgggaucaugaaaaaccccaccgucgacggcaucaugaccaucgaccuggaccccgugauuuacgacagcaaguuugagaagcaguuaggccaggugauguuguuaguccucugcgccgugcagcuucuguugaugcggaccagcugggcgcugugcgaggccuugacccucgccaccggccccaucaccacccucugggagggauccccggguaaguucuggaacacuaccaucgccgugagcauggccaacaucuuccgcggcuccuacuuagcgggggccggccuugcauucagcaucaugaagagugucgggacagggcggcggggcaccgggagccagggagagacgcugggggagaaauggaagaagaagcucaaccagcucagccggaaagaauuugaccuauacaagaaguccggaaucaccgagguggaucgcaccgaggcuaaggaagggcugaaacggggcgagacgacccaccacgcagugagccgcggaucugccaagcuccagugguucgucgagaggaacauggucauccccgagggacgggugaucgaucugggcugcgggcgcggcggguggagcuacuacugcgccgguuuaaaaaaggucacggaggucagaggauacaccaagggcggccccggucaugaggagccagugccgauguccacuuauggcuggaaccucgugaagcuuaugagcgggaaggauguguucuaccugccgcccgaaaagugcgacacacugcuuugcgacaucggagagaguucacccucaccgacgguggaggagagccgcacuauccggguccugaagaugguggagcccuggcugaagaacaaccaguucugcaucaaggugcucaaccccuauaugcccaccguaaucgagcaccuggaacgucugcagagaaaauacggcgggaugcuuguccgcaacccgcugucccggaacagcacccacgagauguacuggaucagcaacggcacagggaacaucguaagcagugugaacaugguaucuagauuacuccugaaccgguucaccaugacccaccgccggcccaccaucgagaaggacgucgaucuaggugcaggcacgcgacacgugaacgccgagcccgagaccccgaacauggaugugauaggggaacggauaaagcggauuaaggaggaacacuccucaaccuggcacuaugacgacgagaaccccuacaagaccugggccuaccacggcagcuacgaggucaaggcgacggggagcgccagcuccaugaucaacggcguagugaaacuccugaccaagcccugggaugucguacccauggugacacaaauggcaaugaccgacacgaccccguucgggcagcaacgggucuucaaagagaaaguagacacccguacgccccggccaaugcccggcacgcguaaggugauggagaucaccgcagaauggcuguggcggacccuagguagaaauaaaaagccgcgccugugcacgcgggaagaguucacgaagaagguccgcaccaacgccgcgaugggugccgucuuuaccgaagagaaucagugggacagcgcccgugccgccguggaggacgaagaguucuggaaguuaguggaccgcgaacguaagcuccacaagcugggcaaaugcgggaguugugucuauaacaugaugggcaagcgcgagaagaagcugggugaguuuggcaaagccaagggcagucgggccaucugguauauguggcucggggccagauaccuggaguucgaggcacugggguuccuaaacgaggaccacugguuuagucgggagaacagcuacagcgggguggaaggggaggguuugcauaagcugggguauaucuuacgcgauaucuccaagauccccggcggggcgauguacgccgacgacaccgcggguugggacacucggaucaccgaagacgaucugcacaacgaagagaagaucacccagcagauggaccccgaacaucgccagcuugccaacgccauuuuuaaguuaacauaccagaauaaggucgugaaaguccagagaccuacgccaaagggcaccguaauggacaucaucucacggaaggaccaacgcgguagcggccagguggggaccuacgggcugaauacuuuuacuaacauggaagcccagcuaguacgccagauggaaggggaaggcguacucuccaaggccgaucuugagaauccgcaucuauuagagaagaagauaacacaguggcuugaaacaaagggcguugaacgacugaagcgcauggcgaucaguggggacgacugcguggucaagcccaucgaugauagguucgccaacgcccuccuggcgcucaaugacaugggcaaggugcgcaaagacaucccccaauggcaaccguccaagggguggcacgacuggcagcaaguacccuucuguucucaccacuuucacgagcucauaaugaaagaugggcguaaacucguagugcccugccgaccccaagacgagcucauagggcgcgcccggaucucccagggcgcuggguggagccucaaagagacggcgugcuuggggaaggccuacgcgcagauguggucccugauguacuuccaccgacgugacuugcgccuggccucaaacgccaucugcuccgcggugccgguccauuggauacccaccagccgcacgaccuggagcauccacgcgcaucaccaguggaugaccaccgaggauaugcuaaccguauggaaccgagucuggaucgaggacaacccguggauggaggacaagacccccgucaccacuugggaggaugugccguaccucggaaagcgggaggaccaguggugugggucccugauaggccugacaagccgcgcgacuugggcccagaacaucuugacagccauacagcagguccggucccugaucggggacgaggaauuccuggacuacaugccuucgaugaagcgcuuccggaaggaggaggagagcgagggcgccaucugguga

SEQ ID NO: 26117 - RNA, 9873 nt, Artificial Sequence
  derived and/or modified CDS sequence (opt11) from DENV-3__FJ562099__SS-prME
accagccuaugccuuaugaugaugcugcccgcgacccuggccuuccaccucaccagcagggacggcgagccgcggaugaucguggggaagaacgaacggggcaaaagccucuuguuuaagaccgcauccgggauuaacaugugcacucucaucgccauggacuugggugaaaugugcgacgacaccgucacguauaaaugcccccugaucgcggaggucgagcccgaggacaucgauugcuggugcaaccuuacuagcacauggguuaccuaugggacgugcaaccaggccggcgagcaccggcgagacaagcggucugucgcccucgcgccccacguggggauggggcuggacacccguacccagaccuggaugagcgccgagggcgccuggcgucaaguggaaaaggucgagacgugggccuugcgccacccgggguucaccauccuggcuuuguuccucgcacacuauaucggcaccagccugacccagaaaguggucauauucauccugcucaugcugguaacucccagcaugaccaugcggugcgugggggugggcaaccgagauuucgucgagggccugucuggcgccaccuggguggacgugguccucgagcacggcgggugcgugaccacgauggccaagaacaagcccacucuggacaucgagcugcagaaaaccgaggcuacacagcucgcgacguugcggaagcuguguaucgagggcaagaucaccaacauaaccaccgacucucgcugcccuacgcaaggagaggccauacucccggaggagcaggaccagaacuacguguguaagcauaccuacgucgaccggggguggggcaacgggugcggcuuguucgggaagggcucccuagugacaugcgcgaaguuccagugccucgagcccaucgagggcaaagugguccaauacgagaaccucaaguacaccgugaucaucacggugcacaccggggaccagcaccaggucggcaacgauacccagggggucacuguggagaucacuccgcaggccagcaccguggaggcggugcugcccgaguauggaacccucgggcuggagugcuccccgcgcaccggccuagacuuuaacgagaugauccuccucacuaugaaaaacaaggcguggaugguccaucggcaaugguuuuucgaccugccucuuccguggacuucgggcgccacaaccgaaacccccacguggaacaggaaagagcugcuggugacauucaagaaugcccacgccaagaagcaggaaguugucgugcucgguagucaggagggcgccaugcacaccgcgcugaccggugccacggagauccagaacucuggcgguaccucgaucuucgccggccaucugaagugccguuugaagauggacaaauuggagcugaagggaaugagcuacgcaaugugccucaacaccuuugugcuuaagaaggaggucuccgagacccagcacgggacgauucugaucaagguggaguacaagggcgaggacgccccguguaagauccccuuuagcaccgaggacggccaaggcaaggcgcacaacggucgccugaucacggccaacccuguggugaccaagaaggaggagcccgugaacauugaagccgagccgcccuuuggggagagcaacaucgugaucggcauuggagacaaggcgcucaagaucaacugguacaagaagggcucgucaaucggcaagauguucgaggcgacggcccgaggcgcccgccgaauggcuauacugggcgauaccgccugggacuucgggagugucggcgguguucugaacagccucggcaagauggugcaccagauauucggauccgcguauaccgcccuauucagcggcguguccuggaucaugaagaucggcaucggggugcugcucaccuggaucggcuuaaacagcaaaaacacgagcaugucuuucuccuguauagugaucgggaucaucacccuguaccucggcgccguuguucaggccgacauggggugcgugauuaauuggaagggcaaggaacugaagugcggcucugguauauucgucaccaacgaggugcacacuuggacggaacaguacaaguuucaagccgauucacccaagcgccuggccaccgccaucgccggcgccugggaaaacgggguuugcggcauccgcagcaccacacgcauggagaaccuccuuuggaagcagaucgcaaacgagcugaacuacauccucugggagaacaacaucaagcugacggucguugugggggacaucauaggcgugcucgagcaggggaagcggacccucacgccccagccgauggagcugaaguauuccuggaagaccuggggcaaggcgaagauuguaacggccgaaacccagaacuccuccuucaucaucgaugguccuaauacccccgagugcccaucggccucccgggccuggaacguuugggaggucgaggauuacggguucggcguguuuaccacgaacaucuggcuaaagcuccgcgaaguauacacccagagcugcgaccaccggcuaaugagcgccgccaucaaagaugagcgcgcagugcacgccgacaugggcuacuggauagaaucccagaagaacgguucguggaagcuggagaaggccucauucaucgagguaaaaaccugcaccuggcccaaaagccacacgcuguggaguaacggcgugcuggagagcgacaugaucauucccaagucccuagccgggcccaucagccagcacaaccaccggcccggcuaccacacgcagacugccgggccguggcaccuagggaagcuggagcuugacuucaauuacugcgagggcaccacggucgugaucacggagaacugcgggacccgcgggcccuccuuacgcacaaccacggugagcgggaagcugauucacgaguggugcugccgcuccugcacccugccaccgcuccgguacaugggcgaggacggcugcugguacggcauggagauucgcccuaucaacgaaaaggaggagaacauggucaagagccugguauccgccggcuccggcaaggucgauaacuucaccaugggcguccugugccucgccauccuguucgaggaggugaugcgggggaaguucggaaagaagcacaugaucgcaggcguacucuucaccuuuguccuccuccuuucgggacagaucacauggcgcgauauggcacacacccucaucaugaucggcagcaacgccagcgaccguauggggaugggcguaacguacuuggcccugaucgccaccuuuaagauccagccauuccucgcccugggguuuuuccugcgcaaacucacgagcagagagaaucugcugcucggcgugggucuggcgauggccacuacgcuacagcuacccgaggauaucgaacagauggccaacgggaucgcacugggccugaugacacucaagcugaucacacaguucgagaccuaucagcuguggaccgcgcucgucagccugaccugcuccaacacgaucuucacccugaccguggccuggcgcaccgccacgcucauccuggccggugucagccugcuaccgcugugccaguccagcuccaugcggaagaccgauuggcugcccaugacugucgccgcgaugggcgugccgccccugccacuguuuauuuucagccugaaggauacccccaagcgucgcuccuggcccuugaacgagggggucauggcggugggucuggugagcauucuggccuccagcuuacugcggaacgacguccccauggccggcccguugguggccgggggccuccugauugcgugcuaugugauaacuggaaccuccgccgacuuaaccgucgaaaaggcugcagacgucacaugggaggaggaggccgagcagacgggcgugagccacaaucucaugaucaccgucgacgacgacgggaccaugcggaucaaggacgacgagaccgagaauauccucacggugcugcucaagacggcguuacugauugugaguggcgucuuccccuacagcauccccgccacccugcugguguggcacacuuggcagaagcagacccagcgguccggcgugcugugggacguccccagcccgccagagacgcagaaggccgagcucgaggaggggguauacagaauuaagcagcagggcaucuucgguaaaacccaggugggcgucgggguucagaaggagggcguauuucacaccauguggcacgugacgcggggcgccgugcugacgcacaaugggaagcgcuuagaacccaacugggccuccgugaagaaggaccucauaagcuacggcgggggcuggcgguuauccgcgcaguggcaaaagggggaagagguccaggugauugccguggagcccggcaagaacccgaagaacuuccagaccaugcccggcaucuuccagaccaccacgggggaaaucggugcaaucgcccuggauuuuaagccugggaccagcggcaguccgaucaucaacagggaaggaaagguagugggucuguacggcaacggcgucgucaccaaaaauggcggcuacguguccgguaucgcacaaacaaacgccgagcccgacggccccacgcccgagcucgaggaggagauguucaagaaacggaaccuuaccaucauggaccugcauccggguucuggcaagacccgcaaguaucuccccgccaucgugcgggaggccaucaaacgccggcugcgcacccugaucuuggcccccacgcgggucguugccgccgagauggaggaggcacucaagggccuucccauccguuaccagacaaccgccaccaaguccgagcauacggggcgggagauuguagaccucaugugccacgccacuuucaccaugcgccugcuuagcccagugcggguuccaaacuacaaccucaucauaauggacgaggcgcacuucacugaccccgccuccaucgccgcccggggguacauaagcacacgggugggcaugggcgaggcggcggccaucuucaugaccgcaaccccgccggggacugcagaggccuucccgcaguccaaugcccccauccaagacgaggagcgcgacaucccugagagaagcuggaacaguggcaacgaguggaucacggacuucguggggaagaccgugugguucguacccaguaucaaggccggcaaugacaucgccaauuguuuaaggaagaauggcaagaaggucauccagcugucccggaaaaccuucgacaccgaguaccagaagacgaaacuaaacgacugggacuucguggucaccaccgacaucagcgagaugggcgccaauuucaaggccgaccggguaauagacccccgccggugccuaaagcccgucauccugaccgacggacccgaacggguaauccucgccggcccaaugcccgucacggccgccuccgcagcucaacggcgaggccgggugggcaggaacccccaaaaggagaacgaccaguauaucuucaccggccaaccccugaacaacgaugaagaccaugcccacuggaccgaggcuaagaugcugcucgacaacaucaacacuccggaggggaucauccccgcccuguucgagccagagcgggagaaguccgccgccaucgauggagaguaccgcuugaagggcgaaagucggaagaccuucguggagcucaugcgcagaggggaccuacccguguggcuggcccacaagguggccagcgaaggcaucaaguacacggaucgcaaguggugcuucgacggggagcggaacaaccaaauccucgaagaaaacauggacgucgagaucuggacaaaggagggcgagcgcaagaaacugcggccgcgcuggcucgacgccagaaccuacuccgacccguuggcguugaaggaguucaaagauuucgcggccggccgcaaaagcaucgcccuugacuuagugaccgagaucgggcgcgugcccucccaucuggccuaucggacucgcaacgcacuggacaacuuagucaugcugcacaccagcgaacacggcggccgggcuuaccggcaugccguggaggagcugccugagacgauggaaacacuacuguugcugggccugaugauccuguugaccggcggggccaugcuguuucugaucagugggaaagggaucgggaagacguccauuggacucaucugcgugaucguuagcucuggcauguuauggauggccgacgucccccugcaguggaucgcgagcgcgaucgugcucgaauuuuucaugaugguccugcugauacccgagcccgagaagcagcggacgccccaagacaaccaguuagccuacgugguaaucggaauccuuacccuagccgccauagucgcugccaacgagaugggccuccuggagacgaccaaacgcgaccugggcaugaguaaggagccugggguggugagccccaccucguaucucgauguggaucugcaccccgcaagcgcauggacucuguacgccguggcgacgaccguuaucacgccgaugcuacggcacacgaucgagaacuccacggccaacgugagccuggccgccaucgcaaaucaggccgugguguuaaugggucucgacaaaggguggccaaucuccaagauggaccugggcguccccuuacucgcccuggggugcuacucucaggugaacccacuuacgcuaacugccgccguccuguuacucgucacucacuacgcgauaaucggcccuggccuccaggccaaggccacgcgcgaagcccagaagagaacggccgcgggcaucaugaagaaccccacaguggacggcaucaugaccaucgaccuggacccugugaucuaugacaguaaguucgagaagcagcucggacaggugaugcugcuggugcucugcgcugugcagcugcugcucaugcgcacaagcugggcccugugugaggcccugacccucgcuaccggcccgaucaccacgcugugggagggcuccccugggaaguucuggaacacaaccauagcggucaguauggcaaacaucuuucggggauccuaccuggcaggggccggccucgcauucagcaucaugaaaucuguggggacgggacgcaggggcacggggagccagggagagacccucggcgagaaauggaagaagaagcugaaccagcucucacgcaaggaguucgaccuauacaaaaagaguggcaucaccgagguggaccggacugaggcuaaagaagggcuuaagcgcggugagaccacccaucacgcagucagucggggcuccgccaaacuccagugguucguggagcguaacauggugauuccugagggucggguuauugaucuggggugcgggcgcggcggguggagcuacuacugcgccggcuugaagaaggucaccgaggugcgaggcuacaccaagggcggcccgggccacgaagaacccgucccaauguccacuuacggauggaacaucgugaagcucaugagcgggaaagacguguucuaucugccuccagagaagugcgacacgcugcuuugcgacauuggcgaauccucacccuccccgaccguugaggagagccggacaaucagggugcucaagaugguggagccuuggcugaagaacaaccaguuuuguaucaagguccugaacccauacaugcccaccgugauugagcaucucgagagacuacagcgcaaguacggcgggaugcuggugcgcaacccgcucuccagaaacagcacgcacgaaauguacuggauuuccaacggcaccggcaacaucgucagcuccgugaacauggucagccgucugcugcucaaccgcuucaccaugacccaccgucggcccacuaucgagaaggacguggauuugggcgcgggcacccggcaugugaaugccgagcccgagaccccgaacauggacgucauuggcgagcguaucaagcggaucaaagaggagcacagcagcaccuggcacuaugacgacgagaaccccuacaagacgugggcuuaucacggcuccuaugaggugaaggccaccggaucggcuagcuccaugaucaacggcgugguaaaacuucucacaaaaccaugggacguggugcccauggucacucagauggcgaugacggacacuaccccguucgggcagcagcggguguucaaggagaagguggacacucguacgccccgaccuaugcccggcacccggaaggucauggaaaucaccgccgagugguuguggcgaacacuaggucggaacaagaaaccacgacugugcacccgcgaggaguucaccaaaaaggugcggaccaaugcagccaugggggccguauucaccgaggaaaaccagugggacagcgcgcgugccgccgucgaggacgaggaguucuggaagcugguagaucgggagcgcgagcugcauaagcuaggcaagugugguuccugcguguacaacaugaugggcaagcgcgagaagaagcugggagaguucggcaaggcuaaggguucccgagccauaugguacauguggcugggggcccgguaucucgaguucgaggcccugggauucuuaaaugaggaucacugguucucccgcgagaacagcuacuccgggguagagggcgaggggcugcacaaacuuggcuacauccugcgggacaucagcaagauccccggcggggccauguacgcugacgacacugcuggcugggacaccaggauaacggaggacgaccuccacaacgaggagaagaucacccagcaaauggaccccgaacaccggcagcuggcuaacgccaucuuuaagcugaccuaccagaauaaaguagucaagguacagcgccccaccccgaagggaacggugauggacaucaucagucggaaagaucaacgcggcagcggccagguaggaaccuacggccucaacaccuucacgaacauggaggcccaacugguccggcagauggagggggagggaguccuguccaaagcagacuuggagaauccccaccuccuggaaaagaaaauaacacagugguuagagaccaaggggguggagcgccugaagcggauggccauaagcggcgacgacugcguaguuaagcccauagacgaucgguucgcuaacgccuuacucgcacugaacgacaugggcaaggugagaaaggacauuccgcaguggcaaccguccaaaggguggcacgacuggcaacagguccccuucuguagccaccacuuccacgagcugaucaugaaggacggcaggaagcucgucguucccugucguccccaggacgaacugaucggucgcgcccgcaucucgcagggugcgggauggagccugaaagagacugccugccucggcaaggccuacgcccagauguggagccugauguacuuccaccggcgcgacuugcggcucgccagcaacgcgaucugcucugccguuccggugcacuggauuccuacaucccgcaccaccuggucaauccacgcccaucaucaguggaugaccacggaggacaugcugaccguuuggaaccgugucuggaucgaggacaaccccuggauggaggacaagacuccugugaccaccugggaggaugugccguacuugggcaagcgggaggaccaauggugugggucccucaucggcuuaaccucccgggccaccugggcgcagaacauccugaccgcaauccagcaaguccgcucccucauaggugaugaggaguuccuggacuacaugcccucgaugaagcgguuccgcaaggaggaagaguccgagggcgccaucugguga

SEQ ID NO: 26118 - RNA, 9873 nt, Artificial Sequence
  derived and/or modified CDS sequence (opt11) from DENV-3__KF955457__SS-prME
acuagccucugccucaugaugaugcuaccggcuacacuagcauuccaccuaacgagccgagacggggagcccagaaugaucguagggaaaaacgaacgcgggaaauccuuguuauucaaaaccgccucgggaauuaacaugugcacacugauagcgauggaccugggggaaaugugugaugacacgguuaccuacaaauguccuuuaauugcggaaguagaacccgaagauauagauuguuggugcaauuugacuucaacauggguaacuuacggaaccuguaaccaagccggggaacaucggcgagauaaacggagcguagcgcuagccccacacguugggaugggacuggauacucggacucaaacuuggaugagugcugaaggagccuggcgccaaguggaaaaaguagaaacaugggcgcuccgacauccaggauuuacaauccuagcacuguuccuggcccacuacauagguacguccuugacgcaaaaagucguaauauucauccuccucaugcucgugacacccagcaugacuaugcgaugcgucggaguaggaaaccgugacuuugucgaaggguuguccggagcaacauggguugacgucguccuagagcacggagggugcguuaccacgauggcgaaaaacaaacccacacuugauaucgaacuccagaaaaccgaagcuacgcaacuggccacacugagaaaacuuugcauagaagggaaaauaacgaacaucaccacggacaguaggugccccacccaaggagaagccauucucccagaagaacaagaccaaaauuauguaugcaaacacacauaugucgaccgcggcuggggaaacgggugcgggcuauucggcaaagggucauuggucacaugcgccaaguuucaaugucuagaacccauagaaggaaaggugguccaguacgagaaccucaaauacacaguaaucauaacagugcauacaggggaucagcaccaagucggcaacgacacacaaggugcaaccgucgaaauaaccccacaagcgaguacagucgaggcagugcucccagaauacggcacccuuggacucgaauguuccccacggaccggccucgauuuuaaugaaaugauccugcucacuaugaaaaacaaagcguggaugguccaucgacaaugguucuucgacuuaccccuuccauggacaaguggggcaaccacggaaacucccacauggaaccgaaaagaauuauugguaacauucaagaacgcccacgccaagaaacaagagguggucguacuaggaagucaagaaggagccaugcacacagcucuaaccggugcaacagagauacagaacagcggcggaaccuccaucuuugccggacaccucaaaugccgccuuaaaauggacaaacuagagcuaaagggcaugagcuaugccaugugccuaaacacauucguacucaagaaagaagucagugagacacaacacggaaccauacuaaucaaagucgaauacaaaggugaagacgcccccugcaagaucccuuuuucaacagaagauggccaaggcaaagcgcacaauggccgcuuaaucaccgccaacccagucguuaccaagaaagaggaacccguaaacauugaggccgagccacccuuuggcgagagcaacauuguaauaggcauuggagauaaggcacuuaaaauaaacugguauaagaaagggaguucgauagguaaaauguuugaagcaacugcaagaggugccagacgaauggccauacuuggagacacagcgugggacuucggcuccgucggcgguguccuaaauucacuggggaaaaugguucaccagauauucggaagcgccuacacagcacucuucucuggagugucguggauaaugaaaauaggaaucggagugcuacugacguggaucgggcucaauagcaagaacaccagcaugagcuucagcugcauaguuaucggcaucaucacgcucuacuuaggcgccguuguacaagccgacaugggaugugccaucaacuggaaaggcaaagaacugaagugcgguuccggaauauuugugacaaacgagguccacacuuggacagagcaauauaaauuccaggcugacuccccgaaacgucuggccacggcaauugcgggugccugggaaaauggugucugugggauccgcuccacaaccagaauggagaaccuucucuggaaacaaaucgccaaugaacugaauuacauauuaugggaaaauaacauaaaacuaacgguaguaguuggcgacaucaucggcgucuuggaacaggguaagagaacgcuaacaccacagcccauggagcuaaaauacucguggaaaaccuggggaaaggcaaagauagucaccgccgagacccagaacuucucauuuauuauagauggccccaacacucccgaaugcccguccgcuagucgggcauggaauguaugggaaguggaagacuacggcuuuggaguguucacaaccaauaucuggcugaaacuuagagaagucuauacacagucaugcgaucacagacuaaugagcgcggcaaucaaggacgaacgagcuguccacgccgauaugggguacuggauugaaucacagaaaaacggaucauggaagcuggaaaaggcgucguuuauugaaguaaaaaccuguacauggccaaaaucucacacacucugguccaauggcguuuuggagagcgacaugauaauaccaaagagccucgcgggucccauaucacaacacaaccacaggccuggcuaccacacacaaacagcaggaccauggcaccuaggaaaacuggagcuggauuucaacuacugugaaggaacaacaguugucauaacggaagauugcggaacccgcgggccuagccuccggacgacaacggugucuggcaaacucauacaugaguggugcugccggucaugcacauuaccaccacuacgguacaugggcgaagacgggugcugguacggcauggagauucggcccauaaacgagaaagaagaaaacaugguaaagucacucguuucggcaggaucaggaaagguagacaacuucacaauggggguccucugucucgcgauccucuucgaagaggugaugaggggcaaguucggcaagaaacacaugaucgccgggguguuauucaccuucguucugcucuugagcggacagauuacauggagagacauggcccacacuuuaauaaugaucggcagcaacgccagugaccgcaugggcaugggagugacauaccuggcccuuaucgcgaccuucaagauccagcccuuucuggcccuuggauucuuccugcgcaagcucacgucccgugaaaacuugcucuuaggaguaggacuagcaauggcgaccacacuucagcuccccgaggauauagaacaaauggccaacggcaucgcguuggggcucaugacccugaaacuaaucacgcaauucgaaacauaccaacucuggacagcccucgucaguuugacaugcagcaacacaauauucacuuuaaccguggccuggcguaccgcaacccuuauucuugcgggagucagccuauuaccucuaugccagagcucauccaugcgcaaaacugauuggcucccuaugacagucgcagcgaugggcgucccuccccuaccacucuucauuuucucgcuaaaagacacucccaagcguagaagcuggccacucaacgagggggugauggcggucgggcuggucagcauacuggccucaagccucuugcgcaaugacgucccgauggccgguccccuagucgcuggagggcuacucaucgcaugcuacgugaucacagguacguccgccgaccuaaccguagagaaagcggcagacgugaccugggaggaagaagcagagcaaaccggcgugucgcacaauuuaaugaucaccguggacgacgacggaaccaugagaauaaaggacgacgaaacagaaaacauacucacggugcuccuaaaaaccgcacuucuaaucgugaguggcauauuccccuacucuauccccgcgacacuauugguguggcauacauggcaaaaacagacgcaacgcuccggaguacuaugggauguaccgucaccucccgaaacacagaaggcggagcuagaagaaggcguauaucggauaaaacaacagggcauauuugggaaaacccaaguggggguaggaguccaaaaagaaggggucuuccacacuauguggcacgucacacgcggcgcaguccuaacacacaacgggaagcggcucgagccaaauugggcaucgguaaagaaagaccuuauaaguuacggcggagguuggcggcucucagcacaauggcagaaaggggaggaaguccagguaaucgccguagagccgggcaaaaaucccaaaaauuuccagacaaugccaggaauauuccaaacaaccacgggggagauaggcgcuaucgccuuagacuucaagccaggaacaucaggaucaccgauuaucaaccgcgaagggaaaguggugggacuguauggaaacggagucgugaccaaaaauggaggauacguuagcggcauugcacagaccaacgcggagccagacggaccgacuccggaacuagaagaagagauguucaaaaagcgaaaccugacuauaauggaucuucaccccggaagcggcaagacaaggaaauaucuacccgccaucguccgggaggcaauuaagagaagacuaaggacccucauauuggcgcccacaagggucgucgcagccgaaauggaagaagcucugaagggccucccaauacgguaucagaccacagccacuaaaucggaacacacgggacgggagauaguagaucugaugugucacgcaaccuucaccaugcgccugcuaaguccaguuagaguacccaauuacaaccucauaauuauggacgaggcucacuuuacagacccagccucgaucgcugcccgaggauacaucagcacccgcgucggcaugggcgaggcggcggcaauauucaugacggcaacaccaccgggaacagcagaggccuucccacaaaguaaugcccccauucaagacgaggaacgagacaucccagagaggaguuggaauagcggaaacgaauggauaacagauuucguaggaaagacuguaugguucgucccgucaauaaaagcaggcaacgauaucgcuaauugccuacgaaagaacggcaagaaaguaauacagcuaaguagaaaaaccuucgacacagaguaccaaaagacgcgccucaacgacugggauuucguggugacuacagacaucucagaaaugggcgcaaacuucaaagcggauagagucauagacccaaggcguugccugaaaccagugauccuaacagauggcccagagaggguaauauuagcggggccaaugccaguuacagcggcgagcgcugcgcagagaaggggccgcgucggaagaaacccgcagaaggaaaacgaccaauacaucuuuacagggcagccgcuaaacaacgacgaagaucacgcccauuggacagaagccaaaaugcuacuggacaauaucaacacaccggaaggaauaauaccggcguuguuugaaccggagcgggagaaauccgccgcuauagauggggaauaccgacuaaagggcgaaagcagaaaaacauucgucgaacucaugagacgcggcgaccucccaguauggcuugcucauaagguagcgagcgagggcaucaaguacacagacaggaaauggugcuucgauggggaacgcaacaaucagauauuggaagaaaacauggacguagaaauuuggacgaaggaaggcgagcgaaagaaacuucgcccacgauggcuagacgcacggacguauucggacccguuggcacucaaagaguucaaagacuucgcggccggcaggaaauccauugcgcucgaccucgugacagagauagggcgaguucccucccaccuagcguaccggacacguaacgcacuagauaaccuagucaugcuacacaccagcgagcauggcggacgagcuuaccgacacgcgguagaggaacuuccugaaacgauggagacccuccuuuugcuuggccucaugauacuacuuacaggaggggcaaugcuauuccuaauauccggcaaaggcaucggaaaaacgagcaucggcuugauaugcgucaucguaagcagcggaaugcucuggauggcagacguaccccuccaauggauagccucggcaaucgugcuagaguucuucaugaugguguugcucaucccagagccggaaaaacaacgaacaccacaagauaaccagcucgcauacguggugauaggaauccucacccucgcagcaauaguagccgcuaacgaaaugggguugcucgaaaccaccaagcgugaccucggaaugucaaaggaaccuggaguagucucgcccacgagcuaucucgacguagaccuccacccugcauccgcguggacccucuacgccguugcaaccacgguuauaacccccaugcucaggcacacgauagagaacagcacggcuaacgucucgcuagcggcaauagcaaaccaggcggucguccugaugggucucgauaagggcuggcccauaucaaaaauggaccuaggaguucccuuacuggcgcuuggcugcuacagccaaguaaauccccuaacacuuaccgcugcuguacuccuacuugugacgcacuaugcaauaaucggcccuggacuacaagccaaagcgacccgggaagcgcagaagcgcacggcggccggaaucaugaaaaaucccacaguagacgggaucaugaccauugaccucgacccggucaucuacgacagcaaguucgagaagcagcuaggacaagugaugcugcuaguacucugugcuguccaacuuuugcuuaugcgcacaucaugggcucuaugcgaggcccucacccuagcaacagggcccauaacaacccuaugggaaggcucuccaggcaaauuuuggaacacuacaauugcaguuagcauggcgaauauauuccguggauccuaucucgccggcgccggccuggccuuuucuaucaugaaaucagugggcacaggccggagggggaccgguagccaaggcgaaacccuaggcgaaaaauggaagaaaaaguuaaaccaacugucaagaaaggaauuugacuuauauaaaaaguccggaaucacagaagucgaccgaacggaagcaaaggagggcuuaaaacggggcgaaacgacccaccacgccguuagcagggguuccgccaaguuacaaugguuugucgauaggaauauggugauccccgaaggacgcgucauugaccugggaugcggacgcggaggauggagcuacuacugugcugggcucaagaaaguaaccgaagugcgcggauacacaaaaggcggacccgggcaugaagaaccggugccgauguccaccuacggcuggaaccuggucaagcucauguccggaaaggacguauucuaccuaccacccgaaaaaugcgacacauuauugugcgacauaggagagucaucaccgucgccaacaguggaagagagcagaacgauaagaguguuaaaaauggucgagccguggcugaagaacaaccaauucugcaucaaaguacuuaaccccuauaugccaacagucauagagcaccucgaaagacuccaaagaaaauacggagggaugcugguccgaaauccuuuaaguaggaacucuacgcacgagauguacuggauuaguaacggaacaggcaauauaguuucauccgucaauaugguaagcagacuccuccucaaccgcuuuaccaugacccauagacgcccgaccauagagaaagacgucgaccugggcgccgguacgcgccacguuaacgccgaaccagagacucccaacauggacgucaucggggaacgaaucaaacgaauaaaagaggaacacaguuccacuuggcacuacgaugaugagaauccauauaaaacuugggcuuaucauggaagcuacgaagugaaggcuacggggucagccucuaguaugaucaauggggucguaaaguugcuaacgaagcccugggaugucgucccaauggucacacagauggccaugacugauacaacgccguucgggcaacagcggguauucaaagagaagguugacacaagaacaccacgcccgaugccagggacacgcaaggugauggagauuacagcggaauggcuauggcgaaccuuaggaagaaacaagaaaccccgucucugcacccgcgaggaguuuacaaagaaaguaagaaccaacgccgcaaugggggcgguguucacggaagagaaccagugggauucugccagggcggccgucgaagacgaagaauuuuggaaacucgucgacagggagagagaauuacacaaacuggggaaaugcggcuccugcguauauaauaugaugggaaaaagagagaagaaacucggggaguucggaaaggccaagggcucacgagccauuugguauauguggcuaggggccagauaccuugaguucgaggcgcucggcuuccucaacgaagaccauugguucuccagagaaaauuccuacucaggaguagagggcgaagggcuccauaagcucggguacauacuucgggauaucaguaaaauaccuggcggugcaauguaugcagacgacacggcgggcugggacacuaggauaacggaagacgacuugcauaacgaagagaaaauaacucagcagauggaucccgaacaccggcagcucgcgaacgcaaucuuuaagcuaacauaucaaaacaaagucguaaaagugcagaggccaacaccaaaaggaaccgugauggauauaaucucucgcaaggaccagcgcggaucgggccaaguggggacauacgggcugaacaccuucacgaauauggaagcacagcuagugcgucaaauggagggagagggcgugcucagcaaagccgaccuagagaacccucaccuauuagagaaaaagaucacccaauggcucgaaacgaaggguguugaacgauuaaagcgcauggcgaucucgggcgacgacugcguagugaagccuauagacgaccgguuugcuaacgcgcuacucgccuuaaacgacaugggaaaaguacgaaaggacauaccucaauggcaaccuagcaaaggguggcacgacuggcagcaaguacccuuuugcagccaccauuuucacgaacuaauaaugaaggacggccgaaagcuggugguaccuugucguccgcaagacgagcugaucggaagggccagaaucucacagggggcaggcuggagccuaaaggaaacagccugccuaggaaaggccuacgcccaaauguggucuuuaauguacuuccaccgacgagaccugcggcuagccucaaacgcaauuugcagcgccgugccgguccauuggaucccgacgagccgaacgacguggucgauacacgcgcaccaucaauggaugaccaccgaagacaugcucacaguauggaacagaguuuggauugaagacaacccauggauggaagacaaaacaccugucacaacaugggaagacgugccauaccucggcaaaagggaagaccagugguguggcagcuuaaucggauugacgucccgagccacgugggcacaaaacauccuuaccgcaauucagcaaguacgcucgcucauaggggaugaggaguuccucgacuauaugcccagcaugaagagguuccggaaagaagaagaaagcgaaggggcaaucugguag

SEQ ID NO: 26119 - RNA, 9873 nt, Artificial Sequence
  derived and/or modified CDS sequence (opt11) from DENV-3__FJ562100__SS-prME
acgagcuuaugccuaaugaugaugcuacccgccacacucgccuuccaucucacaucgcgagauggugaaccucgcaugauagucgggaaaaacgaacgcggaaaaucccugcuguuuaaaacagccucaggcaucaacaugugcacccuuauagccauggacuugggggaaaugugugacgauaccgucacguacaaaugcccgcuaauugcugaaguggaaccagaggacauugauugcuggugcaaccucaccuccacaugggugacuuauggcacaugcaaccaagcaggcgaacacaggcgcgauaaaaggucgguugcucucgccccacauguagggaugggccuagauacacguacacaaacguggauguccgccgaaggagccuggcgacaagucgaaaaaguugagacaugggcacuacggcacccuggcuucacuaucuuagcgcuuuuccuagcacauuacauaggcaccucacucacucagaaaguugugauauucauacuccuuaugcuaguaacacccagcaugacaaugcgaugcgucggaguuggcaaucgagauuuugucgaagggcuuucaggugcgacguggguagacguggugcuagaacacggcgguuguguaacgaccauggccaagaauaaacccacucuagauauagaacuccagaaaacugaggcgacgcaauuggcaacucuacggaagcugugcauagaaggcaaaaucaccaauaucacaaccgacucccgaugcccaacacaaggggaagcaauccugcccgaggagcaagaccaaaacuauguauguaagcacaccuauguggaucgugguuggggcaacgguugcggucuuuuugggaaagggucauuaguaaccugcgcgaaauuucaaugucucgagccaauagaaggcaaagucgugcaauacgaaaaccugaaguacaccguaauaauaacgguccauacaggagaccagcaccagguaggaaacgacacacagggcgugacaguagaaaucacgccacaagcaagcacaguggaggcaauucuacccgaguauggcacacuaggguuggaauguaguccgcgaacaggucuagauuuuaacgagaugaucuuacucacaaugaaaaauaaagcauggaugguccaucgccaaugguucuucgaucucccgcuaccguggacuuccggcgcaacaaccgaaaccccaacauggaaccgaaaggaauuacucgugacauucaagaacgcccacgcuaagaaacaggagguaguaguguuagggagucaggaaggcgcgaugcacacggcacuaacaggcgcaacagaaauccaaaacuccggaggcaccucaauuuucgcuggacaucucaaaugucggcucaagauggauaaacuugaacuaaaaggcaugagcuacgccaugugccucaacacauuuguccuuaagaaagaggugucagagacccaacacggaacaauacuaauaaaagucgaauacaagggagaagacgcacccugcaaaauaccguucaguacggaggauggucagggaaaagcccacaauggacgccucauaaccgcuaacccgguugugacgaagaaagaggaacccgugaauauugaggcugagccaccauuuggagaaaguaauaucgucauaggaauaggagauaaggcccuaaaaaucaacugguacaagaaggggucaaguauaggcaaaauguucgaggccaccgcccgaggugcaagacgcauggcaauccuaggcgacaccgccugggauuucgguucagucgggggagucuuaaacaguuuggguaaaaugguacaccaaauauuuggcucugcauauacagcccuauucuccgggguaagcuggaucaugaaaauaggcauaggaguccuacucacguggaucggcuuaaacagcaagaacaccaguaugucguucucguguauaguuauuggaaucauuacccuauaccugggggccguaguccaagcggauaugggcugcgcaauuaacuggaaaggcaaagaacuuaaaugcggcagcgggauauucguaaccaacgagguacacacauggaccgagcaauacaaguuucaggccgauagcccaaaacgccuagcgaccgcaauagcaggagcgugggaaaacggcgucugcggaauccgcagcaccacacgaauggaaaauuuacuuuggaaacagauagcaaacgaacucaacuacauauuaugggaaaacaacauaaagcucaccgucguugucggagacaucauaggcguccuagaacaaggcaagcggacccucaccccgcaaccaauggaacuuaaauacagcuggaagacguggggaaaggcgaagaucgugacagccgaaacacaaaacuccagcuucaucauagacggcccgaauacgccagagugcccgucagcaucccgagcguggaacgucugggaaguggaagacuacggcuucggaguauucacaaccaacauauggcuaaaacuuagagagguuuacacucagucgugcgaccaccgccucaugucugcagccaucaaggaugaaagagccguccacgcugacaugggcuacuggaucgagucgcaaaagaauggcucguggaagcuagagaaggcaucauucauagaggugaagaccuguacauggccgaaaucccacacauuaugguccaacggggugcucgaaagugacaugauaaucccaaaaucacuggcaggccccaucucccaacacaaccaccggccaggauaucacacacaaaccgccggcccuuggcaucucgggaaacuggaacucgacuuuaauuacugugaaggcacaacaguagugaucacggaaaauugcgggacgaggggcccuucacugcgaaccacaacggucagcgggaagcucauacacgaaugguguugccgaaguugcacacucccaccgcucagauacaugggcgaagacgguugcugguacggaauggagaucaggccaauuaaugaaaaggaggagaacauggucaagagccuggugagcgcgggaagcggcaaggucgacaacuucacaaugggaguccugugccuagcgauacuauucgaggaaguaaugagagguaaguucgggaagaaacacaugauagccggaguccuuuucacauucgugcugcuccuaagcggacagaucaccuggagggacauggcccauacauugauaaugauaggaagcaaugcuagcgaccgaaugggcauggggguuacguaccucgcucucauagccacuuucaaaauacagccguuccuagcccuuggguucuuccuccggaaacuaaccucccgcgagaaccuauuacuaggcguagggcuggcuauggccacaacacuucaacuccccgaagacaucgaacagauggcuaacggcauugcgcuugggcuaaugacucugaagcuaaucacccaguuugaaacguaccaacuuuggacagcgcucguuucacuaacuugcucaaacacuauauucacgcuuacagucgccuggcgcaccgccacccucauacuagccggcguaucgcuccugccccuaugccagagcagcuccaugaggaagaccgacuggcuccccaugaccgucgcagcgaugggcguaccgccccuaccccuguucaucuuuagccugaaggacacaccgaaaaggcggaguuggccccuaaacgagggcguaauggccguaggccuagucagcauacuggccucuagccuacuacgcaacgaugucccgauggcaggcccuuuaguugcgggaggcuugcuaauugcgugcuacguuaucacuggaacaucagcagaccuuaccguugaaaaggcagcggacguaacgugggaagaagaggcagaacagaccggaguaucccacaauuuaaugauaaccguggacgacgauggaacaaugagaauaaaagaugacgagaccgagaacauccucacagugcuauugaaaaccgcguugcugaucguaagcggaaucuucccguauuccaucccagcgacacuccugguuuggcacacuuggcaaaagcaaacgcaacgcucgggaguacugugggacguccccagcccaccggaaacacagaaagccgaacuagaggaaggaguauaucgcaucaaacaacagggaaucuuuggcaaaacacaggucggagucggagugcagaaagagggagucuuccacaccauguggcacgucacgagaggggcaguccuuacccauaacggaaaacgccuagaaccgaacugggccucaguaaagaaagaccuuaucucguacggggguggguggcggcucucagcccaguggcaaaaaggcgaagaaguucaaguuaucgcgguugagccggggaaaaaccccaaaaauuuucaaaccaugccaggcauauuccagacuacaacaggagagauaggagcaaucgccuuagacuucaagcccggcacuagcgggucgccgauaaucaaccgagagggaaagguaguaggacucuaugguaacgguguugucacgaagaacggcggcuacguaagcggcauugcacaaaccaacgccgagccggacgggccaacaccagaacuagaggaagaaauguucaagaaacgcaaccucaccaucauggaccuacaccccggcucgggcaagacgcgaaaauacuugccagcgaucguacgcgaagcgaucaaaaggcgacuaagaacccuuauucuugcaccgacacgaguaguugccgccgagauggaagaagcccucaagggucuaccgauccgcuaccagaccacggcaaccaaauccgaacacacuggacgcgagaucguagaccugaugugccacgcaacuuucacaaugcgacugcuuuccccgguccgcguuccgaauuauaaccugauaauuauggaugaggcccacuucaccgaccccgcuagcaucgcagcgcgcggguacauaucgaccagggucggcaugggugaagcugcggcuauauucaugacagccaccccgcccggcacggcugaagccuuuccccagagcaacgcaccuauucaggacgaagagagagauauccccgagcgaaguuggaacagcggaaacgaauggauaaccgacuucguggguaaaacagucugguuugugcccagcaucaaagccgggaacgacaucgcgaauugccuacguaaaaacgggaagaaagucauccaauuguccagaaaaaccuucgauacggaauaccagaaaacuagacucaaugacugggacuuuguagucacaacagacauauccgaaaugggagcuaacuucaaagccgacagggugauagacccaaggagaugccucaaaccgguaauuuuaaccgacggccccgaacgcguaauacucgcggggccaaugccagugacagcagccagcgcggcccaacgucggggccgcguaggacgaaacccacagaaagagaacgaucaguacauauucaccggacagccacugaacaacgacgaagaccacgcacacuggaccgaagcgaaaaugcuucuggacaacaucaacaccccagaaggaaucauucccgcccucuucgaaccugaacgcgagaaauccgcagcaauagacggagaauaccgacuaaagggggaaucccguaaaaccuucguagaauugaugcggagaggggaccucccugugugguuagcacauaagguagccagugagggaauaaaauacacagacagaaaguggugcuucgauggcgagcgaaacaaucaaauuuuggaagagaacauggacgucgaaaucuggacgaaagaaggagagagaaagaagcuacgaccgcguuggcuggacgcaagaacauacagcgauccccuagcacucaaagaauuuaaagacuucgccgcggggcguaaaucaauugcgcuugaccugguaaccgagaucggucgaguacccucacaccuagccuaucgcacgcggaaugcguuagacaaccuaguuauguugcacaccagugaacaugggggaagggcauaucgccacgccguggaggagcuuccugagaccauggagacacuacugcugcucggucuuaugauacuccuaaccgguggagcgauguuauuucugauaucaggcaaggggauagguaaaacgaguauaggacuuauaugcguaaccgugucgucagggaugcuguggauggcugacguccccuuacaauggauagcgagcgccauaguccucgaauuuuucaugauggugcugcuaauaccggagcccgagaaacaacggacgccacaagacaaccaacuggcuuacguagugauaggcauccuaaccuuagcagcgaucgucgcagccaacgaaaugggacugcucgaaaccacaaagagggaucuaggaaugagcaaggagccaggagugguaucgccaacgagcuaccucgacgucgaccuacaccccgcaucggccuggacacucuacgcaguagccaccaccguaaucacaccgaugcuacgucacacuauagaaaacucaaccgcuaauguuagcuuagcugccauagcaaaccaggcagucguucuuaugggguuggacaaaggcuggccaauuucgaaaauggaccucggggugccccuccuagcccucggauguuacucacaaguuaacccacucacauuaaccgcagccguccuacuccucgucacacacuacgcgauaauuggacccggacugcaggcgaaagccaccagagaggcacagaaaagaacggccgcgggcauaaugaagaaccccaccguagaugggaucaugacgauugacuuagacccagucauauaugacagcaaauuugaaaaacaacuuggacaagucaugcuacuugugcucugugcuguccagcuacuccugaugaggacaagcugggcgcuaugugaggcgcuaacccucgccacuggccccauaaccacucuaugggagggcucgcccggaaaauuuuggaacacaacgaucgcggucuccauggcaaacaucuuccgcggaagcuaccucgccggcgccggccuugcguucagcauuaugaaauccgucgggacggguagaaggggcacggguagucaaggggaaacgcuuggagagaaauggaagaagaaacucaaccagcuuagcaggaaagaguucgaucuguacaagaaaucagguauuacagagguugauagaaccgaagcgaaagaaggacuaaagagaggagagaccacgcaccacgccguuuccagaggguccgccaagcuacaaugguucguggagcgaaauauggugauuccagaggggcgaguaaucgaccuugggugcggcaggggaggauggucauacuauugcgcagggcucaaaaagguuacggaaguaaggggcuauaccaagggcgggcccggacaugaggaaccugucccgaugagcaccuauggcuggaaccuggugaaacucaugucaggaaaagacguauucuacuuaccgcccgaaaagugugacacccuacugugugauaucggagaaucgaguccaagcccaacugucgaggagagccgcacgauaagaguacucaagaugguagaacccuggcugaaaaacaaccaauucugcauaaaaguguugaaccccuacaugccuacgguaauagaacaccucgagagauugcaacgcaaguauggcggaaugcuggugaggaauccccuuucaagaaacucaacccacgaaauguacuggaucagcaacggcacggguaauaucgucucgagcguaaacauggucucgcgccuuuuacugaacagauucaccaugacgcaucgacggcccacaauugaaaaagacguagaccucggagcagguacccgccacgucaaugcagagccggaaacuccgaacauggacguaaucggagagcgaauaaagcgaaucaaagaagaacacagcucgaccuggcacuacgacgacgagaaccccuacaaaacaugggcauaccacgguagcuaugaagugaaggcaacgggcagcgcgagcucuaugaucaauggcguugugaaacugcucaccaaacccugggacguagugccaauggucacacaaauggccaugaccgacacaacaccauucggccagcagcgcguauucaaagagaaaguggauacccguaccccgcgaccgaugccgggaacaagaaaagucauggaaaucaccgcugaguggcuauggagaacacuaggccgcaacaagaagccgcgacuaugcacccgagaagaauuuacgaaaaagguccgaacaaaugccgccaugggagccguguucacggaggaaaaccaaugggacuccgcgcgugccgccgucgaagacgaagaguucuggaaauuagucgaccgugagagggaacuucacaaacucgggaaaugcgguagcugcguauacaacaugaugggaaagagagaaaagaagcugggagaguucggcaaagcgaaagggagccgcgcuaucugguauaugugguuaggggcgcgauaccucgaguucgaggcucuagguuuccucaacgaagaccacugguucagcagagaaaacuccuacuccgggguagaaggcgagggacuacacaaacugggcuacauacuaagggacauaagcaaaauacccggaggagcgauguaugccgacgacacggccggaugggacaccagaauaacagaagaugaccuacauaaugaagagaagaucacccaacaaauggacccggaacaccggcagcucgccaaugccaucuucaaacugacauaccagaacaaagucgucaagguccagagacccacacccaagggaacagugauggacaucaucucuagaaaagaccagcgaggaagcgggcaaguuggaacguacggacuaaacacuuucacaaacauggaagcacagcuaguacgccaaauggagggagagggcgugcuauccaaggcagaccuggaaaacccccaccuccuugagaagaaaauaacacaaugguuagagacgaaaggcgucgagcgacugaaacgaauggcgauaucaggcgacgauugcgucgugaaaccaaucgaugaucgcuuugccaacgcccuauuagccuuaaaugauaugggaaagguccggaaggacaucccccaguggcagccgucaaagggauggcacgacuggcaacaggugccguucugcucacaccacuuccaugagcugauuaugaaggacggacguaaacucgucguuccgugcagaccacaagaugagcucauuggacgcgcacgaaucagccaaggcgccggcuggucgcuaaaagaaacugccugccuuggcaaggcauaugcccaaauguggucguuaauguacuuucaccgucgagaccuacgacucgcaucaaacgcaaucugcuccgccguacccguccauuggauaccaacaucuaggacaacauggagcauucacgcucaccaccaauggaugaccacagaagacaugcuaacgguauggaauaggguguggauagaagacaacccguggauggaggacaagacccccguaaccaccugggaagacgucccauaucuagggaaacgggaagaccagugguguggcagcuugauaggacugacuucacgggcgaccugggcacaaaacauacugacagcaauacaacaagugcgcucccuaaucggagacgaagaguucuuagauuacaugcccuccaugaagcgguucaggaaggaagaagagagcgagggagcuauaugguga

SEQ ID NO: 26120 - RNA, 9873 nt, Artificial Sequence
  derived and/or modified CDS sequence (opt11) from DENV-3__FJ547062__SS-prME
accagccuuugucuaaugaugaugcugcccgcaacccuggccuuccaucucaccagccgggauggugaaccccggaugaucguggguaagaacgagagaggcaagagccugcuguucaaaaccgcguccgggauaaauauguguacgcugauagccauggaccugggcgagaugugcgacgacaccgugaccuacaaaugcccccugauugccgagguggaacccgaggacauugacuguuggugcaauuugaccagcaccugggucacguaugggacguguaaccaggcuggggaacaucggcgggauaagcgguccguugccuuggcgccccacguggggaugggguuggacacccgcacccagacauggaugucagcggagggugccuggagacagguggagaaggucgagaccugggcacuccgucacccgggguucaccauacuggcacucuucuuagcucacuacauaagcaccagccugacgcagaagguggugaucuuuauacuguugaugcugguuacaccuuccaugaccaugcggugugugggcguagggaaccgcgacuucguagaggggcuguccggugccaccugggucgacgugguccuugagcacgguggcugcgugaccacaauggccaagaacaagcccacucuagacaucgaacugcagaagaccgaagccacccagcuagcgacgcuacggaagcugugcaucgaggggaagaucaccaacauaacgaccgacucucggugccccacgcagggggaggccauccuccccgaagaacaagaccagaacuacguaugcaaacauacauacguggaccgggggugggggaacgggugcggucuguucggcaaagggagccuagucacaugcgccaaguuccagugucucgagcccaucgagggcaaagugguacaguaugagaaccuuaaguacacugugaucauaacugugcacaccggcgaucagcaucagguaggaaacgacacacagggggugaccguggagaucacaccccaggcaagcaccgucgaggccauccugcccgaguacgggacacuaggguuagagugcuccccgcgcaccggucuggacuucaacgaaaugauccugcugacuaugaagaacaaggcauggauggugcaucggcagugguucuuugaccugccuuugccauggaccaguggugccacuacagagacccccacguggaaccgcaaggagcugcugguuacuuuuaaaaaugcccacgcuaaaaagcaggagguugugguccuugguagccaggagggggcuaugcacacggcgcucaccggggccacggagauacagaacuccgguggcaccagcaucuuugcuggccacuugaagugccggcucaagauggacaaacuggagcugaagggcauguccuacgccaugugucuuaacacguucgugcugaagaaggaggugagugagacccagcacgggacgauccugaucaagguggaauacaagggggaagacgccccgugcaagauuccauucucaacagaagacggccaggggaaggcccacaacgggcgauugauuaccgccaauccuguggugacgaaaaaggaggagcccguaaacaucgaggcugagccaccuuucggugaguccaacaucgugaucggcaucggcgacaaggcacuuaagaucaacugguauaagaaagggaguucaauuggcaagauguuugaggcgacggcgcggggcgcccgccgcauggccauccugggggauaccgcaugggauuuuggcucgguagggggcguccuaaauucccucgggaagauggugcaucagauuuucggcucggcguacacggcccucuucuccggcgugagcuggauuaugaagaucgggaucggcguccuucuuaccuggauagggcucaacucgaaaaacacaagcaugaguuucucuugcaucgugaucggcauaaucacauuguauuugggggccgucguacaagccgacauggguugcgcaaucaauuggaagggcaaggagcugaaauguggguccggcauuuuugugacgaacgaggugcacaccuggacggagcaauauaaguuccaggcggacucacccaaacgccuugcgaccgccaucgccggggccugggaaaacggcgucugugggauucgcuccaccacccggauggagaaccuacuuuggaaacagaucgccaacgaacugaacuacauacuaugggagaacaacaucaagcugacgguaguggucggggauaucaucgggguuuuggagcagggcaagaggaccuugacaccccagcccauggagcuuaaguacagcuggaagacuugggguaaagccaagaucgugacggcagagacccaaaauuccagcuuuaucaucgacggcccgaacacacccgagugccccuccgccagcagggcguggaacgucugggagguggaagacuacggcuuuggggucuucaccacgaacauuuggcugaaguuacgcgaaguauacacccaguccugugaccaucgucugaugagcgcggccaucaaggacgagcgcgccguucacgccgauaugggcuacuggaucgagucccagaagaauggcucguggaagcucgaaaaggccucuuucaucgaggugaaaaccugcaccuggccaaaaagccacacucucuggagcaacggggucuuagaguccgauaugaucauccccaagagccuagccggcccgaucagucagcacaaucaccggccggguuaccacacgcagaccgcugggcccuggcaccuaggaaagcuggagcuggauuuuaauuauugugaggggacgacgguggugaucaccgaaaacugcggaacacgggggcccagccucaggaccaccacgguauccgguaagcugauccaugaguggugcugucgcagcugcacacuaccaccccuccgguacaugggugaggacggcugcugguacgggauggagauccgccccauuaacgagaaagaggagaacaugguuaaaagucuaguaucggccggguccggcaaggucgacaacuuuacuaugggcguacuuugucuagcaauauuauuugaggaggugaugcguggcaaauucgggaagaagcacaugaucgcggguguccuguucaccuucgucuuacugcuguccggccaaaucacauggcgcgacauggcacacacccucaucaugaucggcucgaacgccagcgacaggaugggcaugggggugaccuaccuggcacugaucgcgacuuuuaaaauucagcccuuccuagcgcugggcuucuuccuccggaaauuaacuagccgcgagaaccuucuguugggugucggucuggcuauggcuaccacccugcaacucccugaggacaucgagcagauggccaauggcaucgcgcuggguuugaugacccucaagcugaucacacaauuugagacauaucaacuguggaccgcacugguaucgcugaccugcucuaacacgauauucaccuuaacgguggccuggcgcaccgccacacucaucuuagcaggcgucagucugcucccccugugccagagcaguagcaugcggaagaccgauuggcucccgaugacaguggcggcuaugggcguaccaccccucccgcuguucaucuucucgcugaaggauacccccaagcggcgcagcuggccucucaaugagggcguaauggccguuggguuagucuccauacuggcuagcucucucuugcggaacgacgugccgauggccgguccgcugguagcuggcggacucuuaaucgcuuguuaugucaucacgggcaccucagccgaccugaccguggaaaaggccgccgacguuacgugggaagaagaagcggagcagacagggguaucccauaaccucaugauaaccgucgacgacgacgggaccaugcgcaucaaagaugacgaaacggaaaacauccugacggugcugcucaagacggccuuacugauagucuccgggaucuucccguacagcauacccgcaacgcuccuaguguggcacacguggcaaaagcagacccaacggaguggcguauuaugggaugucccgagcccgcccgagacgcagaaggccgaauuagaggagggaguauaccgcauuaaacaacaggggaucuucggaaagacccaggucggcguaggcguucagaaagaggggguauuccauaccauguggcacguuacucggggcgccgugcugacacacaacgguaagcgccuggagccaaacugggcguccgugaagaaagaucucaucucuuacgggggaggcuggcgccucagcgcucaguggcagaagggcgaagagguccaggucaucgccguugagccagguaagaauccgaagaacuuucagaccaugcccggcauauuccagaccaccacgggggagauaggggcgauugcgcuggauuucaagcccggcaccucgggcaguccgauuaucaacagagaaggaaaaguaguaggacuuuacgggaauggcgugguuacgaaaaacggagguuacgugucagggaucgcucagaccaacgccgaaccugacggaccgacccccgagcuagaagaggagauguucaagaagcggaaccugacgaucauggaccuucacccggguaguggcaagacccgcaaguaccuccccgccauagugcgggaggccaucaagcgccggcugcgcacccugauauuggcucccacaagggucguggcggcagagauggaagaggcccuuaagggccugccgaucagauaccaaaccaccgcuacaaaguccgaacacacggggcgggagaucguggaccuuaugugccaugcgacauucacaaugcgccugcuguccccgguucgggugcccaacuauaaucucauaauuauggaugaagcccacuucaccgaccccgcuagcaucgccgcccgcggauacauuaguaccagggugggcaugggcgaggccgccgccauauucaugaccgccacgccgcccgggaccgcagaagcauuuccccagagcaacgcgcccauacaggacgaggagcgcgauauuccagaacgcuccuggaauagugggaacgaguggauuaccgauuucgucggcaaaacggugugguucgugccuuccaucaaggcgggaaacgacaucgccaacugccucaggaagaauggaaagaaggucauccaguuaagccguaagacuuucgacaccgaguaccagaagacgcggcucaacgacugggacuucguggugaccaccgacauuuccgagaugggggcgaauuuuaaagcggaccgcguaaucgaccccagacgaugucugaagcccguuauccugacggacggccccgagcgugucauccucgcugggccgaugcccgucacugcagccucagcggcccaacgccgcgggcgcguugggcggaacccccagaaggaaaacgaccaguauauuuucacagggcagccccuaaacaacgacgaagaucacgcgcacuggaccgaggcuaagaugcuacucgauaauaucaacaccccugagggcaucauucccgcacuguuugagccagaacgcgagaaauccgcggccaucgacggugaauaccggcugaagggcgagagccgcaagacguucguggaacugaugagaagaggggaccugccagucuggcuggcccacaagguggcuagcgaggggauaaaauacacagaucgaaaauggugcuuugacggcgagcggaacaaccagauucucgaggagaacauggacgucgaaauauggaccaaggagggcgagagaaagaagcugcgcccgcgguggcuggacgcgagaacuuauucagacccucucgcguuaaaagaauuuaaggacuucgcagccggcagaaagaguauugcccuggaccuaguaaccgagaucgggcggguucccagccaccuggcguaucgcacucggaacgcccuagacaacuuagucaugcugcacacaagcgagcacggagggcgcgccuaccgccacgccguggaggaguuaccggagacuauggaaacccuccuguuacucggccugaugauccugcucacaggaggggccaugcuguucuugaucaguggcaaggggaucgggaagaccagcauaggccuuaucugcguuaucguuuccagugggaugcuuuggauggcugacgugcccuuacaguggaucgcuuccgccauaguacucgaguuuuucaugauggucuuguuaauucccgagcccgagaagcagcggacgccgcaggacaaucaguuggccuauguggugauuggcauccugacccuagcggccauaguugcugccaacgagauggggcugcucgagacgacgaagcgugaccuagggauguccaaggagcccggagugguguccccgacgagcuaccucgacguagaccugcacccugccagcgccuggacucuguacgcgguggcaacaacggugaucaccccuaugcuuagacauacgauagaaaauuccaccgccaacgucucccuggcugcaaucgccaaccaggcuguggugcugaugggacucgacaagggcuggccaauuagcaagauggaucugggggucccccugcucgcgcugggcugcuacucccaggugaacccccugacccuaaccgcggcuguacuccugcucgucacacauuacgcuauuaucgguccaggcuugcaagccaaagcuacuagagaggcacaaaagcgcacugcggccggcaucaugaagaacccaacgguggacgggaucaugaccaucgaucuggacccggucaucuaugauaguaaguucgagaagcagcuaggccagguaaugcuucuggugcucugcgcggugcagcugcuccuuaugcggacauccugggcacuaugcgaggcccucacccucgcuaccggcccuauaaccacgcuuugggagggaagcccgggcaaguucuggaacacgaccaucgccgucuccauggcaaacaucuuccgcggcucguaccuggcuggugcgggucucgcguucucgaucaugaagucaguggggaccgggcggcgcgggacggguagccagggggaaacacuuggcgaaaaguggaagaagaagcugaaccagcuuucccggaaggaguucgaccuguacaagaaaucugguauaaccgagguggacaggaccgaggccaaggaaggccugaagcggggugagaccacucaucacgccgucucccgcggcucugcaaagcugcagugguuuguggagcggaacauggugauacccgagggccgcguaaucgaccugggaugcggucgcggaggcuggucguacuacugcgcggggcugaagaaagugacagagguacggggcuacacgaagggugggcccggccaugaggagccggucccgaugucaaccuacggguggaaccucgugaaacuuaugaguggcaaagacguguucuaccugccgcccgagaaaugcgacacccuuuugugcgacauaggugagagcucgccuucuccgaccguggaagagucccgcaccauacgggugcugaaaaugguggagcccugguugaagaauaaccaauucugcaucaagguccucaaccccuacaugcccaccgugauagagcaucuagagaggcugcagcggaaguacgguggcaugcuugugcgcaacccacucucccggaacucuacccacgaaauguauuggaucucgaacggcaccggcaacaucguauccuccgugaauauggucuccagacuucuccuuaaccgauucacuaugacccaccgcaggccuacaaucgaaaaagacgucgaccucggugccgguacucgccaugugaaugccgaacccgagaccccgaacauggacgucaucggcgagagaaucaagcgcaucaaggaggagcacuccuccaccuggcacuacgacgacgagaaccccuacaaaacgugggccuaccauggcucguacgaagucaaggccaccggauccgcguccagcaugaucaacgggguugucaagcuccuuaccaagcccugggacguggugccaauggucacccagauggccaugacugacaccaccccauucggccagcagcggguguucaaggagaagguggacacccgcacgccacggcccaugcccgguacccgcaaggucauggagauaaccgccgaaugguuguggcggacguugggaaggaacaagaagccucgacugugcacgcgggaggaguucaccaagaagguacguacuaacgccgcgaugggugccguguuuacagaggagaaucagugggacuccgcccgggccgcgguagaggacgaagaguucuggaagcuggucgaccgugagcgggaguuacacaaacuugggaagugcggcucgugcguguacaacaugauggggaagcgcgagaagaagcugggugaguucgggaaggcgaaaggcucacgggccaucugguacauguggcugggggcccgcuaccuggaguucgaggcccugggguuccucaacgaggaccacugguucagccgggagaacagcuacuccggcguugaaggcgagggccugcacaaacuggguuacauuuuacgugacaucuccaagauccccgguggggcuauguacgcggacgacacggcagggugggacacccggaucaccgaggacgaccugcacaacgaagaaaagauaacccaacagauggaucccgagcacagacaacuggccaacgccaucuucaaguugacguaucagaauaaaguggugaagguccagcgccccaccccgaaaggcacagugauggauaucauaucccgcaaggaccagcgggguuccggccagguggggaccuacgggcugaacaccuuuacgaauauggaagcacagcugguccgccagauggagggcgaaggaguccucucgaaagcggaccuggagaauccucaucucuuagagaaaaagaucacccaguggcuggagacaaaaggcguagagcgguugaagcgcauggccaucuccggcgaugacugcguggucaagcccauugaugacagauucgccaacgcccuccuagcccuaaaugacauggggaaagugcgcaaagauaucccccaauggcagccuucgaagggcuggcacgacuggcaacaaguaccuuucugcagccaccacuuccacgagcucauaaugaaggacgggcguaagcuggugguacccugccggccacaggacgagcucaucggucgugcucggaucucacagggggcuggcuggucccuaaaggagaccgcuugcuuaggaaaggcauacgcccagauguggagcuuaauguacuuccaccgccgggaccuccgccuggcuuccaaugccaucuguagcgccgugccggugcacuggauccccacgagccggacaaccuggagcauccacgcacaccaccaauggaugacaacggaggauaugcugacaguguggaaucgcgucuggauugaggacaaucccuggauggaagacaagacgcccgucaccacaugggaggauguaccguaucucggcaagcgggaagaccaguggugcggcagccugauuggguuaacgagucgcgcgaccugggcucagaacauccucacggcaauccagcaagugaggucgcucaucggugaugaggaguuccuugacuacaugcccucaaugaagagauuucgcaaggaggaggaaagcgagggggccaucugguga

SEQ ID NO: 26121 - RNA, 9873 nt, Artificial Sequence
  derived and/or modified CDS sequence (opt11) from DENV-3__FJ461322__SS-prME
accagucugugccucaugaugaugcugcccgcgacccuggccuuccaucucacgagccgggacggugagccccggaugaucgugggaaagaacgagcgcggcaaaagccugcuguucaaaaccgcguccgggauaaacauguguacccucaucgccauggaccugggcgagaugugcgacgacacugugacauacaagugcccccugaucgccgagguggagcccgaggacaucgauugcuggugcaaccucaccagcaccugggugaccuacgggaccugcaaccaggccggcgagcaccggcgcgacaagcggaguguugcacuggcgccccacgugggcaugggacuggacacccgcacccagacauggaugucagccgagggcgccuggcgccaggucgagaaaguagagaccugggcccuucgccacccgggcuuuaccauccuggcgcuauuccuugcccacuacaucggcaccucccucacgcagaaaguggugaucuucauccugcucaugcuggucacucccagcaugacgaugcggugcgugggggugggcaaccgcgacuucgucgagggccuguccggggccaccuggguggacguugugcucgagcacggaggaugcgugaccacgauggccaagaacaagcccacccuggauaucgagcugcagaagacugaggccacccaguuagcgacgcugcggaagcugugcaucgagggcaagaucacuaacaucacuaccgacagccgcugccccacacagggcgaggccauccuucccgaagagcaggaccagaauuacguuugcaagcauaccuacgucgaucgaggguggggcaacggcuguggccuguucgggaaaggcucucuggugacuugcgccaaauuccagugccucgaaccuaucgagggcaaagugguacaguaugagaaccugaaauacacggugaucaucacggugcacaccggggaucagcaccaggugggcaaugacacccagggggucaccguagagaucacgccccaggcuagcaccguagaggccguccuccccgaguacggcacccucgggcuggaaugcucgccgcgcaccggccuggacuucaaugaaaugauccuuuuaaccaugaaaaacaaggcguggaugguccaccggcagugguucuucgaucugccucuccccuggacgagcggcgccaccacagaaacccccacguggaaccgcaaggagcugcuggugaccuucaagaacgcccacgccaagaagcaggagguggucgugcucgggucccaggaaggggccaugcacaccgcgcugaccggggcaacggagauccagaacagcggcgggacuucaaucuuugccggacacuugaagugucggcucaagauggacaagcuggagcugaagggcaugagcuacgcuaugugccucaacacuuuuguguugaagaaggaggucuccgaaacccagcacgggacgauucugaucaaggucgaguacaagggugaggaugccccgugcaagauccccuucagcaccgaggacgggcagggcaaggcgcacaacggccgccugaucaccgccaauccagucgucaccaagaaggaggagcccgugaacauagaggcugaaccgcccuucggcgaguccaacaucgugaucggcaucggggacaaagcccucaagauaaacugguacaaaaagggcuccagcaucgggaagauguucgaggcgacagcccgcggcgcccgccgaauggccauccugggagacaccgcuugggacuucggguccgucggcggggugcugaauagccuggguaagaugguucaccagaucuucgggucugcguacaccgcccuguucagcggcgucuccuggaucaugaagaucgguaucggggugcugcucaccuggauaggccuaaacagcaagaacacguccaugagcuucuccuguaucgucaucggaaucaucacccuguaccuuggcgccguggugcaggcugacauggggugugccauaaacuggaagggcaaagaacucaagugcggcagcggaaucuuugugaccaacgaaguccacaccuggacugaacaguacaaguuccaggccgacuccccaaagagacuggcgacagccaucgcgggcgccugggaaaacggggugugcggcauccgcucgaccacccgcauggagaaccuccuguggaagcagaucgcgaacgagcuuaacuacauccucugggagaacaauauaaaauugaccguagucgucggggacaucaucggcgugcuggagcaaggcaagagaacccucacgccccagccgauggagcugaaguacuccuggaagaccugggggaaggccaaaauaguuacggcagagacccagaacagcucguucauuaucgauggccccaacaccccagagugccccagcgccucucgggcguggaacgugugggagguggaggacuauggguucggcgucuucacgacgaacaucuggcugaaguugagagaaguguacacucagagcugcgaccaccggcugaugagcgccgccaucaaggaugagcgcgccgugcacgcugacaugggcuacuggauugagucccagaagaacggaagcuggaagcuggaaaaggcguccuucaucgaagucaaaacgugcaccuggccaaagagccauacccucugguccaacggcguacuugagagcgauaugaucauccccaagucccuggcugggccuaucagucagcacaaucaucggccgggcuaccacacgcagaccgcuggccccuggcaccuaggcaagcuugagcuggacuucaacuacugcgagggcacaaccguggucaucacggaaaacugcgggacccgaggccccucccuccggacgaccacggugagcggcaagcugauccacgaguggugcugccgcuccugcaccuugcccccgcucagauacaugggcgaagacgggugcugguacggcauggaaauacgccccaucaacgagaaggaggagaacaugguaaagagccuggucuccgccggcucggggaaaguggacaacuucacaaugggcgugcugugccuggccauucuguucgaggaggucaugagaggaaaguucggcaagaagcacaugaucgcggggguucuguucacauucguguuacugcuguccggccagaucacguggcgugacauggcccacacccucaucaugaucggcagcaacgccuccgaucggauggggaugggagucacauaccuggcgcugaucgccaccuucaagauacagcccuuccucgccuugggguucuuccugcgcaagcuuacgagccgagagaaccugcuguuaggcgucggccuggccauggcuacaacccuccaguugccagaggacaucgagcaaauggccaacgggaucgcuuuaggccuuaugaccuuaaaacugauaacgcaguucgagaccuaccaguuauggaccgccuuggugagccugacaugcuccaacacgaucuucacccugacgguggcauggcgcaccgccacgcucauccuggccggggucucacugcucccguugugucagucuaguagcaugcguaagaccgacuggcugcccaugaccguugccgcgaugggggugccgcccuugccgcucuucaucuucagccugaaggacaccccaaaacgccgcuccuggccccucaaugaggggguaauggccgugggacuugugucaauccuagccuccagccuccuccggaaugacgugccuauggcuggcccgcugguagccggcgggcuccugaucgccugcuacgugauuacggggacauccgcugaccugaccguggaaaaagccgccgacgucaccugggaggaagaggcggagcagacuggggugagucacaaccucaugaucaccguggacgacgacgggaccaugcgcaucaaggaugaugagaccgagaacauacugacagucuugcucaagacggcccugcugaucgucuccggcaucuuucccuauagcaucccagccacccuucugguguggcacaccuggcagaaacaaacccagcgguccggcguacugugggacgugcccagcccgccggagacgcaaaaagccgagcucgaggaagggguguacagaauuaagcagcaggggaucuucgggaaaacccaggucggcguaggggugcaaaaggagggcgucuuccacaccauguggcacgugacccggggcgccgugcugacccacaacgggaagcgccuggagcccaacugggcguccgucaagaaggaccucaucagcuauggcgggggcuggagacuuuccgcccaguggcagaagggggaggagguccaagugaucgcugucgagcccggcaagaauccgaagaacuuccaaacaaugcccggcaucuuccagacuaccacgggggagauaggcgccaucgcgcuggacuucaagcccgggaccagcggcagcccgauuauuaaccgcgagggcaaggugguaggacuguacggcaacggggucguuacaaagaacgggggguauguguccggcaucgcccagaccaacgccgagcccgacggccccacgcccgaacucgaagaggagauguucaagaagcggaaccugaccaucauggaccuucauccggggucggggaaaacucgcaaguaccuucccgccaucgucagggaggccaucaagcgccggcugcgcacacugauccucgcgccuacgcggguuguggccgccgagauggaggaagcccugaaggggcugcccauccgcuaccagacaaccgcaaccaaguccgagcauacagggcgcgagaucguugaccucaugugccaugcuacuuuuacgaugcgccugcugagcccggugagaguucccaacuacaaccucaucaucauggacgaggcgcauuucaccgaccccgccuccauagccgcccgcggcuacaucagcacgcggguaggcaugggggaggcggccgcuauuuucaugaccgccacuccgcccgguaccgcggaggcguucccccaguccaacgcccccauccaggacgaggagcgcgacaucccggaacgcagcuggaacuccggcaacgaguggaucacggacuucgugggcaagaccgugugguucgugcccucaaucaaggccggcaaugacaucgccaacugcuugcguaaaaaugggaaaaaggugauccagcugucccgcaagaccuuugacaccgaauaccagaagacgcggcucaacgacugggauuucgugguuaccaccgacaucagcgagaugggcgcaaacuucaaggccgaucgcgugauagacccccggcgcugccugaagccggugauccuuaccgacggacccgagcgggucauccuugccgguccgaugcccguaacggcggcgucugccgcccagaggcggggccgcguggggcgaaacccacagaaggagaacgaccaguacaucuuuaccggacagccccugaacaacgacgaggaucacgcccacuggacugaggccaagaugcugcucgacaacaucaacacccccgaggggaucauccccgcccuguucgagccggagcgggaaaaguccgcagccaucgacggcgaguaccggcuaaagggcgagagucggaagaccuucgucgagcucaugcggagaggggaccuacccguguggcuugcccacaaggucgcgagcgagggcaucaaauacacggacagaaaguggugcuucgacggcgagcgcaacaaucaaauccucgaggagaauauggacguggagaucuggaccaaagagggcgagcggaagaaacugcgcccgcgcuggcuugaugcgcggaccuacuccgacccccucgcacuuaaggaguucaaggacuucgccgccggccgcaagagcaucgcucuggaccucgugaccgagauagggcggguccccucccaucuggcguaucgaacgcggaacgcccuggacaaccucgugauguugcacaccagcgagcacggcgguagagcauauaggcacgccguagaggaacuaccggagaccauggagacccuucuguuacuaggacugaugauccugcucaccggcggggcuaugcuauuccugauaagcgggaagggcauuggcaagaccaguaucgggcugaucugcguaaucgugaguuccggcauguuguggauggccgaggugccccuucaauggaucgccagcgcgaucguccucgaguucuucaugauggugcugcugauccccgagcccgagaagcagcgcacgccgcaggacaaccaguuagccuacguggucauagggauccugacgcucgccgcgaucguggccgcaaacgagaugggccucuuagagaccaccaagcgggaccugggcaugagcaaggagcccgggguggucucccccacauccuaccucgauguagaccugcaccccgcuuccgccuggacccuguaugccguugccacgaccgucauuaccccaaugcuccgccauacuaucgagaacuccaccgccaacgugagccuggccgcgaucgccaaccaggccguggugcugaugggccucgacaagggauggcccaucagcaagauggacuuaggcgugccgcugcucgcccuggggugcuacucccagguuaauccccugacccucaccgccgcuguucugcugcucgugacccacuacgcgaucauagggccuggccugcaggccaaggcuacucgggaggcccagaagcgaaccgcagccgggaucaugaaaaaccccaccguagacggcaucaugaccaucgacuuagaccccgucauuuacgauucgaaauucgagaagcagcucggccaggugaugcugcuggugcucugugcuguccagcuguugcuuaugcgcacgagcugggcccuaugcgaggccuugacccucgcgacggggcccaucacgacacugugggaaggcucgccagggaaguuuuggaacaccaccaucgccguuagcauggccaacaucuuccgcggcuccuaccuggcaggggcuggccucgccuucagcaucaugaagucuguggggacuggccggcgcggcacggggucccagggugagacauugggcgagaaguggaagaaaaaacugaaccagcuuucacggaaggaguucgaucuguacaagaaguccggcaucaccgaggucgaccgcaccgaggcgaaggaggggcugaagaggggcgagacgacccaccacgcugugagucgcggcucugcgaaacuccagugguucguggagcgaaacauggucauccccgagggucgcgugaucgaccugggcugcgggcgcggaggcuggucguacuacugcgcgggccugaagaagguuacugaaguccggggcuacaccaaaggaggccccggucacgaagagcccgucccgaugucgaccuacggauggaacaucgugaagcuaaugagcgggaaggacgucuucuaccugccgcccgagaagugcgacacuuugcugugcgacaucggggaguccagcccuucccccaccguggaagaaucgcgcaccauucgggugcucaagauggucgagcccuggcugaagaacaaccaguucugcaucaaggugcugaaucccuacaugccaacuguuaucgaacaccucgagcgccugcagcggaaguacggcgggaugcugguccgcaacccgcuuucccggaacagcacgcacgaaauguacuggauauccaacggcacagggaacaucgugagcuccgugaacauggucagccgccuacuguugaaccgcuucaccaugacccaccgccggcccacgaucgagaaggacguagaccugggcgccggcacucgccacgucaacgccgaacccgagaccccgaacauggacgugaucggggaacggaucaagcgcaucaaggaggagcacuccucgaccuggcacuacgacgaugagaaucccuacaagacgugggccuaucacggcuccuacgaggugaaggccaccgggagcgcgagcuccaugaucaacggcgucgugaagcugcucaccaagcccugggacguggucccgauggugacccagauggcgaugacggacaccaccccguucgggcagcagcggguguucaaggagaaggucgacacccgcacaccccggcccaugcccgggacccgcaaggugauggagaucacggccgaauggcuguggcggacccucggccgcaacaagaagccgcgacucugcacgcgggaggaguucaccaagaaagugcguaccaacgcagcgaugggggcgguuuucaccgaggagaaccagugggacagcgcucgggcugcaguggaggacgaggaguucuggaagcuuguggaccgcgagcgggaguuacauaagcucggcaagugcggguccugcgucuacaacaugaugggaaagcgcgagaagaagcugggcgaguucggcaaggcgaagggcagcagagcuaucugguacauguggcugggagcccgcuaccucgaauucgaggcccugggcuuccugaacgaggaccacugguuuucccgggagaauagcuacuccgggguggagggggaggggcuccacaagcugggcuacauccuucgcgacaucagcaagauacccggcggggcgauguacgcggacgacacggcaggcugggacacccggaucaccgaggacgaccuacacaacgaggagaagaucacccagcagauggacccugagcaccgccaacuggcgaacgccaucuucaagcugacguaccagaacaagguggucaaggugcagcggcccaccccgaaggggacagugauggacaucaucucgcgcaaggaccagcggggaucaggccaggucgggaccuacggccucaacaccuucacgaauauggaggcccagcugguucgccagauggagggggagggcgugcuguccaaagcggaccucgagaacccccaccuccuggagaagaagaucacccaguggcucgagaccaaggggguugagcggcuaaagcguauggccaucuccggcgacgacugcguagugaagcccaucgacgaccgguucgccaacgccuugcucgcccugaacgacaugggaaagguaagaaaggacauaccccaauggcagccuucaaagggguggcacgauuggcagcagguccccuucuguagccaccacuuucacgaacuuaucaugaaggacggccggaagcucgugguccccuguaggccucaagacgaguugaucggacgcgcgcggaucucccagggugccggguggucccugaaggagaccgccugucucggcaaggccuacgcacagauguggagccugauguacuuucaccgccgggaccugcgccucgcaagcaaugcgauaugcuccgcuguaccggugcacuggauccccacgucucggacuaccuggucuauccacgcccaccaucaguggaugaccacggaggacaugcugacggucuggaaucgcguauggaucgaagauaaccccuggauggaggacaagacccccgugacgacgugggaagacaucccguaccugggcaaacgggaggaccaguggugcgguucccucaucggccugacuagccgcgcaacaugggcccagaacauccuaacagcuauccagcagguccggucucucaucggggacgaagaguuccuggacuacaugcccucuaugaagcgcuuccggaaggaggaggaguccgagggugccaucugguga

SEQ ID NO: 26122 - RNA, 9873 nt, Artificial Sequence
  derived and/or modified CDS sequence (opt11) from DENV-3__KF955458__SS-prME
acaagccugugcuuaaugaugaugcugcccgcgacgcuggcuuuccaucucaccagccgggacggagagccccguaugaucguggggaagaacgagcgcggcaaaagccuccuguucaagaccgcguccgggaucaacaugugcacucuuaucgcaauggaccugggggagaugugcgacgacaccgucacguacaagugcccccucaucgccgaaguggagcccgaggacaucgacugcugguguaaccuuacaagcaccuggguuaccuacgggacgugcaaccaggcaggagagcacaggcgcgacaagcggaguguggccuuggcaccccacgugggaauggggcuggauacacggacccaaacuuggaugagcgccgaaggcgccuggcgccagguggagaagguggagacgugggcccuccgccacccgggguucaccauacuggcccuguuucucgcccacuacaucgggaccucucugacccaaaaaguggugauauucauccugcucaugcuggucacgccaagcaugaccaugcggugcguugggguuggcaacagagacuuugucgagggccuguccggggccacauggguggacgugguccuugagcauggcgggugcgugaccacgauggccaagaauaagcccacccuggacaucgagcugcagaaaaccgaggccacccagcucgcaacgcuacggaaguugugcaucgaggguaagaucaccaauaucaccaccgacagccgcugccccacgcagggcgaggcuauccucccggaagaacaggaccagaacuacgucugcaagcauaccuacgucgaccgggguuggggcaacgggugcggacuguucgggaaaggcucccuggugaccugcgccaaauuccagugccucgaacccaucgaagggaaggucguccaguacgagaaucugaaguacaccgugauaaucaccgugcacaccggagaccagcaccaggugggcaacgacacccagggggugaccgucgagaucacgccccaagcaagcaccguugaggccgugcugccagaguacggcacgcucgggcuggagugcucuccgcgcacgggccuggacuucaacgagaugauccuccugaccaugaagaacaaggcguggaugguccaucggcagugguucuucgaccugccccugccguggacuagcggggccaccaccgagacccccacguggaacagaaaggaacugcugguuaccuucaagaacgcucacgccaagaagcaagaaguggucgugcucgggucccaggagggcgccaugcauacagcgcugaccggggcgacggagauccagaacagcggcgggacguccaucuucgccggccaucugaagugccggcucaagauggacaagcucgagcugaaggggaugaguuacgccauguguuugaauaccuucgugcugaagaaggaagucuccgagacccaacacggcacgauacucaucaagguggaguacaagggcgaggacgccccgugcaaaauccccuuuuccaccgaggacggccaaggcaaggcgcacaauggccgccugaucaccgcgaaucccguggucacaaagaaggaggagcccgugaacaucgaagccgagccgcccuucggggagucgaacauagugauaggcauuggggacaaggcccuuaagauaaacugguacaagaaggguagcagcaucgguaagauguucgaggcgacggcccgaggcgcacgucguauggccauccugggcgacaccgcaugggacuucggcuccgucggaggggugcugaacagccucggcaagauggugcaccagauauucggguccgcguauaccgcccuguucagcggcgucuccuggaucaugaagauuggcaucgggguucuucucaccuggaucggccugaacagcaagaacacguccaugagcuucuccuguaucgucauagggaucaucacccuguaucucggugccgucgugcaggccgacauggggugugcuauaaauuggaagggcaaagaguugaagugcggcagugggaucuucgugaccaaugagguacacaccuggaccgagcaauacaaauuccaggcggacagucccaagaggcuggccacugccaucgcaggcgccugggagaacggagugugcgggauuaggucaacaacccggauggagaaccuucuguggaagcaaauugcgaacgagcugaacuacauccucugggagaacaacauuaagcugacggucguugugggugacaucaucggcgucuuagagcagggcaagcgcacccucacgccgcagccgauggagcugaaguacuccuggaagacaugggggaaagccaagaucgucacggccgagacccagaacagcuccuucaucauagacgggccuaauacucccgagugccccagcgccucccgggccuggaacgugugggagguggaggacuacggguucggcgucuucaccacgaacaucuggcugaagcuccgcgaggugaacacccagucuugcgaccaccggcugaugagcgccgccaucaaggaugagcgcgcagugcacgcggacaugggcuacuggaucgaaucccagaaaaacgggagcuggaagcuggagaaggcguccuuuauugagguuaaaacgugcacauggcccaaaagccacacccucugguccaacggcgugcuggaguccgacaugaucauccccaagucccuggccgggcccaucagccagcacaaucacagaccaggcuaccacacgcagaccgccggucccuggcaccucggcaagcuggagcuggacuucaacuacugcgaggggaccaccguggucaucacggaaaauugcgggacucggggccccucccuccggaccaccacggugagcgggaaacuuauccacgaguggugcugccgcagcugcaccuuaccgccccuccgguacaugggcgaagacgggugcugguauggcauggagauccgccccaucaacgagaaggaggaaaacauggucaagagcuuaguuuccgccggcagcgggaagguggacaauuuuaccaugggcguacuuugccucgccaucuuguucgaggagguuaugagggggaaguucggcaagaagcacaugaucgcggggguccuguucaccuucguacuguugcuguccggccagaucacguggcgcgauauggcccacacccucauaaugaucggcagcaacgccuccgaccgcauggggaugggcgucacuuaucuggcccugaucgccaccuucaagauacagcccuuccucgcgcugggauucuuccugcgcaagcuuacuagucgggagaacuuacugcuaggcgugggccucgccauggcgaccacccugcaguugcccgaggacaucgagcagauggcgaacgggaucgcguuaggccugaugacccucaaacugaucacgcaguucgagaccuaccagcuguggaccgccuuggugagccugacaugcuccaacacgaucuucacccugaccguggccuggcguaccgccacguuaauccuggccggggugagccugcucccgcugugccaguccagcuccaugaggaagaccgacuggcugcccaugaccguagcggccaugggcguaccaccccucccguuauuuaucuucagccuuaaagacacccccaagcgccgcaguuggccccuuaacgagggggugauggccgucggccuggugucgauccuggccuccucucuccugcggaacgacgugccaauggccggaccgcuugucgccggcgggcucuugaucgcauguuacgugaucacgggcacauccgccgaucugaccguagagaaggcagccgacgucaccugggaggaggaggcugagcagacgggggugucgcauaaucucaugaucaccgucgacgacgacggaacuaugcgcaucaaggacgacgagaccgagaacauccugacuguccugcugaaaacagcccugcugaucgucuccggcaucuuccccuacucgauccccgcgacccucuuaguguggcacaccuggcagaagcagacccagcgguccggcguacugugggacguccccuccccgcccgagacgcagaaggccgagcuagaagaggggguguaccggaucaagcagcaaggcaucuuuggaaagacucaggugggcgugggagugcagaaggaaggcgucuuucacaccauguggcacgugacgcggggcgccgugcugacucacaacggcaagcgccuggagcccaacugggcgucugucaagaaagaccucaucucuuacggagggggcuggcggcuguccgcccaguggcaaaagggugaggagguccaggugaucgccgucgagcccggcaaaaacccaaagaauuuccagaccaugcccggcaucuuccaaaccacaacgggggagauuggcgccauugcgcuggacuucaagcccgguaccucgggcagcccgauaaucaaccgcgaggggaagguuguggggcuuuacggcaacggggucgugaccaagaacggcggauacgucuccggcaucgcccagacuaacgccgagcccgacggccccacucccgagcucgaggaggagauguucaagaagcggaacuugacgaucauggaccugcauccgggauccggcaagacacgcaaguaucucccggccauaguccgggaggccaucaagcgccgucugcgcacucuaauccucgcgcccacgcgcguaguagccgccgagauggaggaagcccuuaaggggcugcccauccgcuaccagaccaccgccaccaaguccgagcacacgggccgggagaucgucgaccugaugugucacgcaaccuucaccaugcgcuuacugucaccagugcgggugcccaacuacaaccuaaucaucauggacgaggcccauuucacugaccccgccuccaucgccgcccgcggguacaucagcacgagagucggcaugggcgaggcggccgccaucuucaugaccgccacgccgcccgguaccgcggaggccuucccacaguccaacgcccccauccaggacgaggagcgcgacaucccugaacgcagcuggaacuccggcaacgaauggauaacggacuucguggggaagaccgugugguucguccccagcaucaaggccgggaacgacaucgcgaacugccugcggaagaacgggaagaaggugauccagcugucccgcaaaaccuucgauaccgaguaucaaaagacacgccucaacgacugggacuucguggugacaaccgacaucagcgaaaugggcgcgaacuucaaggccgaccgcgugaucgacccccggcgcugucugaagcccgugauauugaccgacggccccgaacgagucauccuugccgggccgaugcccgucacggccgccagcgcggcccagcgccggggcagaguggggcggaacccccagaaggaaaaugaucaguacauuuuuaccggccagccucugaacaacgacgaggaccacgcgcacuggaccgaagccaagaugcugcucgacaacaucaacaccccggaggggaucauccccgcgcuguucgagcccgagcgcgagaaguccgcggccaucgacggggaguaccgguugaaaggcgagagccgcaagacguucgucgagcucaugcgucgcggggaucugccaguguggcuggcccauaaggucgcgucagagggcaucaaguauacagaccggaaauggugcuuugacggggaacgcaacaaccagauacucgaggaaaacauggacguagagaucuggaccaaggaaggcgagcggaagaagcugcguccuaggugguuggacgcgaggacguacagugauccccucgcacugaaagaguucaaggacuucgccgccggccgcaagaguaucgcccuggaccucgugaccgagaucgggcgggucccaucgcaccuggcguaccgcacgcguaacgccuuggacaaccucaugaugcugcacacaagcgaacacggcgggcgcgccuacagacacgccguggaggaacugccggagaccauggagacguugcugcugcucggccuuaugauccugcucaccggcggcgccaugcuuuuccugauuagcggcaaggggauuggaaagaccucaauagggcuuaucugugugaucgucagcuccgggaugcuguggauggcggacgugccccugcaauggaucgcgagcgccaucgugcucgaguuuuucaugaugguacugcugauccccgagcccgagaagcagcggaccccgcaggacaaccagcucgcuuacguggugaucgggauucugacacuagcggcaaucgucgccgccaacgagaugggccuccuagagacuaccaagcgggaccugggcaugagcaaggaacccggcguggugucaccaacguccuaucucgacguugacuugcaucccgccucggccuggaccuuguacgcgguggccacuaccgugaucacaccgaugcuccgccacaccaucgagaacucgacggccaacgucagccuggcagcgaucgccaaccaggccgucguucugaugggccuagacaagggguggcccaucuccaagauggaccucgggguaccccugcuggcccuggggugcuacucacaggugaacccccugacccucaccgcggcgguccugcuguuggucacccauuaugccaucaucggcccuggccugcaggccaaggcuacgcgugaggcccagaagcgcaccgcggcugggaucaugaaaaaccccaccguggauggcaucaugaccaucgacuuagaccccgugauauacgacucgaaguucgagaagcagcuagggcaggucauguuacuggugcucugcgcuguccagcuacuccucaugcggacaagcugggcccugugcgaggccuuaacccucgcgaccgggccuaucaccacgcugugggaggggucuccagggaaauucuggaacaccaccaucgcuguaagcauggccaacauuuucagaggguccuaccuagccggggccggccucgcuuucagcaucaugaaguccgugggcacgggccggcgcggcacgggaagccagggcgagacacuaggggagaaauggaagaagaagcuuaaccagcucucgcggaaggaguuugaccuuuacaagaaguccggaaucaccgagguagaccgcaccgaggcuaaggaggggcugaagcguggagagaccacgcaccaugccgucucucgcggcuccgccaagcugcagugguucguggaacggaauauggucauccccgaagggcgcguaaucgaccucggcuguggacgcggcggguggucuuauuacugcgcgggccuuaagaaggugaccgaggugcggggcuacaccaaaggaggccccgggcacgaagagccuguccccauguccaccuacggcuggaaccucguuaagcugauguccgggaaggacguguucuacuugccgcccgagaagugcgauacguuacucugcgacauuggcgagaguagccccagcccgaccgucgaggagucucgcacgauccgggugcuaaaaaugguggagccuuggcugaagaauaaccaguucugcauaaagguacucaacccauacaugccuaccgugaucgagcaccuugaacgccugcagcggaaguacggaggaaugcuugugcgaaacccgcuaucgaggaacagcacgcacgagauguacuggaucuccaacggcaccgguaacaucgucagcuccgugaacauggugagccgccuacuccugaaccgguuuacgaugacccaccgccggcccacgauagagaaggacguggaccugggcgccggcacccgccacguuaacgccgagcccgagaccccgaacauggaugucaucggggagcggaucaagcgcaucaaggaagagcacucgagcaccuggcacuacgacgacgagaacccguacaagacgugggccuaccacggcuccuacgagguuaaggcuaccgggagcgcgagcagcaugauuaauggugucguuaagcuccucaccaaacccugggacguugugccuauggucacccagauggcuaugaccgacaccacuccguucgggcagcagcggguuuucaaggagaagguagacacccgcacgccacggcccaugcccggcacccgcaaagucauggagaucaccgccgaguggcuguggcggacccucggccguaacaagaagccgagacugugcacacgggaggaguucaccaagaagguacgcaccaacgcggccaugggggcuguuuucaccgaggagaaccaaugggauagcgcacgggcugcugucgaagacgaggaauucuggaagcugguggaccgcgagcgggaguuacacaagcugggcaagugcggguccugcguauauaacaugaugggaaagcgcgagaagaagcugggggaguuuggcaaggcgaagggcagccgggccaucugguacauguggcucggggcccgcuaccuggaguucgaggcccuagguuucuuaaaugaggaccacugguuuucccgugagaauagcuacuccggggucgagggcgaggggcuucauaaacugggcuacauccuccgcgacauuagcaagaucccuggcggggccauguacgcggacgacacggccgguugggacacccgaaucaccgaagacgaccugcacaaugaggagaagauuacccagcagauggaccccgagcaucgccagcuggccaacgccaucuucaagcucacguaccaaaacaagguggucaagguccagcgaccaaccccgaaggggaccgugauggacauuaucucccguaaggaccagcgaggcagcggacagguggggaccuacggccugaauaccuuuaccaauauggaggcccagcuaguacgacagauggagggagaaggagugcucuccaaggcggacuuagaaaacccccaucuacuggagaaaaagaucacccaguggcuagagaccaaggggguugagcggcugaagcgcauggccaucagcggcgacgacugugucguaaaacccaucgacgaccgauucgccaacgcccuccuggcccuuaacgauaugggcaaggucagaaaggacaucccccaguggcagccguccaagggguggcacgacuggcagcaggucccuuucugcucucaccacuuccacgaacucaucaugaaggauggccggaagcucgugguucccugccgcccccaagaugagcugaucggacgcgcacggauuucccaaggcgccggguggucacucaaggagaccgcuugccuggguaaggcauacgcacagauguggucccugauguacuuccacaggcgggaccuccgccuugcgagcaaugccaucugcuccgcggucccgguucacuggauccccacgucacggaccaccuggagcauccaugcccaucaccaguggaugaccacggaggacaugcugaccguguggaaccgcgucuggaucgaggacaacccuuggauggaggauaagacacccgugaccacuugggaggacgugccguaccucggcaagcgggaggaccaguggugcggcagccugaucggccugacuagccgcgcgaccugggcccagaacaucuugacagcuauccagcagguccggagccugauaggggacgaagaauuuuuggacuacaugccuagcaugaaacgcuucagaaaggaggaggagagugagggcgccauuugguga

SEQ ID NO: 26123 - RNA, 9873 nt, Artificial Sequence
  derived and/or modified CDS sequence (opt11) from DENV-3__FJ562102__SS-prME
accagccugugucucaugaugaugcuaccggcgacacuggccuuccaccuuacgucccgggacggcgagccgcggaugaucguagggaagaacgagaggggcaagagcuuacuguucaagaccgcguccgggauuaacauguguacacuaaucgccauggaucuuggagagaugugcgacgacacggugaccuacaaaugcccccuuauugccgagguggagcccgaggacauugacugcuggugcaaccucaccagcaccugggugacuuacgggacguguaaucaggccggcgaacaccggcgcgacaagcgguccguggcgcuggcgccacacguuggcauggggcuggacacccgcacccagacauggaugucugcggagggugcguggcgccagguggagaaggucgagacuugggcccuccgccacccggguuucaccauuuuagcuuuauuuuuagcccacuacaucggaaccucccugacucagaagguggugaucuucauccugcucaugcuggucacccccaguaugaccaugcggugcguggggguggguaaccgcgacuucgucgagggccucuccggggcaaccuggguggauguaguccucgagcacggcgggugcgugacaaccauggcuaagaacaagccuacccuggacaucgagcugcagaagaccgaggccacacaacuugcgacguugcggaagcuuuguaucgagggcaagauaaccaacauuaccaccgacagcaggugucccacgcagggcgaggccauccucccggaggaacaggaucagaacuacguguguaagcacacuuacguugaucggggguggggcaacgggugcggccuguucgguaagggcucgcuggugaccugcgccaaguuccaaugccucgagccaauagagggcaaggugguccaauacgagaaccugaaguacacagugauuaucacggugcauaccggagaccagcaccaggucggcaacgacacccagggcgugacugucgagaucacgccgcaggccagcaccguggaggcaguccugcccgaguacgguacuuuggggcuagagugcuccccgcgcaccggcuuagacuucaaugaaaugauccuguuaaccaugaagaacaaggccuggaugguccaccggcagugguucuucgaccugccucuuccauggacguccggcgccaccaccgagacacccacuuggaaccgcaaggagcugcuggugaccuucaagaacgcccacgcaaagaagcaagaggugguagucuuagggucgcaagagggcgccaugcacaccgcgcugaccggggccacggagauacagaacagcggcgggaccuccaucuucgcgggccaccugaaaugccgcuugaagauggacaagcuagaguuaaaggguaugucuuacgccaugugccucaacaccuucguucugaagaaggaagucuccgagacccagcacgggaccauccugaucaagguggaguacaagggcgaagacgcaccaugcaagauaccuuucagcacugaggacgggcaagguaaggcucauaacggccgccugaucaccgcgaaccccguggucaccaagaaagaggagcccgucaacaucgaggccgagccgccguucggggagucuaacaucgugaucggcauuggggacaaggcccucaagauaaacugguacaagaagggcuccucgaucgggaagauguucgaagcaacggcgagaggcgcccgccggauggccauccugggcgauaccgccugggacuucggcagcguggggggggugcugaauucacugggcaagauggugcaucagaucuucgggucagcguauaccgcguuguuuagcggcguguccuggaucaugaaaauaggaaucggggugcugcucaccuggauaggcuuaaacagcaagaacacguccaugagcuuuaguugcauagugaucgggaucaucacgcuguaucucggcgcaguggugcaggcagauaugggcugcgcgaucaacuggaagggaaaggaacugaagugcggcagcgggaucuuugugacaaaugagguccauacauggaccgagcaguacaaguuccaggcggauucuccgaagcgucuugcaacggccauugcuggcgcuugggaaaauggugugugcggcauccggucaaccacccggauggaaaaccuccuguggaaacagaucgcgaacgagcuaaacuauauacucugggaaaacaacaucaagcugacgguagucgugggggacaucaucggcgugcuggagcagggaaagcgcacccugacuccacaaccgauggaguuaaaguacuccuggaaaacuuggggcaaggcgaaaaucguaacggcugagacccagaacagcuccuucaucaucgacggccccaacacgcccgaguguccuagcgccucccgcgcauggaacgucugggagguugaggacuauggguucggcguuuucaccacuaacauuuggcuaaagcuccgcgagguguacacccagagcugcgaccaccgccuuaugagcgcggcuaucaaggacgagcgcgccgugcacgcagacaugggcuauuggaucgagucccagaagaacgggucguggaagcuggagaaggcguccuucaucgagguaaagaccuguaccuggcccaagagccacacccucugguccaacggaguucuggagagcgacaugaucauucccaaaucccuggccggccccaucucgcagcacaaccaccggccaggcuaucauacgcagaccgccggccccuggcaucucggcaaacuggagcuggacuuuaacuacugcgaggggaccaccguuguaaucacggagaacugcgggacgcgcggccccucacucagaaccaccacaguaucugggaagcugauccacgaguggugcugccgcuccugcacccugcccccucuacgguacaugggugaagacggaugcugguacggcauggagauucgccccaucaacgagaaagaggaaaacaugguaaagagccucgucuccgccggcagugggaagguggauaacuucacuaugggagugcugugccuagcgauccucuucgaggaggucaugcgggguaaguucgguaagaagcacaugaucgcggggguacuguucacuuucguccuucuucuauccggccagauuacguggcgcgacauggcgcacacuuucaucaugaucggcagcaacgccuccgaccggauggggaugggcgucaccuaccucgcccugaucgccaccuucaagauccagcccuuccuggcucuuggguucuuccugagaaaguugacgucucgggagaacuuacugcugggcgugggccuggccauggccaccacccugcagcugcccgaggacaucgagcagauggccaacgggaucgcucuaggccucaugacacucaagcucauuacgcaauucgagaccuaccaacuguggacagcacuggugagccugaccugcuccaacacgaucuuuacacugaccguugcauggcgcaccgccacgcugauuuuggccggggugagccugcugccgcucugccagaguagcucaaugcguaagacugacugguuaccgaugaccguagcggccaugggcguaccgccccucccccucuuuaucuucucccugaaggauacucccaaacgccgcaguuggccccugaaugagggggugauggccgucggauuagugagcauccuugccaguucccuccuccggaacgacgugcccauggccggcccgcuggucgcgggcgggcugcuaaucgcaugcuacgugauaacgggaacuuccgccgaccugaccguugagaaggcugcggacgucacgugggaggaggaggcggagcaaacgggagucagccacaaccuaaugaucaccguggacgacgacgggaccaugcgaaucaaggaugaugagaccgagaacauccuaaccgucuuguugaagacggcccuccugaucguguccggcaucuuccccuacagcauccccgcaacccugcucguguggcacaccuggcagaaacagacccagcgguccggcguccugugggaugugccuucaccucccgagacgcagaaggccgaguuagaggaggggguguaucgcaucaagcagcaaggcaucuuugggaagacgcaggucggcgugggcgugcagaaggagggcguuuuccacaccauguggcacgugacccggggcgcggugcuuacacacaacgggaagaggcuggagccuaacugggcuucggucaagaaagaccugaucagcuauggcgggggcuggcgguuguccgcccaguggcagaagggagaggagguccaggugaucgccgucgagcccggcaaaaacccgaagaacuuccagaccaugcccggcaucuuccagacaaccacgggggaaauuggcgcaaucgcgcuggauuuuaagcccgggacgagcggcagcccgauaaucaaccgcgagggcaaggugguuggacuguacgguaacggggucgugaccaagaaugggggguacguaucaggaaucgcacagacuaacgccgagccugacggcccgacgcccgagcuagaggaggagauguucaagaagcggaaccucaccaucauggaccugcacccggggagcggcaagacccggaaguaccugcccgcaauuguucgggaggccaucaaacgcaggcuccgcacucugauccuggcgcccacucgggugguugccgccgaaauggaagaggcccucaagggccugccaauuagguaccagaccaccgccacuaaguccgagcauacgggccgggagaucguagaccugaugugucacgcgaccuuuacuaugcgcuugcugucuccagugcgggugccaaacuacaacuugaucauaauggacgaggcccauuucacugacccggcguccauagcggcucguggauauauaagcacgcgugucggcaugggggaagcggccgccaucuucaugaccgccacgccccccgguaccgcggaagccuucccccaguccaacgcccccauccaagacgaggagcgcgacauucccgaacgcagcuggaacuccggcaaugaguggaucacagacuucgugggaaagacugugugguucgucccgagcaucaaggcuggcaaugacaucgcgaacugccuccggaaaaacgggaagaaggugauccagcugucccgcaaaacauuugauaccgaauaccaaaagacucggcugaacgacugggacuucgugguuaccaccgacaucagcgaaaugggcgcgaacuucaaggccgaccgcgugaucgaccccaggcgcugccucaagcccguuauccugacggacggccccgagcgcguaauccuggccgggccuaugcccgugacugccgcauccgcggcccagcggcgggggcgcguggggcggaauccccagaaggagaacgaccaauacaucuucaccggccagccgcucaacaacgacgaggaccacgcccacuggaccgaggccaagaugcuguuggacaacauuaacacccccgagggcaucauccccgcccucuucgaaccagagcgugagaaguccgcugccauagacggggaguaucggcugaagggugagucccgaaagacauucguugagcugaugcgacgcggggaccuccccguguggcuagcccacaaggucgccagcgaaggcaucaaguacacggaucggaaguggugcuucgauggggagcgcaacaaccagauacuggaggagaauauggacguggagaucuggaccaaggagggagaacggaagaagcuccgcccgcgcuggcuggacgcucggaccuacucagauccccuggcccucaaagaguucaaggacuucgccgcaggccgcaagagcaucgcccuggaccuagugacagaaaucgggcguguccccucgcaucucgccuaccgcacgcggaaugcccucgacaaucuggucauguuacauaccagcgagcacggcgggcgcgcuuaccggcacgccguagaggaacugccggagaccauggagacccuccuccugcuaggccucaugauacugcugaccgggggcgccaugcuguuucugaucagcgggaaggggauaggcaagaccuccauaggguuaauuugcgucaucguuagcuccggcaugcucuggauggcggaugugccccugcaguggaucgccagcgccaucauccuggaguucuucaugaugguccuccugauuccugagcccgagaagcagagaaccccgcaggacaaccagcuggcuuacguggugaucgggauacucacccuggccgcgaucgucgccgcaaacgagaugggccugcucgaaacgaccaagcgagaccugggcauguccaaggagccggggguggugagccccaccuccuaccuggacguggacuuacacccagcuagcgccuggacauuauacgcgguggccacgacugugaucaccccgauguuacgccacacgaucgagaacagcacggccaacgucagccucgccgcgaucgcuaaccaggcagugguguuaaugggccuggacaagggguggcccaucuccaaaauggacuugggcgucccgcugcuggcccucgggugcuacagccaggugaacccccugacacuaaccgccgcagugcuccugcuggucacccacuacgccaucauugguccgggacuccaagccaaagccacgcgggaggcacagaagcgcaccgcugccgguauaaugaagaaccccaccguagacggcaucaugacgaucgaccuggacccuguuaucuacgacuccaaguucgaaaagcagcucggccaggucaugcuccucgugcugugcgccgugcagcuccugcuuaugcggacgagcugggcccuaugcgaggccuuaacccucgcgacaggccccaucaccacgcucugggagggcucaccggggaaguucuggaacacgaccaucgccgucagcauggcaaacaucuuucgcggcucauaccuggccggggcgggccuggcguucucgaucaugaaguccguagggacgggccgccggggcacggggagccagggcgaaacucucggggagaaguggaaaaaaaagcugaaucagcugagccggaaggaguucgaccuuuacaagaaguccggcaucacagagguggauaggaccgaggccaaggagggccugaagcggggugagaccacgcaccacgccgucagccgcggcuccgccaagcugcagugguucguugagcggaacauggugauccccgaggggcgagucauagaccugggcugcgggcgcgguggguggucauauuacugcgcgggccugaagaaggugacggagguccggggcuacaccaagggcggccccgggcacgaggagcccguaccuaugucgaccuacggcuggaaccugguuaagcuuaugagcgggaaggacguguucuaccugccgccugagaagugugacacgcuacucugcgacaucggagaguccagccccucaccuaccgucgaggagagccguaccauccgugugcucaagaugguugagcccuggcugaagaacaaccaguucugcaucaaggucuuaaaucccuacaugcccaccgugaucgagcaccucgagcgccugcagcggaaguauggugggaugcuggugcgcaacccgcugucccggaacagcacgcacgagauguacuggaucucgaacggcaccgggaacauuguaagcagugugaacaugguaagccgccuccuacucaaccgauucaccaugacccaccggcggccuacgaucgaaaaggacgucgaccuuggggccggcacccggcacgugaacgccgaacccgagaccccaaacauggacgucaucggagagagaauuaagcgcauuaaggaggaacacucaagcacauggcauuaugacgacgagaaccccuacaagacgugggcguaccacggaucguacgaagugaaagccaccgggucggcgagcagcaugaucaacggaguggucaagcuccucaccaagcccugggacguggugccgauggugacccagauggcaaugacggacaccacaccguucgggcaacaacggguguucaaagagaagguagacacacgcaccccccggcccaugcccggcacacgcaaggucauggaaaucaccgccgaguggcuguggcggacccuggggcgcaacaagaaaccgcgccucugcacgcgggaggaguucaccaagaaggugcgaaccaaugcggccaugggcgcgguguuuacagaggagaaccagugggacagcgcccgggccgccguggaggaugaggaguucuggaagcugguagaccgcgagcgggagcuccauaagcuuggcaagugcgggucaugcguguacaacaugaugggcaagagagagaagaagcugggggaguuuggcaaggcuaagggcagcagggccauuugguacauguggcugggagcccgguaucucgaguuugaggcucugggcuuccugaacgaagaccauugguucucccgggagaacagcuauuccgggguggagggcgagggguugcauaagcugggcuauauccuucgcgacaucagcaaaauccccggcggugccauguaugcagacgacacggcaggcugggacacccggaucacugaggacgaccuccacaacgaggagaaaaucacccagcagauggacccugagcaucggcagcuggcaaacgccaucuuuaagcucacguaccagaacaaggucgugaagguacaacggccgacuccgaaggggacuguaauggacaucaucuccagaaaggaccagcggggcucaggacaggugggcaccuacggccucaacaccuucacgaacauggaggcccagcugguucgucagauggagggagagggcgugcugagcaaggcggaccucgagaauccccacuugcuggagaagaagaucacacaguggcucgagaccaaggguguugagcggcuaaagcgcauggccauaagcggcgaugauugugucgugaagcccaucgacgaucgauuugcgaacgcccugcucgcccugaacgacaugggcaaagugcgcaaggacauaccccaguggcagccguccaagggcuggcaugacuggcagcagguccccuucugcagccaccauuuucacgagcugaucaugaaggacggccggaagcuuguuguccccugcagaccccaggaugaguugaucgggcgcgcucggaucagccagggcgccgguuggagccuaaaggagaccgccugccucggcaaggcauacgcccaaauguggucccugauguacuuccaccgccgggaccugaggcucgcgucaaaugccauaugcuccgccgucccugugcacuggauacccacgagccggaccaccuggagcauucacgcccaccaccaguggaugaccacggaagacaugcugacaguguggaaccgcguguggaucgaagacaaccccuggauggaggacaagacuccuguuaccacgugggaggacgugccguaucugggcaagagagaggaccaguggugcggaucccugauaggccugaccagccgcgcgaccugggcucagaacauccugaccgcgauucaacagguccgaucccucaucggagacgaggaguuccuggacuauaugccaagcaugaaacgcuucagaaaggaggaggagagugagggagccaucugguga

SEQ ID NO: 26124 - RNA, 9873 nt, Artificial Sequence
  derived and/or modified CDS sequence (opt11) from DENV-3__FJ410229__SS-prME
acgagccuaugcuuaaugaugaugcugcccgcaacccuggcauuucaccucaccagccgagauggggaaccccgcaugaucguggggaaaaacgaaaggggaaaaagucuacucuuuaaaacggcauccggaaucaacaugugcacacucauugcgauggaccugggagaaaugugugacgacacugucacauauaaaugcccacugauagccgaaguagaaccagaagauauugacugcuggugcaaccucacguccacaugggucacauacggcacauguaaccaagcaggggaacaccggcgcgacaaaagaagugucgcucuggccccgcacgugggaaugggucucgacacacggacccagacguggaugagcgcggaaggugccuggcggcaagucgaaaaagucgagacuugggcccucagacaccccggcuucacgauucuagcccucuuccuggcccacuacaucgguacaagccuaacgcaaaaaguugucauauucauucuacucaugcucgugacacccagcaugaccaugcggugcgucggggugggcaacagggacuuugucgagggccuaagcggggcuacgugggucgacgucgugcuagaacacggaggcugugucacaacgauggccaaaaacaaaccaacacuggacaucgagcuacagaaaacggaagcaacccaacucgcgacacuccgcaagcugugcaucgaggggaaaauuacaaacauuaccaccgacucgcgcugccccacccaaggugaagccauccuccccgaagaacaagaccagaacuacguauguaagcacaccuacguggaccgaggcuggggcaacgguugcggccuguucgggaaggggucacucgucacgugugccaaguuccagugcuuagaaccaaucgaaggaaagguaguacaguacgagaaccuaaaguacacagucaucauuacugugcacacaggagaccagcaccaagucggcaaugacacgcaaggggugacgguagaaaucacaccgcaagccucgacaguagaagccguucucccggaguacggaacucuagggcuagaaugcagcccccggacgggacuagauuucaaugaaaugauucugcuaacgaugaaaaacaaggcuuggaugguacaccggcaaugguuuuucgaccuuccccuuccguggacgucgggggccaccaccgaaaccccgaccuggaaccgaaaagaacuucuuguaacuuucaagaacgcacacgccaagaaacaagaagucguugugcuugguucccaagaaggggcaaugcauaccgcgcucacaggcgcuacggaaauccagaacuccgggggaacaaguauauuugcggggcaccucaaaugccggcucaaaauggauaaacuggaacugaaagggaugaguuaugcaauguguuuaaacaccuucguacucaagaaagaagugagcgaaacgcagcauggcacgauuuuaauaaagguggaauacaaaggagaggacgcccccugcaaaauaccguucucaacggaagacggccaagguaaagcccacaacggacgucuaaucacggcuaacccugucgugacuaaaaaggaagaaccuguaaacauagaggcagagccgcccuucggggaaucgaacauagugauagguauaggugauaaagcgcugaaaauaaacugguauaagaaagguagcagcauaggcaagauguuugaggcgacagcgcggggcgcacgacgaauggccaucuuaggcgacacagcgugggacuucggaagcguaggagggguccugaacuccuuaggcaaaaugguccaccagaucuucggauccgcuuacaccgcccuauuuucaggcguaucauggauuaugaaaauagggaucgggguccucuugacauggaucggacuaaauagcaagaauaccagcaugaguuucaguuguaucgugaucggaauaaucacacuuuaccuaggggcaguagugcaagccgacauggggugcgccauuaacuggaaagggaaggagcugaaaugcggaagugggauauucgucacuaacgaggugcacacguggacggagcaguacaaguuucaagcggacagccccaagcgccucgcaaccgcgauagcaggagcgugggagaauggugucugcggcauacgaagcaccacgagaauggaaaaccuacucuggaaacagaucgcaaacgagcugaauuacauacugugggagaacaauauaaaacugacugucgugguaggagauauaauagguguccuggagcaaggaaaaaggaccuugacaccccaaccaauggaguuaaaauauuccuggaaaacaugggggaaagcuaaaauagugaccgcagaaacgcagaacagcuccuuuaucauagacggaccgaacacaccggagugucccuccgcgucaagagccuggaacgucugggaggucgaagacuacggauucggcguguucacgacaaacauauggcuaaaacuacgagagguguauacacaaaguugugaccauagguugaugucagcagcuauuaaggacgagcgcgccgugcacgcugauaugggguacuggaucgaaagccagaaaaacgggagcuggaaacuagagaaagccaguuucaucgagguaaaaacaugcacauggccaaagucacacacgcuguggucgaauggcguauuagaauccgacaugauuauccccaagucacuagcgggaccaaucucccaacacaaccaucgacccgguuaucacacacagacagccggacccuggcaccuggguaaacucgaacuagacuuuaauuacugcgagggcaccacagucguuauuacagaaaacugcggaacccgcggacccucacuaagaacaacaacagucuccgguaaacuaauccacgaaugguguugcagguccuguacauugccaccacucagauacaugggugaagacggcugcugguauggaauggagauuaggccgauaaacgagaaagaagagaacauggugaagucacuuguuagcgcaggcucaggaaaagucgauaacuucacaauggggguccugugucuggcgauccuauuugaagaaguaaugcguggcaaauucgggaaaaagcauaugauugccggggugcuauucaccuucguacuuuugcucagcggacagauaaccuggcgggacauggcacauacacugauuaugauuggcagcaacgcgagugacagaauggguaugggcguaacuuaccucgcgcucauagcaacauucaagauacaaccuuuccuugcccugggguucuuccuacgaaaacuuacgagucgagagaaccuccuacuagguguaggacucgcgauggcaaccacccuccaacucccagaagacauagaacagauggcaaauggaaucgcacucggacuaaugacccugaaacucauuacucaguucgagacauaccaacuguggaccgcauuagucagccugacgugcucgaacacgaucuuuacguuaaccguagcguggaggacagcgacccuuauucuggccggcgucagccuccucccccuuugccaguccaguaguaugcgaaaaaccgacuggcuucccaugacaguagcugcaauggggguacccccacugccacuauuuaucuucagcuuaaaagacacuccaaagaggaggucguggcccuugaaugaaggcguaauggcaguaggcuuagugucgauacuagcgucuucacuacuacgaaacgacgugcccauggccgggccccucgucgccggcggcuuguugauugcaugcuacgugauaacaggaaccucagcugaucucacgguggagaaagccgccgauguuacaugggaagaagaagccgaacagacggguguaagccacaaccugaugaucaccgucgaugacgacggaaccaugcgaauaaaggaugacgaaaccgagaauaucuuaacgguccuacucaagacggcacuucucauugugucugggaucuucccguacaguauucccgcaacccugcuaguauggcacacguggcagaaacagacccagcguagcgggguacucugggacguaccgaguccacccgaaacccagaaggcggaacuggaggagggcguauaccgaauaaaacaacaaggcaucuucgggaagacccagguggguguuggcguccaaaaggaaggugucuuccacacgauguggcacgucacgagaggggcaguguuaacgcacaacgggaaacgacuugaaccgaacugggcaucggucaagaaagaccuuaucagcuauggaggaggauggcgccuuagcgcacaauggcaaaaaggugaggaggugcaagugaucgccgucgaaccgggcaaaaacccaaagaauuuccaaacaaugccgggaauuuuccaaacaacgaccggcgaaaucggggcaauagcacuagacuucaaacccgggacguccggcucgcccaucaucaaccgggaaggaaaagucgucggacuguauggcaacggagucgucacaaagaacgguggauaugucaguggcauugcgcaaacgaacgcagaaccggacgguccaacuccggaacuagaagaggaaauguuuaagaaaagaaaccuuaccaucauggaucuccacccagggucagggaaaaccaggaaauaccugcccgccauaguaagggaggcaauuaaacgaaggcuucgcacccucauucuggcaccaaccagaguggucgccgcagaaauggaggaagcauuaaagggucugccgauccgauaucaaacaacggccaccaaaagcgagcauacgggcagggaaaucguagaccuaaugugccacgcgacauucaccaugcgccugcucagucccguccgcguuccgaauuacaaccuaaucaucauggacgaggcccacuuuacagaccccgccagcauagccgcaagaggguacaucuccacacgcgucggcaugggagaagcggcagcaaucuucaugaccgcaacacccccgggaacggccgaggcauucccccaaagcaaugcgccgauacaggacgaagaacgugacauacccgaaaggucauggaacucaggcaaugaauggauuacggacuuugucgguaaaacugucugguuuguaccaagcauaaaagcaggcaacgacauagccaacugccuucgcaaaaauggcaaaaaggucauccaguugagcagaaaaacauucgauaccgaauaccagaaaacucgacucaaugauugggacuucguggucaccaccgacauauccgagaugggugcgaacuucaaggcggacaggguuauagacccucgccgaugccugaaaccggucauacuaacugacggcccugaacgaguaauucuagcaggacccaugccagucacagcagcaagcgcugcgcaaagacgagggcgggugggccgcaacccgcaaaaagagaacgaccaguacauuuucacgggccagccucuaaauaacgacgaagaccaugcacauuggacggaagcaaaaaugcucuuagacaacauaaauacaccagaagguaucauaccagcgcuuuucgaaccggagcgagaaaaaucugcggccaucgacggugaauacaggcuaaaaggagaaucccggaaaacguucguggaauuaaugcgccggggagaccugcccgucugguuagcccacaagguggcuagugagggcauaaaguacaccgauaggaaguggugcuucgauggcgaaaggaauaaccaaaucuuggaagaaaauauggacguagaaauauggaccaaggaaggcgaacgcaagaaacugcgcccgcgauggcucgacgcccgcaccuauagcgacccacuagcucuaaaagaguucaaagacuucgccgcuggacgaaagagcauagcccucgacuuagugaccgagaucgggcgcguccccagccacuuggcauauagaacccgaaacgcgcuagauaacuuagucaugcuccacacgagcgaacauggcggcagagcuuaucgacacgcagucgaggaacucccagaaacaauggaaacccucuuacuacugggacuaaugauccugcuaacagguggcgcaauguuauuucuaauaagcggcaaaggaauagguaaaacguccaucggacuaaucugcgucaucgucucaaguggaaugcuuuggauggccgacgucccccuacaguggauugcuucagcgauaauauuagaguucuuuaugaugguccuucuaaucccagagcccgagaagcagcgaaccccucaagacaaccagcucgccuaugucgucaucggcauucucacgcuggcggcaaucguugcagcgaacgagaugggucuacuggaaacaaccaaacgagacuuaggaauguccaaggaaccaggcgugguaagucccaccuccuaccucgaugucgacuuacacccagccagcgcguggacccuuuacgccguugcaacaaccguuaucacaccaaugcuuaggcacaccaucgaaaacagcaccgccaacguaucauuagcagcuaucgcgaaccaggcaguaguacuuaugggacuagacaaaggguggccgaucagcaagauggaccuggggguaccgcuacuagcucucggcugcuacagccaggucaaccccuugacguugacugcggcuguacuccugcucguaacacauuacgcaaucauagguccaggucuccaggcaaaagcgacgcgggaagcacaaaaacgcacggcagcggguaucaugaaaaacccaaccguugacggcauaaugaccauagaccuugacccuguaauauacgauaguaaauucgaaaaacaguuaggucaagucaugcuacucguacucugcgccgugcaauugcugcucaugcggacaucaugggcgcuaugcgaggcccucaccuuggccacgggcccaaucacaacgcuuugggaggggagcccuggcaaauucuggaacaccacgaucgcaguaucgauggcuaauauauuccgaggaucauaccuagcaggagcgggcuuagcauucucuaucaugaaauccguagggacuggccggcgcgguacaggcagccaaggggaaacacuaggagagaaauggaaaaagaaacuaaaccagcuaucacgcaaggaguucgaucucuacaagaaauccggcauaaccgaagucgaccgaacagaagcaaaagagggacugaaaagaggggaaaccacccaccacgccguguccagaggaagcgccaaacuacagugguucguggagagaaauaugguuaucccggaaggacggguuauagacuuggguugcggccgcggcgguuggagcuacuacugcgccggacuuaagaaagucacagaaguacggggcuacacaaaaggaggaccaggacacgaggaaccgguccccaugucaacguacggcuggaaccugguaaagcuaaugagcgguaaggacgucuucuaucuacccccggagaagugcgacacacuacugugugacaucggcgagagcucaccgagccccacggucgaagaaagccguaccaucagagugcuaaagaugguggaaccguggcuuaaaaacaaucaguucugcaucaaggucuuaaaccccuacaugccuacagucauugaacacuuggaacgcuugcaacgaaaauacggcggaaugcugguacgcaacccucucagucggaacucgacccaugaaauguacuggauuucaaacggcaccgguaacaucguaaguuccguuaacauggucucgcgccuacuguugaaccgcuucaccaugacacaucggcguccuaccauagaaaaagacguagaccuaggagcgggaacccgacaugucaacgcagagccggagacacccaauauggaugucaucggcgaaagaauuaagaggauaaaggaagaacacucuucaacauggcacuaugacgacgaaaaccccuauaaaaccugggcauaccacggaagcuacgaagucaaagcaacagggagcgcaucaagcaugaucaaugguguggugaaacuccugacaaagccaugggacguagucccaaugguuacccaaauggcaaugaccgacaccaccccauucggucaacaaagaguuuuuaaggaaaagguagacaccagaacgccaagacccaugccuggaacucggaaagugauggagaucacagcggaaugguuguggagaacgcucgggcgcaauaagaaaccacgcuugugcacccgggaggaguuuaccaagaagguccgaaccaacgcagcgaugggugcuguauucacggaagaaaaccagugggacucagcccgagcggccguggaggacgaggaguucuggaaguugguggaucgcgagcgugaacugcacaaacuaggaaaaugcggaaguugcguauauaauaugaugggaaaacgagagaagaaacuuggagaguucggcaaagccaaaggaucacgagccauaugguacaugugguuaggcgcucguuauuuagaguucgaggcgcuagguuucuugaacgaagaucacugguucagucgagaaaacaguuacagcggcgucgagggagaaggacuacacaaacugggcuauauacuccgagacauaagcaagauaccaggcggggcaauguacgccgacgacacugccggaugggacacacgaauaacggaggacgaucuacacaacgaggagaaaaucacccaacaaauggacccagaacacagacaacuagcuaacgcuaucuucaagcugaccuaccaaaacaaaguaguaaagguccagcggccgacacccaaaggcacaguaauggacaucauaucacggaaggaccaaaggggaagcggacaagugggcacauacggucuaaauacuuuuacaaacauggaggcccaacucgugaggcaaauggaaggugaaggaguccucagcaaggcagacuuggaaaacccacaccuacuggaaaagaaaaucacacaauggcucgagacgaagggagucgagcguuugaaaaggauggccaucucuggcgacgauugcguaguaaaaccaauagaugaucgguucgcgaacgcucuauuggcccugaaugacauggggaagguacgaaaagacaucccgcaguggcaaccuuccaaggguuggcaugacuggcaacaggugccauucuguucucaucauuuccaugagcuuauaaugaaagacggucgaaagcuaguuguaccaugccguccccaagacgagcugaucgggagggcccguauaucccaaggagcaggauggagucuaaaagaaacagccugccuuggaaaggcuuacgcacaaauguggagccugauguauuuccacagaagggaccuccgacucgccucaaaugcgauaugcucggcaguacccgugcacuggauccccacaucaagaaccacguggaguauacacgcgcaucaucaauggaugacaacggaagacaugcugaccguuuggaaccgaguauggaucgaagacaaccccuggauggaggacaaaacaccggucacaaccugggaagauguaccuuacuugggaaaaagggaggaccagugguguggcagccuaauagggcuaacuagccgggcgaccugggcccagaacauucuuacagcaauucaacaaguaaggucacucauaggggacgaggaguuuuuggacuacaugcccucaaugaagagauuccggaaggaagaagagagcgaaggagccauuugguag

SEQ ID NO: 26125 - RNA, 9873 nt, Artificial Sequence
  derived and/or modified CDS sequence (opt11) from DENV-3__FJ461326__SS-prME
accaguuugugccuaaugaugaugcucccggccacucuagccuuccaucucacuucaagagacggagaaccccgaaugauaguaggcaaaaacgaaagagguaaaagccuccuguucaaaacggcgagcggcauaaacaugugcacgcuuauagcgauggaucucggggaaaugugugacgacaccguaacauacaaaugcccacuaauagccgaagucgaaccggaagauauugacuguuggugcaaccucaccucgacguggguaacuuaugguacaugcaaucaagccggggaacacagacgcgacaaaagaucagucgcccuagcaccccauguagggaugggcuuagacacccgcacccaaaccuggaugucugcagaaggagccuggagacaaguugagaaaguggaaacuugggcccugcggcacccuggguucacaauacucgccuuauuccuagcacauuacaucucaacaucgcucacccaaaagguagugauuuuuauccuucuuaugcucgugacccccagcaugaccaugaggugcguagggguggguaacagagacuucguggaaggacugagcggcgccacaugggucgacguugucuuagaacacggaggaugcgucaccacaauggcuagaaacaagcccacccuagauaucgaacuucagaagacagaggcgacgcaacuugcaacacuuaggaaauuaugcauugaaggaaaaauuacgaauauaacaaccgacagccgcugcccgacgcagggugaggcgauacuaccggaggagcaagaccaaaacuacgugugcaaacacacauacguagaccgcggcugggggaacggauguggacuauucgggaaagggucgcugguaacaugcgcgaaguuucagugccuggaaccgauagaaggaaaggugguacaauaugagaaucugaaauacacggucaucauuacaguacacaccggagaccaacaucaaguaggcaaugacacacaaggugugacuguggaaauaacaccucaagccaguacgguggaggcggucuuaccggaguaugggacacuugguuuggaauguuccccacggacaggacucgacuucaaugaaaugauccuacucacuaugaaaaacaaagcguggaugguacaccgccagugguucuucgaccugccccucccauggacuagcggcgcaaccaccgagaccccaacguggaacagaaaggagcuacucgucacguucaaaaacgcccaugcgaaaaagcaagaagucguuguccuaggcucacaagagggagcaaugcacacugcccucacaggugcgacagagauucaaaacucaggaggcacaucuauuuucgccggacauuuaaaaugcaggcuaaaaauggauaagcuagagcuuaaagggaugucguacgcaaugugccugaauaccuucguacucaagaaagaagucagcgaaacccaacacggcaccauucuaaucaaaguggaauauaaaggagaagacgccccaugcaaaauacccuucucaacggaagacggccaaggcaaagcgcacaacgggcgucugaucaccgcaaaccccguggucacgaagaaagaagaaccagugaauauagaagcagagcccccguucggagagagcaacauugucaucggcauaggggauaaggcccugaaaaucaacugguauaagaaaggaaguucgauugguaaaauguucgaagcaacggcacgaggcgcccggcguauggcgauacuaggcgacacagcaugggacuucggcucaguagguggcguacugaacagccucgggaagaugguccaccaaauauucgggagcgcuuacacggcgcuauucaguggaguauccuggauaaugaaaaucggcauaggaguuuuguugaccuggauaggccuuaacuccaaaaacacaagcaugaguuuuaguugcauagucaucggcauuauaacacuguaccugggggcagugguccaggcugacaugggcugugcaauaaauuggaagggaaaggaacuaaagugcggcuccggcauuuucguaacuaacgaaguccacacguggaccgagcaguacaaauuucaagcggauuccccaaaacgccuagccaccgcaauagcaggcgcuugggagaacggcguaugcggcauucgaagcacaacgagaauggagaaccugcuauggaagcaaaucgcaaacgaacugaauuacauacuaugggaaaacaacauaaaauugacaguagucguaggagacauaauaggagugcucgaacaaggcaagagaacgcugacaccucagccuauggaacuuaaauacuccuggaaaaccuggggcaaggcaaaaauaguaaccgcggagacgcaaaacuccuccuucauaauagacggccccaacaccccggagugcccgucugcgagccgggcguggaacgugugggaagucgaggacuacggauucggaguauucaccaccaauauauggcuaaaacucagggagguuuauacgcaaagcugugaucaccgccucaugagcgcagccauaaaggacgaacgcgccguccacgcagacaugggauauuggaucgaaucacagaaaaacggaucguggaaacuggagaaagcaaguuucauugaagugaaaaccuguacguggccgaaaagccacacacuguggagcaaugguguacuggaauccgacaugauuauccccaagagccuagcgggaccaaucagccagcacaaccaccggcccggauaucauacacaaaccgcgggaccauggcaccugggcaaguuagagcucgacuuuaacuacugcgagggaacaacggugguaauaaccgagaacugugggacacgcgggcccucacugaggacaacgaccguuucaggcaagcucauccacgagugguguugccgcagcugcacacuaccaccccugcguuacaugggggaagacggaugcugguaugggauggagauaaggcccauaaacgagaaagaggaaaacauggugaaaagccucgucuccgcgggaucuggcaagguagacaauuucaccaugggcguucucugccuagccauauuguuugaggaaguaaugagaggaaaauuuggcaagaaacauaugaucgccggaguccucuuuaccuucguauuauuauugagcggccagaucacguggcgcgacauggcccauacacugaucaugaucggaucaaacgcaucagacaggauggguaugggggucaccuaccucgcacuaauagccaccuuuaaaauacaacccuuucuagcucugggauucuuccugaggaaacuaaccucaagagaaaaccuccuucuaggcguaggccucgccauggcgacgacacuacaacugcccgaagacauagaacagauggcgaacgggauagcccuaggacuuaugacccugaaauugaucacccaauucgagaccuaccaguuauggaccgcucuuguguccuugacuuguucgaacacaauauucacucucacggucgccuggcgaaccgccaccuuaauccucgccggcguuagccuauugccucugugccagagcuccaguaugcggaaaaccgauuggcuaccaaugacaguagcagccauggggguaccgccccuaccacucuucauauuuucacuaaaggacacccccaaaaggagaucguggccgcucaaugaaggaguaauggccgucgggcuagucagcauccuagcuagcucgcuacuucggaaugaugucccaauggcuggcccccugguggcuggaggauuacucauagccugcuaugucaucacaggaacuuccgcggaccugacugucgagaaagcagccgacgugacgugggaagaggaagccgagcaaacaggaguaagucauaaccuuaugauaacaguggacgacgacggcacuaugagaauaaaggaugacgaaaccgaaaacaucuuaaccguacuacuaaaaacugcucuccucauaguaucaggcauauuuccauacucaauaccagcaacccuacucguguggcacacuuggcaaaaacagacacaaagaagcggaguucugugggacgucccaucacccccggagacccaaaaggcagaacuagaagaaggaguauaccgaauaaagcaacaggggaucuucggaaaaacgcagguaggagucggcguccaaaaagaaggaguguuucauacgauguggcauguaacccgaggugcgguccugacucacaacgggaaacggcucgagccuaauugggcuuccgugaaaaaggacuugaucaguuacggaggaggguggagacucagcgcacaauggcagaaaggcgaggagguccagguaauagcagucgaacccggcaaaaaccccaagaacuuucaaacgaugccugguaucuuccaaacaacuacgggcgaaauaggggcaauagcccucgacuucaaaccgggcacaagcggaagcccaauuauaaauagagaaggcaaaguagugggacuauacgggaacgggguggucacuaaaaacggcggauauguuagcggcauagcgcaaacaaacgccgaaccagauggcccgacccccgaacuagaggaggagauguucaagaaacguaaccugacaauuauggaccuccauccggggagcgggaagaccagaaaauaucuaccggcuauaguaagagaagcgaucaaacggcgcuugcgcacauuaauccuugcgccaacacgagucgucgcggcagaaauggaagaagcccugaaaggcuuaccaauccgcuaccaaacgacugccacaaaaucagaacacacgggacgagagaucgucgacuuaaugugccacgccacguucacgaugcgccuucuaagcccagugcgcguacccaacuacaacuuaaucauaauggaugaggcacacuuuacagaccccgcaucgaucgccgcacgcggcuacauaucaacccgagucggaaugggagaagcggcggcaauuuuuaugacagcgaccccgcccggcaccgcugaggcauucccccagucaaacgcgccgauccaagacgaagagagggacauccccgaaagauccuggaacucagggaacgaauggauuacagacuucguuggcaaaacagugugguuugucccguccaucaaagcgggcaaugauaucgccaacugccuuagaaagaacgggaagaaaguuauucaguugucccggaaaaccuucgacacugaauaccagaaaacaagguugaacgacugggacuucgucguuacuaccgauaucagcgaaaugggcgcgaauuucaaagccgaucgagucauagauccacgccgaugccugaaaccgguaauucugacggacggacccgaaagagucauuuuggcagggcccaugccagugacggcggcuucagcagcccaacggcgaggacgggugggacgcaacccacaaaaagaaaacgaucaguacauauucacaggccagccacugaacaacgacgaagaccacgcacacuggaccgaagcaaaaaugcuguuggacaauaucaacaccccggaaggcauuauaccugcauuauucgaacccgaaagggagaaauccgccgccaucgauggagaauacagacuaaagggagaguccaggaagacuuuugucgaguuaaugcgcagaggggaccuccccguguggcucgcccauaagguagcaagcgaaggcaucaaauacacugaucgcaagugguguuuugacggggaacggaacaaccaaauccuagaagagaacauggacguagagauauggaccaaagaaggagagcggaaaaagcuaaggccucgaugguuggacgcccguacuuauucagauccacuggcacuuaaagaguuuaaagacuucgcagcuggcagaaaaucaauagcacuagaccuggucaccgaaauaggacgcguaccgagucaccucgcauaccgcacgcguaaugcauuggacaaucugguaaugcuccacacaagcgagcacggaggccgugcguacaggcacgccguagaagaacuccccgaaacaauggaaacccucuuacuacugggcuuaaugaucuuacugaccgguggcgcgaugcuauuucucauaagcggcaaagggauuggaaagaccucaauaggacuaaucugcguuauagcaucaucgggcaugcucuggauggccgacgucccauugcaguggauagcgagugccauaauucucgaguucuucaugaugguucugcuaauuccagaacccgaaaaacaacgaaccccacaagacaaccagcucgcauacgucgugauaggcauacuaacgcuggccgcgauuguggccgcaaacgaaaugggucuccuggaaaccacaaagcgcgaccugggcaugagcaaagaacccggagucguuagcccgaccucauaccucgacgucgaccuacaccccgcgagcgcauggacucuuuaugccgucgccacgaccgugaucacgcccaugcucagacacacaaucgaaaauucuaccgcuaacgugucgcuagcugcaauugcuaaccaggccguaguuuugaugggccucgacaaggguuggccaaucagcaaaauggacuuaggcgucccgcuacuggcacuaggcugcuacucucaaguaaacccccugacccuuaccgcggccguacuacuucuggugacacacuacgcaauaauaggacccggacuccaggcaaaagcaacucgggaagcccaaaaacgaacagccgcagguaucaugaaaaacccgacagucgaugggaucaugacaauagaucuugauccagugauauacgacagcaaauuugagaaacaacucggacaagugauguugcuaguacuaugcgcuguccaacuacuacucaugcgcacaagcugggcacuaugcgaggcacucacgcuggcuacaggacccaucaccacccugugggaaggaagccccggaaaguucuggaacacaaccaucgcggucuccauggccaacaucuuccgcggaaguuaccuagcaggcgcagggcucgcguucagcauaaugaaauccguagguacggggagacgggggacugggagccagggagaaacacugggcgagaaguggaagaagaaacuaaaccagcuuaguagaaaggaguucgacuuguacaagaaaagcgggauuacggaaguggaccggaccgaagcaaaagagggacuuaaacgaggcgaaaccacucaccaugccgucagccgggggucagccaaacugcaaugguuuguugaaaggaacauggucauuccggagggucgcgucaucgaccuugggugcggccgcgguggauggaguuacuacugcgcgggacuuaaaaaggugaccgagguacgcggcuacaccaaaggcggaccagggcacgaagaaccgguaccgaugucaaccuacggguggaaccugguaaaacuaaugagugggaaggacgucuuuuaccugccgccagaaaaaugcgacacucuacugugcgacaucggggaaucaaguccgucaccgacaguggaggagucccgaacgauucgaguccuaaaaaugguagaaccauggcugaaaaauaaccaguuuugcauuaaaguucucaauccguacaugccaaccgucauagaacacuuggagagacuucaacguaaguacggugggaugcuagucaggaaucccuuaagccgcaacagcacacaugaaauguacuggauaagcaacggaacaggcaauauaguaagcucgguaaauauggugucucgucugcugcucaacagguucaccaugacacacagacggcccacaauagaaaaagaugucgaucucggagcaggaacccgacacgucaacgcugaaccugagacgccaaacauggaugucauaggcgaaagaauaaagagaaucaaagaggaacacucauccacauggcauuaugacgacgaaaauccauacaagacuugggcauaccacggcagcuacgaagugaaagccacgggaagcgccuccucuaugauaaacggggucgucaaacuacucacuaaaccgugggacgucguccccaugguuacgcaaauggcaaugaccgacaccacucccuucgggcaacaacgcguuuucaaagagaagguagacacuagaaccccacgaccaaugcccggcacacggaaagugauggaaauaacggccgaauggcuguggaggacccuagggagaaacaagaaaccgcgacuguguacgcgagaagaguucaccaagaaggugcgaaccaacgcagcaaugggagccgucuucaccgaagaaaaucaaugggacucagcccgagcggcaguugaagaugaagaguucuggaaacucguagaccgagaaagagagcugcacaaacuagguaaaugcgguagcugcguuuacaacaugaugggaaagcgugagaagaaauuaggagaguucggaaaggcgaagggcagccgggcuaucugguacauguggcuaggcgcgcgauaccucgaguucgaagcgcuagguuucuuaaacgaggaccauugguucagcagagaaaauuccuauuccggcguggagggagaagggcugcacaaacuaggcuacauucuccgagacaucucgaagauacccgguggcgccauguacgcagaugacacagcaggcugggacacaagaaucaccgaggacgaccuacacaacgaagagaaaauuacacaacaaauggacccagaacaucgaaaacuggcgaacgcgauauucaaguuaaccuaccaaaacaaggucguaaaaguacagaggcccacaccgaaaggcacgguaauggauauaauaaguagaaaggaucagaggggcagcgggcaaguaggcacguacggccugaacacguuuacgaacauggaagcgcaacugguccggcaaauggaaggcgagggaguacuuuccaaggcagaccuagaaaacccccacuuacuagagaagaaaaucacgcaauggcuagaaacuaaaggagucgaacgacugaaaaggauggcuauaucaggcgaugacugcgucguaaagcccauagaugaccgauucgcuaacgcacuccucgcccugaacgacaugggcaaaguuagaaaggacauaccccaauggcaaccaucaaaaggguggcaugacuggcaacagguacccuucuguucacaccacuuccacgagcucauuaugaaggacgggcgcaaacuuguuguaccaugcaggccccaagaugaguugaucggccgagcacggaucucacagggcgccggguggagccucaaagaaacggcgugucugggcaaggcuuaugcccagauguggagccuuauguauuuccaucggagagauuugagacucgcauccaaugcaauaugcagugccguaccagugcauuggauaccaacgucacggacgacauggagcauccacgcucaccaccaguggaugaccaccgaagauaugcucacgguguggaaucggguguggauagaagauaaucccuggauggaagacaaaacuccuguaacgacaugggaagaugugccauaccucggaaagcgcgaagaccaauggugcggcucacugauagggcuuacgagccgcgcaacuugggcacagaacauauugacggcaauucaacagguccguagccugauaggugacgaggaguuccuagacuacaugccgucuaugaagcgauucaggaaggaagaggaaagcgaaggggcaaucugguaa

SEQ ID NO: 26126 - RNA, 9873 nt, Artificial Sequence
  derived and/or modified CDS sequence (opt11) from DENV-3__FJ461329__SS-prME
accucucugugccucaugaugaugcuucccgccacucuugccuuccacuuaacaagccgggacggagagccacggaugaucguggggaagaacgaacgcggcaagagcuugcuguucaagaccgcguccgggaucaacauguguacccucaucgccauggaccugggcgagaugugcgacgacaccgugacguacaagugcccccugauugcggagguagagcccgaagacaucgauugcuggugcaaccucacaaguaccugggugaccuacgggacuuguaaccaggccggcgaacaccggcgcgacaagcgguccguggcccuggcgccucacguagggaugggacuggacacccgcacccagaccuggaugagcgccgagggcgcguggcgccagguagagaaggucgagacgugggcccuccgccauccggguuuuacaauccuggcgcuuuuccucgcgcacuacaucggcaccucccugacccagaagguggugauauuuauucugcucaugcuggucacccccuccaugaccaugcggugcgugggggugggcaaccgcgacuucgucgagggccuguccggggccacauggguagacgucguccucgagcacggcgggugugugaccacgauggccaagaacaaaccgacccuggauauagagcugcagaaaaccgaggccacgcagcucgccacgcuacggaagcugugcaucgagggcaagaucacgaacaucaccacagacagcaggugccccacgcagggagaggccauacucccggaggagcaggaccagaacuacguuugcaagcacaccuacgucgaccgcggcugggguaaugggugcggccuguucgggaaagguucccuggucaccugcgcgaaguuccagugcuuggagcccauagagggcaaggugguucaguacgagaaccugaaguacacggugaucaucacgguucacaccggggaccagcaucagguuggcaacgauacccagggaguaacagucgaaaucacuccccaggccagcaccguggaggccgugcugcccgaguacggcacccuugggcuugagugcucgccgcgcaccggccuggacuucaaugagaugauccugcucacuaugaagaacaaggcguggaugguacaccgucagugguucuucgacuuaccuuugcccuggacgagcggagccaccacugagacacccacguggaaccgcaaggagcugcuggugaccuuuaagaaugcccacgccaaaaaacaggagguggucguuuuggggucccaagagggcgccaugcacaccgcgcugacaggggccacggaaauccagaacagcggagggaccuccauauucgcuggucaccugaagugccggcucaagauggauaagcuggagcugaaagguaugagcuaugccaugugucucaacaccuuugugcugaagaaggagguuucagagacucagcacgggacuaucuuaaucaagguggaguacaaaggcgaggacgcgccuugcaagauccccuucagcaccgaggaugggcaagguaaggcucacaauggccgcuugauuaccgcaaaccccguggucaccaagaaggaggagcccguuaacaucgaggccgagccgccuuucggggagucgaacaucgugauaggcauuggugacaaggcgcucaaaaucaacugguacaagaagggcuccagcaucgggaagauguucgaggcuacggcacggggcgcccgccguauggccauccugggcgacaccgcaugggauuucgggagcguuggcggggugcuuaacucgcuugguaagauggugcaccagaucuuuggguccgcauacaccgcccuguucucaggcgucagcuggaucaugaagaucggcaucggcguacuucucaccuggaucggauuaaacucaaagaacacguccaugagcuucuccugcaucgugauugggauaauuacacuauaccugggcgccgucgugcaggccgacauggggugugccaucaacuggaagggcaaggagcugaagugcggcagcgggaucuucgugaccaacgagguucauaccuggacggagcaguauaaguuccaggcggauucucccaagcgacuggcuaccgccauagccggcgccugggagaacggggugugcggcaucagaagcaccacccguauggagaaccuccuguggaagcagaucgcgaaugagcugaacuauauacucugggagaacaacaucaagcucacgguggucgugggggacaucaucggagugcucgagcagggcaaaaggacauuaacgccccaaccuauggagcugaaguacuccuggaagaccuggggcaaggcaaagaucgucacggccgagacacagaauagcuccuucaucaucgacggccccaacacgcccgagugucccagcgccagucgggcguggaauguuugggaaguggaagacuacggguuugguguuuucaccacaaacaucuggcugaagcuccgcgagguguacacucaaagcugugaccaccggcuuaugucugccgccaucaaggacgaacgcgccgugcaugccgauaugggcuacuggauugagucccagaagaaugggagcuggaagcuggaaaaagcauccuucauugaggucaaaacgugcaccuggcccaagagccacacccucuggagcaacggcguccuggaguccgacaugaucauucccaagucguuagcggggcccaucagccagcacaaccaccggccgggcuaccacacgcagaccgccgggcccuggcaccuaggaaaguuagagcuugauuucaauuauugcgaaggcaccaccgugguuaucacggaggauugcgggaccagaggccccucccuccggaccacuacgguaagcgggaagcuaauccaugaaugguguugcagauccuguacacugccccccuugcgguacaugggcgaggacgggugcugguacggcauggaaauccgccccaucaacgagaaggaggagaacaugguaaagucacugguguccgccggaagcgggaaaguagacaacuucacgaugggcgugcuaugccuugccauccuguuugaggaaguaaugagagguaaguucggcaagaagcacaugaucgcuggggugcuauuuacuuuuguccuccugcucuccggccagaucaccuggagggauauggcccacacccucaucaugaucggcagcaacgccagugaccggauggggauggggguuaccuaccuggcccugaucgccacguucaagauccagccauuccuugcgcugggguucuuucugcgcaagcucacgagccgggaaaaccuguugcucggaguaggccuggccauggccaccacccuucaauuacccgaggacaucgagcagauggcuaacgggaucgcgcugggccugaugacccucaagcugaucacgcaguucgaaaccuaccagcuguggacggcccucguuagccugaccugcagcaacacgauauuuacccugacuguagccuggcgcaccgccacucucauccuggccggugugagccugcucccguugugccaguccagcuccaugcggaagaccgacuggcugcccaugaccguugccgcgaugggaguuccgccacugccccuguucauuuucagccugaaggacacgcccaagaggcgcuccuggccccucaacgagggggugauggccgugggccuugugagcauccuggccuccagccuccugcgaaaugauguacccauggcugggccguugguagccggcggguuguugauagccugcuaugugaucacggggaccucagcggaccucaccgucgaaaaggccgccgaugucacgugggaggaggaagcggaacaaacgggcgugagccacaaccucaugaucaccgucgacgacgacgggacgaugcgcaucaaggacgaugagaccgagaacauccugacgguccuucucaagacugcgcugcugaucguuuccggcauauuucccuacucgauaccggcgacccuacugguguggcacaccuggcagaagcagacccagcgguccggcguccugugggaugugcccucaccuccagagacccagaaggcugagcuugaagaggggguguaccgcauaaaacagcagggcaucuucgggaagacccaggucggggucggggugcagaaggagggagucuuucacacaauguggcacgugacucguggggcggugcuuacucacaacggaaagcgacuagagcccaacugggcuucggucaagaaggacuuaaucagcuacggcggugguuggcggcugucagcccaguggcagaaaggggaggagguccaggugaucgccgucgagccuggcaagaauccgaagaacuuccaaaccaugcccggcaucuuccagaccaccacgggggagaucggagccauagcccuggacuuuaagcccgggaccagcggcagcccgauaauaaaccgcgagggcaagguaguagggcuguacgguaacgggguugugaccaagaauggcggguacguguccgggaucgcccagacuaacgccgagcccgacggucccacgcccgagcucgaagaggaaauguucaagaagagaaaccugaccaucauggauuugcacccgggcaguggcaagacccguaaguaucuccccgccaucguccgggaggccaucaagcgccggcuccgcacucuuauccucgcgcccacacgcgugguggcugccgaaauggaggaggcguugaagggccugcccauccgcuaccaaaccaccgccaccaaguccgagcacacgggacgcgagaucgucgaccucaugugccacgcgacauucaccaugcgcuugcuauccccggugcgggugcccaacuacaaccucaucauuauggaugaagcccauuucaccgaccccgccuccaucgcagccagaggguacaucucuacgcgggucggaaugggcgaggcggccgccaucuucaugaccgcgacgccgccgggaaccgcggaagcguucccccaguccaaugcgcccauccaagaugaggagcgugauauccccgaacgcagcuggaacucuggcaacgaguggauuacugacuucguugggaagaccguuugguucguccccucgaucaaagccgggaacgacaucgccaauugccuucggaagaacggaaagaaagugauccagcuuucccgcaaaacuuucgacaccgaauaccagaaaacgcggcucaacgacugggauuucgugguuacaaccgauauaagcgaaaugggcgcuaacuucaaggccgaccgaguaauagacccccggcgcugucugaagcccguuauccugacugacgggcccgagagggucauccucgccgggcccaugccggugacagccgccuccgcggcccagcgccggggcagaguugggcggaacccccagaaggagaacgaccaguauaucuucacaggucagccccugaacaacgacgaagaccacgcccauuggaccgaggccaagaugcugcucgauaacaucaacacaccggaggggaucaucccagcucuguuugagcccgagcgcgaaaaguccgcggcuaucgacggcgaguaccggcugaagggagagaguaggaagacauucguugaacucaugcggcgcggggacuugcccguuuggcuggcccacaaaguggcaagcgagggcaucaaauacacggaccggaagugguguuucgacggugagcggaacaaccagauccucgaggagaacauggacguugagauuuggacuaaggagggcgagcggaagaagcugcgcccgcgaugguuagacgcccgcacuuacuccgacccgcucgcccugaaggaguuuaaagacuuugcggccggacgcaagagcauugcgcuggaucuugugaccgagaucggucggguccccucccacuuggcauaccgcacgcggaacgcacuggacaaccucgucaugcuccacaccagugagcacggcgggcgcgccuaccggcacgccguagaggagcugccggagaccauggagacccuccugcuacucggccugaugaucuuauuaaccggaggagcuaugcuguucuugaucucgggcaaggguaucggcaagacguccaucgggcucauuugcgugaucgugagcuccggcaugcuguggauggcggacaucccccugcaauggaucgccagcgcuauagugcuagaguucuucaugaugguguuacuuauuccggagcccgagaaacaacgcaccccacaagacaaccaguuggcuuacguuguaaucgggauacugacucuggccgcgaucgucgcggcuaacgagaugggccuacuugagacgaccaagcgggaccugggaauguccaaagagcccgguguggugagucccaccuccuaucucgacgucgauuugcacccagccucagccuggacucuguaugcgguugccaccacggugaucaccccgaugcuccgccacaccaucgagaacagcacggccaaugucagccuggcggcgaucgccaaccaggccgugguccugaugggccucgacaagggguggcccaucuccaagauggaucugggggucccccugcucgcccuggggugcuacucccagguaaauccgcugacccucacagccgcggugcugcugcucguuacccacuacgccaucauaggcccgggccugcaagccaaggccacgcgggaggcccagaagcgcacagcggcuggaaucaugaagaaccccaccguggacggaaucaugaccauagaccuugaucccgugaucuaugacagcaaguucgagaagcagcuugggcagguaaugcugcuggugcucugugcagugcagcugcuacucaugaggacguccugggcucugugcgaggcucuuacccucgcgaccggccccauaacaacgcugugggaagguucaccggguaaguucuggaacaccaccaucgccgucagcauggcuaacaucuuccggggcuccuaccuggccggggcgggucucgccuuuagcauuaugaaauccguggguaccggccgccguggaacgggaucacagggcgagacccugggggagaaguggaagaagaagcugaaucagcucagccggaaggaguucgaccuauacaagaaguccggcaucaccgagguggaccguacagaagccaaggagggucugaagcggggcgaaaccacacaccacgccgucagccguggcuccgccaagcuccagugguucguggagcggaacauggugaucccagaagggagggugaucgaucugggcugcggacgaggcggauggagcuacuacugcgcgggucugaagaaggugaccgaaguacggggcuacaccaagggcggucccgggcacgaggagccggucccaauguccaccuacggcuggaaccucguaaagcugaugagcgguaaggacguguucuaccugccuccggagaagugcgacacgcuacucugcgacauuggcgagucaagcccuucuccgacgguugaggaaagccgcaccauccgggugcugaagaugguagagccauggcugaagaacaaucaguucugcaucaaggucuugaaccccuacaugcccaccguaaucgaacaccuugagcgccugcagcggaaguauggagggaugcuuguaagaaacccgcucucaaggaacagcacgcacgagauguacuggauaaguaacggcaccgggaacaucgucagcuccgucaacauggugagcaggcugcuccugaaccgguucaccaugacucaccggcggcccacgaucgagaaagaugucgaccugggggcaggcacgagacacguaaacgccgagcccgagaccccgaacauggaugucauaggggagcgaaucaagcgcauaaaggaggagcacuccagcaccuggcacuacgacgacgagaaucccuacaagacgugggccuaccauggcuccuacgaggugaaggccacuggcagugccuccuccaugaucaacgguguggucaagcuccucaccaaaccuugggaugugguacccaugguaacccagauggcaaugacggacaccaccccguucgggcagcagagaguguucaaagagaagguugacacccgcacgccccggccgaugcccggcaccaggaagguaauggagaucaccgccgaguggcuuuggagaacccucggccgcaacaagaaaccacgccucuguacgcgggaagaauucaccaagaaagugcgcaccaacgccgcgaugggggcgguguuuaccgaagagaaccaaugggacagcgccagagcugcagucgaggacgaggaguucuggaagcugguggaccgcgagcgggagcuacacaagcugggcaagugcgggagcugcguguacaacaugauggggaagcgcgagaagaaacugggggaauucggcaaggcgaagggcagccgggccaucugguacauguggcuaggagcccgcuaccuggaguucgaggcccugggcuuccucaaugaggaccacugguucucgcgggagaacagcuacaguggggucgaaggcgagggacugcacaagcuaggcuacauccuccgcgacauuagcaagauccccggcggcgccauguaugcggacgacacggccggcugggacacgcgaaucaccgaggacgaucugcacaacgaggaaaagauaacccagcagauggacccagagcaccgccagcuggccaacgcuaucuuuaagcucacguaccagaacaagguggugaagguccaacgccccacaccgaaggggacaguuauggacauaaucucacgcaaggaccagcgggguuccggccagguggggaccuauggccuaaacaccuucacgaacauggaggcgcagcucgugcgccagauggagggggagggggugcucucaaaggcggaccuggagaacccccaccucuuggagaagaagauaacccaauggcuggagaccaaggggguggagcggcugaagcgcauggcuaucagcggcgacgacugcgucgugaaaccgauugacgaccguuucgccaacgcccuccucgcccugaacgacaugggaaagguaagaaaggacaucccccaguggcagccguccaaaggguggcacgauuggcagcagguccccuucugcagccaccauuuucaugagcucauuaugaaggauggccggaagcuaguggugcccugccgcccccaggacgagcugaucgggcgugcgcgcauaagccagggcgccgguuggucuuuaaaagagaccgccugccuggguaaggccuaugcccagauguggucguuaauguacuuccaucgucgggaucuccgccuggcaaguaacgccaucugcuccgcagucccugugcacuggaucccgacuucucggaccaccuggagcauccaugcccaccaccaauggaugaccacggaggacaugcugaccguguggaaccgcgucuggaucgaagacaaccccuggauggaggacaagacccccgugacuacaugggaggacgugccguaucuaggcaagcgggaggaccaguggugugguuccuuaaucggccuuaccucccgcgcgacaugggcccagaacauccuaaccgccauccagcaggugcggucauugauuggaaacgaggaguuccuugacuacaugcccagcaugaaacgcuuccggaaggaggaggaguccgagggggccaucugguag

SEQ ID NO: 26127 - RNA, 9873 nt, Artificial Sequence
  derived and/or modified CDS sequence (opt11) from DENV-3__KF955459__SS-prME
accagccugugccucaugaugaugcugcccgccaccuuagcauuucaccucacuucgcgggacggcgaaccgcggaugauuguggggaagaacgaacgcggcaaguccuuacuguucaagaccgcgagcgggaucaacaugugcacccuaaucgccauggacuuaggcgagaugugcgacgacacagucaccuacaagugcccccugaucgccgaggucgaacccgaggauaucgacugcuggugcaauuugaccagcaccugggugacuuacgggaccugcaaccaagccggcgagcacaggcgcgacaagcgcucgguggcccuggcaccccacguggguauggggcuugacacccgcacccaaaccuggaugagcgccgagggcgccuggcgucagguugagaagguugagacgugggcccuccgccacccgggguucaccauccuggcguuauuucucgcccacuacaucggcaccucccugacccaaaagguggugaucuucauccugcucaugcuggucacgcccaguaugaccaugcggugcguaggugugggcaaccgcgacuucgucgagggccuguccggggcgaccuggguggacgugguccucgagcauggcgggugcgugaccacgauggcuaagaacaagcccacccucgacauugagcugcaaaagaccgaggccacccagcucgcgacccugcggaagcugugcaucgaggguaagaucacaaacaucaccacugacucccggugucccacgcagggcgaggccauccuccccgaggagcaggaucagaacuacgucugcaaacacaccuacguagaccgcgggugggggaaugggugcggcuuguucgggaaggggucccugguuaccugugccaaguuccagugucucgaacccauagaggggaaggugguccaguacgagaaccugaaguacaccgugaucaucacggugcacaccggggaccagcaucaggucgguaacgacacccaaggggugaccguggagauuacgccccaagcgagcaccguggaggccguacuaccugaguacggcacacucgggcuggagugcuccccgcgcaccgggcucgacuucaacgaaaugauccuccucaccaugaagaacaaggcguggaugguccaccgucagugguucuucgaccugccgcugcccuggacgucuggcgccacaaccgagacacccacguggaaccgcaaggagcugcuggucacguucaagaacgcccacgcuaagaaacaagagguagucgugcuggggucgcaggagggcgccaugcacaccgcacugacaggggccacggagauccagaacagcggagggaccagcauauucgcaggacaccuaaaguguaggcucaaaauggacaaacuugagcugaaagguaugagcuacgccaugugcuugaauaccuucgugcugaagaaggagguuucagaaacacagcacgggacgauccugaucaagguagaguacaagggcgaggaugccccuugcaagauccccuucagcaccgaggacgggcagggcaaggcgcacaauggacgacugaucacugcgaaccccguggucaccaagaaagaggagcccguaaauaucgaggccgagccacccuuuggggaaucgaacaucguuauaggcauuggggacaaggcccucaagaucaacugguacaaaaagggcuccagcauugggaaaauguuugaagcgacagcccggggcgcgcgcaggauggcuauucugggcgacaccgcuugggacuucgggagcgugggcggagugcugaacagccuuggcaagauggugcaccagaucuucggguccgcguacacggcccuauucucuggagucagcuggaucaugaaaaucggcaucgggguucuuuugaccuggaucggauugaacaguaagaacaccuccaugucauuuuccugcauagugauugggaucaucacccuguaccugggcgccguagugcaagcagacauggggugcgccaucaacuggaagggaaaggaacugaaguguggcagcgggaucuucguuaccaaugagguccauaccuggacggagcaguauaaguuccaggcggacucccccaagagacuagcgaccgccauugccggcgccugggagaacgggguaugcgggauccggagcgcgacacggauggagaaccucuuguggaagcaaaucgcgaaugagcugaacuacauccuaugggagaacaauaucaaacugaccguggucgugggggacaucaucggcgugcuggagcagggcaaaaggacgcucacuccccaaccgauggagcugaaguauucauggaagaccugggggaaggccaaaauuguuaccgcugaaacgcagaacagcaguuucaucaucgacggccccaacacccccgagugccccagcgcgucccgggccuggaacgugugggaagucgaggacuacggguucggcguuuucacuaccaauaucugguugaagcuccgggagguauacacucagagcugcgaucaccgguuaaugagugccgccaucaaggacgagcgcgccguccacgcggacaugggguacuggauugagucccagaagaacggaaguuggaagcuggagaaggcuuccuucaucgaagugaagacgugcaccuggcccaagagccacacgcucugguccaacggcguguuggagagcgacaugaucauccccaaaucccuggcagggcccaucucacagcacaaccaccgaccgggcuaucacacacagacggccggacccuggcaccucgggaaguuagagcuggacuucaacuacugcgagggcaccacagugguuauuaccgagaacugcgguacgcgcggccccucccugcggacuaccaccgugucagggaagcugauucacgaguggugcugccgcucgugcacgcugccaccccuccgguacaugggggaggacgggugcugguacggcauggagaucaggcccauuaaugagaaggaggaaaacauggucaagagccuagucagcgcgggcucggggaagguggacaacuucaccaugggagugcugugccuagcgauucuguucgaggaggugaugcgggggaaauucggcaagaaacauaugauugcuggcguccuguucaccuucgugcuacuguuauccggccaaaucaccuggcgcgacauggcgcacacacucaucaugauagggagcaacgccuccgaccggauggggaugggcgucaccuaucuugcccugaucgcgacguucaagauccagcccuuccucgcccugggguucuuucugagaaagcucacaagccgggaaaaccugcugcucggcgugggcuuggccauggccacgacccugcaacuccccgaggacauagaacagauggcgaacgggaucgccuugggccugaugacccucaagcugauuacgcaguucgagacguaucaguuauggaccgcccucgugucguuaacuuguucgaacaccaucuucacgcugaccguugccuggcgcaccgccacccucauccuggcgggcgugucucugcuaccgcugugccaguccaguucuaugcggaagacggauuggcugcccaugaccguggccgccaugggcgugccgccccugccacucuucaucuucagccugaaggauaccccuaagcgacgcucauggccgcuaaacgagggggugauggccgucggacuggugagcauccuggcauccagccuccuacggaaugacgugcccauggcgggaccgcuggucgccgggggccuccugaucgccugcuacgugauuaccgggacguccgccgaucugaccguggagaaagccgcagaugucacgugggaggaggaggccgagcagaccggcguuagccauaaccucaugaucacgguggacgacgacggcacgaugagaaucaaggacgaugaaacugagaacauccuaaccguccuacucaagaccgcacuguugaucguguccggcaucuuucccuacucaauccccgcgacgcuccugguguggcacaccuggcaaaagcagacccagcguuccggcguccugugggacgugcccagcccgcccgagacccagaaggcagagcucgaggaggggguguacagaaucaagcagcagggcauauuugggaagacccaagucggcgugggggugcagaaggagggcgucuuccacacuauguggcaugucacccggggcgccgugcugacccacaacggaaagcgacuggagcccaacugggccuccgucaagaaggaccucaucuccuacggcgggggcuggcgguuguccgcccaguggcaaaagggggaggagguccaggugaucgcugucgagcccgggaaaaauccgaagaauuuccagacgaugccuggcauauuccagaccaccaccggggagauuggcgcgauagcccuggacuuuaagcccgguacgagcggcagcccgaucaucaacagggagggcaaaguggugggccuguacggcaaugggguggugaccaagaauggaggguacguguccggcauagcucagaccaacgccgaacccgacgggcccaccccggagcucgaggaagagauguucaagaagagaaaccugacgaucauggaccugcacccggggagcggcaagacccgcaaguaccuccccgccaucguccgggaggcgaucaagcgccgacuccgcacacugauacucgcccccacacgugugguggccgccgagauggaggaggcccugaaaggccugcccauccgcuaucagacgacugcuaccaagucagagcacaccggccgcgaaaucgucgaccucaugugucacgccacauuuaccaugcgacugcuaagccccgugagagugcccaacuacaaccucaucaucauggacgaggcgcacuucaccgaucccgccuccaucgcugcgcguggauacaucagcacucgugucggaaugggcgaagccgccgccaucuuuaugacagcaacgccgccugggacugcugaggccuuuccccaguccaacgccccgauucaggaugaggagcgugacauacccgagcgcucauggaacuccggcaacgaguggaucacggauuucguggggaagacagugugguucguaccgagcaucaaggccggcaacgauaucgcgaacugccugcguaagaaugggaagaaagugauucagcuuagccgaaagaccuuugauaccgaguaccagaaaacccggcucaaugacugggauuucguggucacgaccgacaucagcgagaugggcgcuaacuuuaaggccgaccgcgugaucgacccccggcgcugccuuaaacccgugaucuuaaccgacggccccgagaggguuauauuagccgggccgaugccagugaccgcugcauccgccgcacagcgccggggccgcguugggcggaacccccagaaggaaaacgaccaauacaucuucacggggcagccacugaauaacgacgaggaccacgcccacuggaccgaggcgaagaugcugcucgacaacaucaacaccccggaggggaucauucccgcgcuguucgagcccgagcgcgagaaaagcgccgccauagacggggaauacagacuuaagggcgaaucccgcaaaacauuuguggaguuaaugcggcgcggggaccugccgguguggcuggcccacaaggucgcgucggaggguaucaaauacaccgaccggaagugguguuucgauggggagcgcaauaaucagauccucgaggagaauauggacguugaaauauggacaaaggagggagagcggaagaagcuccgcccgcguugguuggacgccaggaccuauuccgacccccucgcgcugaaggaguucaaagacuucgccgcaggccgcaagagcaucgcgcuggaccucgugaccgagaucgggcgggucccuagccaucuggccuacagaacgagaaacgcccuggacaacuuagugaugcugcauacgagcgagcacggcgggagagccuaccgacacgccguggaggagcuucccgagaccauggaaacacuccugcugcucggcuugaugauccugcucaccgggggcgcaaugcuguuucucauaagcggcaaggggauuggcaaaacguccaucgggcucaucugcgucaucgucagcuccggcaugcuguggauggcggacgugccccugcaguggaucgccagcgcaaucauccucgaguucuucaugauggucuuacuaauccccgagcccgagaagcagagaaccccacaggauaaccaacucgcauacguggugaucgggaucuugacccuggcagccaucgucgccgcgaacgaaaugggccuacucgagaccacuaagagggaucucggcauguccaaggagccuggggucguguccccuacaagcuaccucgaugucgaccugcaccccgccagcgcguggacacuauacgcuguggccaccacggugaucaccccgaugcuccgccacaccauugagaacuccaccgccaacguuagucuggcggccauugcuaaccaggccguugucuugaugggacucgacaagggguggccaauaucaaagauggaccuggguguuccccugcucgcccugggaugcuacagucaggugaaucccuugacccucaccgcggccguuuuacugcuggucacccacuacgccaucaucggcccgggccuucaggccaaggccacccgggaagcgcagaagcgcacagccgccgggaucaugaaaaaucccaccguggacggcaucaugacgaucgaccuggaucccgucaucuacgauuccaaguucgagaaacagcucgggcaggucauguuacuggugcuaugcgccgugcagcuacugcucaugcggaccagcugggcccugugcgaggcacugacauuggccaccggccccaucacgacccugugggagggcucgccggggaaguucuggaauaccaccauagccgucagcauggccaacaucuuccguggcuccuaccuggcgggggccggccucgccuucagcauuaugaaguccguugggaccggccggagaggcaccggaagccaaggcgagacgcugggugagaaauggaagaagaagcugaaccagcuuagccguaaggaguucgaccuguacaagaaaagcggcaucaccgagguggaccgcaccgaggccaaggaggggcugaagcggggcgagaccacccaccacgccguaucacguggcuccgcaaagcuccagugguucguggagaggaacauggugauucccgagggacgcgucauagaccuaggcugcgggcgcggaggguggagcuacuacugcgccggccugaagaaggugacggaagugcgaggguacaccaaaggcgguccggggcaugaggagcccgucccgaugucuaccuacggauggaaccucgugaaacucaugagcgggaaggauguguuuuaccugccucccgagaagugcgauaccuuacucugcgacaucggagagagcagccccuccccuacggucgaggaaagccgaaccauccggguauugaagaugguggagcccuggcuaaagaauaaccaguucuguaucaagguccucaaccccuacaugcccacggugaucgagcaccuggagcggcugcagcggaaguacggcgggaugcucgugcgcaacccgcugucccggaauagcacccacgagauguacuggaucuccaacggcacgggcaacaucgucuccuccgugaacauggugucccgcuugcuccugaauagguucaccaugacccaccgucggcccaccaucgagaaagacguugauuuaggcgccggcacgcgccacgugaaugcugaacccgaaaccccaaauauggacgucauaggggaacggaucaaaaggaucaaggaggagcacagcuccaccuggcacuacgaugacgagaaucccuacaaaaccugggccuaccacggcuccuacgaggugaaagcgacagggucugccucuaguaugauaaacggcguggucaagcucuuaaccaaacccugggacgugguaccaauggucacccagauggcgaugaccgacacgacacccuucgggcagcagcggguguucaaggaaaagguggacacacgcacgccccggcccaugcccggcacgcgcaaggucauggagauaaccgccgaauggcuguggcggaccuuaggccgcaacaaaaagccacgccuguguacccgggaagaguucacgaagaaggugcgcacuaacgcggccaugggggccgucuucaccgaggagaaccagugggacucugcccgggcggcggucgaggacgaggaguucuggaaguugguggaccgcgaacgggagcuccacaaacugggcaagugcgggucaugugucuauaacaugaugggcaagagggagaagaagcugggggaguuuggcaaggccaagggcagcagagccauaugguacauguggcucggggcccgcuaccuggaguucgaagccuuaggcuuucuuaacgaggaucacugguucucgagagagaacagcuacuccggggucgagggcgaggggcuccauaagcugggcuacauucuccgcgacaucagcaagauccccggcggggcgauguacgcggaugacacagccggaugggacacgagaaucaccgaagacgaccugcacaaugaggagaaaaucacccagcagauggaccccgagcaccgccagcuggccaaugccaucuucaaguugaccuaccagaauaagguggugaaggugcagaggcccacgccgaaggggacuguaauggauaucaucucacgcaaggaccagcggggaucaggccaaguggggacauacggacugaacaccuuuacuaacauggaggcgcagcuggugagacagauggagggggagggcgugcucuccaaggccgaccuggagaauccccaccuucuagagaagaaaaucacucaauggcuggagaccaaggggguggagcgccugaaaaggauggcuauuagcggugacgacugcgucgucaagcccaucgacgaccgguuugccaacgcccuucucgcgcugaaugauauggguaagguucgcaaggauaucccccaguggcagccguccaaaggguggcacgacuggcagcagguccccuuuugcagccaccacuuccacgagcucaucaugaaggacggccggaagcuggucgugccuugccgcccgcaggacgagcugaucgggcgcgcccggaucucccagggagccggcuggagccucaaggagaccgccugccugggcaaggcuuacgcucagauguggucucucauguauuuccaccgccgcgaccuacgccuggcaagcaaugccaucugcucugccgucccgguucacuggaucccaacaucucguaccaccuggucgauccacgcgcaccaucaguggaugaccaccgaggacaugcugaccguguggaaccgcgucuggauugaggacaaucccuggauggaggacaagaccccugugaccacgugggaggacgugccguaccucggcaagcgagaagaucaguggugcgggucccuaauaggccugaccagccgcgccaccugggcucagaacauucucaccgccauccagcagguucgaagucugaucggagacgaggaauuucuagacuacaugcccagcaugaagcgcuuccggaaggaagaggagagugagggcgccaucugguga

SEQ ID NO: 26128 - RNA, 9873 nt, Artificial Sequence
  derived and/or modified CDS sequence (opt11) from DENV-3__FJ547066__SS-prME
accagccugugccuaaugaugaugcugccugcgacccuagcguuccaccuaaccucgagggacggagagccgcguaugauaguggggaagaacgagcgaggaaagaguuuguuguucaagaccgcguccgggaucaacauguguacguugauagcuauggaccugggagaaaugugcgaugauaccguaacguacaagugcccgcuuauagccgagauggagcccgaagauaucgacuguuggugcaacuuaacuucaacuugggucacuuacgggacgugcaaccaggcgggcgagcaccggcgugacaagcgguccguagcccuagcaccucacgugggaaugggucuggacacgcgcacucagaccuggaugucggccgagggcgcuuggagacaggucgaaaagguggagacgugggcucugcggcacccgggcuuuacgauuuuagcgcuguuucucgcacacuacaucggcacaucccuuacucagaaggucgugaucuucauccugcucaugcuugugacgccguccaugaccaugcggugugucgggguggggaacagagacuucguggagggcuuauccggcgccaccuggguggaugugguccucgagcacggaggcugcgucaccacuauggccaaaaauaagcccacgcuugacaucgagcuucagaagacggaggccacccagcucgcgacgcuucguaagcugugcaucgaaggcaagaucaccaacaucaccacggauagccgcugcccuacgcagggcgaggcuaucuuacccgaggagcaagaccaaaacuacgugugcaagcacacuuacguggaccggggguggggcaacgggugcggucuauucgggaagggaucccuggucaccugugccaaguuucagugccucgagcccauugaagguaaagucgugcaauacgagaaccugaaauacaccguuaucauuacggugcauacgggggaucagcaccagguaggcaacgacacccaaggugugacaguggagauaacgccccaggccucaacagucgaagccguccugcccgaguacggcacgcuggggcuggaaugcagcccacgaaccggccucgauuucaacgaaaugauccucuugaccaugaagaacaaggcguggauggugcaccggcaaugguuuuucgaccucccccucccguggacuagcggcgccacaaccgagacaccaacguggaaccgcaaagagcugcugguaaccuuuaagaacgcgcacgccaaaaagcaggagguggugguucucgguucacaggagggagccaugcacaccgcccugacaggggccacggagauccagaacucaggcgguaccucgaucuucgccggucaccucaagugccgguugaagauggauaaacuggagcuaaagggcaugagcuacgccaugugccucaacacuuucgugcugaaaaaagaagugagcgagacccagcacgguacaauacugauaaaggucgaguacaagggcgaggaugccccgugcaagaucccauucagcacagaggacgggcagggcaaggcgcacaauggcagacugaucacggcuaaucccguggucaccaagaaggaggagcccgucaauauagaggccgagccgccuuuuggggaaucuaacaucguaauaggcaucggggacaaggcccuuaagaucaacugguacaagaagggcuccuccaucggcaagauguucgaagcgacggcccggggcgcgcgacggauggccauccugggagacaccgccugggauuucgguuccgugggcggggugcugaacagccucggaaagaugguacaccagaucuucgggucagcguacaccgcucuguucucuggcguauccuggaucaugaagaucgguauaggggucuugcuuaccuggaucgggcugaacaguaagaacacgaguaugucguucuccugcaucguaaucggcauaaucacacuguaccucggugcagugguccaggccgacaugggaugugcuauuaacuggaaggggaaagaguuaaagugcgguagcggaaucuuugugacgaacgagguacacaccuggacggagcaauauaaauuccaagcggacaguccgaagcgccucgcuaccgccaucgccggcgccugggagaauggggucugcggcauucguagcaccacccggauggagaacuuacuguggaagcagauugcuaacgaauugaacuacauccucugggaaaauaacauaaaguugacgguggugguaggcgacaucaucggcguccucgagcagggcaagcguacccucacgccacaaccgauggaacuuaaguacuccuggaagaccugggggaaggccaagauaguuacggccgagacccagaacagcucauucauaaucgacggccccaauacccccgagugcccauccgcuucccgggcguggaaugucugggagguggaggacuauggguucggaguguucacgaccaacaucuggcugaaguugcgggaggucuacacccagucgugugaccaccggcugaugagcgccgccaucaaagaugagcgagcugugcacgcagauaugggcuacuggaucgagucccaaaagaaugggucauggaagcuggaaaaggcuaguuucauagaggugaagacaugcaccuggcccaagucucacacacuaugguccaacggcguccuugaguccgacaugaucauucccaagagucuugccgggcccaucagccagcauaaccauaggccgggcuaccacacgcagacggccggacccuggcaccuugggaagcuggagcuggauuucaacuacugcgagggcaccacaguuguaauaacagagaauugugggacucguggccccuccuuacggacuaccacgguauccgggaagcucauucaugagugguguugccgcuccuguaccuugcccccacuccgguacaugggugaagacggaugcugguacgguauggagauccgcccgauuaacgagaaggaggagaacauggucaagagcuuggucucggcuggcagcggaaagguagacaacuucacaaugggcguccuuugccuugcaaucuuguucgaggaggugaugcguggcaaguucgguaagaagcacaugaucgcgggggucuuauucaccuucgugcuccugcucuccggccagaucaccuggcgcgacauggcccauacccuaaucaugaucgggucaaacgccuccgaccggaugggaaugggcgugacuuaccuagcccugauugccaccuucaagauacaacccuuccucgcguugggguuuuuccuccgcaagcucaccucacgggagaaucugcuguuaggugucggguuagccauggccacgacccuucaauuacccgaggauaucgagcaaauggccaacgggaucgcgcuaggauugaugacccuaaaacugaucacgcaguucgaaaccuaccagcuguggaccgcccucgugagucucacaugcucaaacacgaucuucacauugacuguggccuggcguacggccacgcucauccuugccgggguuuccuuauugccccugugccaguccagcaguaugcggaagacggacuggcugccuaugaccguggcagcaaugggcgugcccccgcuaccacuuuuuaucuucagccugaaggacaccccuaaacgccgcuccuggccacucaacgaaggggugauggccgugggucuggugagcauccuagccucuagccuccuucggaaugacgugcccauggccggaccacugguggcaggggguuugcugaucgcaugcuacgucaucaccggcaccagugcugaccugaccgucgagaaggcagccgacgugaccugggaggaagaggccgagcagacgggggugagccacaaccucaugauaacaguggacgacgacggaaccaugagaaucaaggacgacgagacugaaaauauccuuaccgucuuacucaagacugcccucuuaaucgucuccggaauauuccccuauagcauccccgccacacuacugguguggcacaccuggcagaaacagacccagcggucaggcgugcucugggacguccccagucccccggagacccagaaggcggagcuugaggagggaguguaccgcauaaagcagcaggguaucuuuggaaaaacccaggugggagucggggugcagaaagagggaguguuccacacuauguggcacgucacccggggcgccgugcugacacacaaugggaagaggcuggaacccaacugggcguccgugaaaaaggaccucaucagcuacggaggcggcuggcgguuaagugcccaguggcagaagggggaggaaguccaggugaucgccgucgaacccggcaagaaccccaagaauuuccagacaaugcccggcaucuuccaaaccaccacgggggaaauuggcgccaucgcgcuggacuuuaagcccggaacgagcggguccccgaucauaaaccgcgaaggcaaagucguagggcuauauggcaacgggguggucaccaaaaacggcggauaugugucuggcaucgcccagaccaacgccgagcccgauggaccuacgccugaacucgaggaggagauguucaaaaagcggaaccugaccaucauggaccugcaucccggaagcggcaagaccagaaaguaucugcccgcuauugugcgcgaagccaucaaacgaagacugcgcacucuaauacuugcgccuacucgggucguggcugccgagauggaggaggcccugaaggggcugccuaucagauaccagacgacggccaccaagagcgagcacacgggacgggagaucgucgaucugaugugccacgcuacauuuaccaugcgcuugcuaucgccggugcggguuccaaacuacaacuugaucaucauggacgaggcccacuucacagacccugccaguauagccgcccgcggauacauaagcacgcgggugggaaugggugaggcggccgccaucuucaugaccgccacgccucccgggacagcggaggccuucccgcaguccaacgccccuauacaggacgaagaaagggacauccccgagcgcagcuggaacuccggaaacgaguggauaacggacuucgucgggaagacagugugguucguacccagcaucaaagccggaaacgauaucgcuaauugccugcggaagaacgggaagaagguaauucagcugucucgcaagacauucgauaccgaguaucaaaaaacgcgucucaacgacugggacuucguggucacgaccgacauaagcgagaugggugcgaacuucaaggccgacagaguaauagacccucggcguugccugaagcccgugauuuuaacggauggccccgagcggguuauccucgcaggacccaugcccguuacggccgccucggcggcccagaggcgcggacgcguggggcggaacccgcagaaggaaaacgaccaguacaucuucaccgggcagccccuaaacaacgaugaggaucacgcccacuggacugaggccaagaugcugcucgacaacaucaacacaccggagggaauaaucccggcucuguuugagcccgagcgcgaaaagucggcggccaucgacggcgaguaucgacugaaaggggagucccgcaaaacuuucguugagcucaugaggcgcggcgaccucccggucuggcucgcccacaagguugcgagcgagggaaucaaauauacggaccggaaaugguguuuugacggggagcgcaacaaccagauuuuagaagagaauauggacgucgagaucuggaccaaggagggcgagcggaaaaagcuacgcccacgcuggcuggacgcucggacguacuccgauccccuggcucucaaggaguuuaaggacuucgcggccggccgcaaaagcauugcccucgaucucgugacagagaucggaagggugccuucccauuuggcguaccgcacucgcaacgcucuggauaaccucguaaugcugcacaccucggagcacggcggacgagcuuacagacacgccguggaggagcugccggagacgauggaaaccuuguuauuguuaggccugaugaucuugcuaaccgggggggcaaugcuguuccuuaucagcggaaaggggaucgguaagacuuccaucgggcucaucugcgugauaguuagcucaggaaugcuguggauggcggacgugccacugcaguggaucgccucggccaucauccucgaauucuucaugaugguacugcugauccccgagccggagaagcaaagaaccccgcaggacaaccaacuagccuacguggugaucgggauccugacucuggcggcuaucguggccgccaacgagaugggguugcuagaaacuaccaagcgggaccuugguaugucgaaggagcccggcgucguuucucccaccuccuaccucgaugucgaucugcaucccgcuagcgccuggacccuuuacgcagucgccacaaccguuaucacaccgaugcuccgccacaccauugagaauuccaccgcaaacgugucccuagccgcgaucgccaaccaagccgucguacugaugggccuugauaagggguggccgauuuccaaaauggaccugggagucccccuguuagcccuagguugcuacagucaagucaacccccucaccuuaacugccgcggugcuacugcucguaacccacuacgccauuauuggcccgggcuuacaggccaaggcaacucgggaagcccaaaagagaaccgcggccgggaucaugaagaaccccacagucgauggcaucaugaccaucgaccuggaccccgugaucuaugacuccaaguucgagaagcaacucggccagguaaugcugcucguccucugcgcggugcagcugcugcuaaugcggacgagcugggcccugugugaagcccugacucuggcgacgggucccaucaccacguugugggaaggcucuccggggaaguucuggaacaccaccauagcugugagcauggccaauaucuuccgugggucauaccuggccggagcagggcucgcguuuucaaucaugaaguccguggggaccggccgucgcggcacggggagccagggagaaacccugggagagaaguggaagaagaaguuaaaucaauugagccggaaagaguucgaccuguacaagaaauccggcaucacagagguugaccguaccgaggccaaagaggggcugaaaaggggcgagacuacgcaccacgcugugagccgcggcucagccaagcuccagugguucgucgagcgcaauaugguuauaccagaaggacgcguuaucgaccugggaugcggccgcggaggguggagcuacuacugcgcgggccugaagaagguuaccgaggugcggggcuacacuaagggcgggccgggucacgaggagcccgugccgauguccaccuacggcuggaaccuugucaagcugaugagcggcaaggacguguucuaccugccgccugagaagugcgacacgcuguugugcgacauaggcgaguccagccccuccccgaccguggaggagagcaggaccauccggguucuaaaaaugguggaacccuggcugaagaacaaccaguucugcaucaaggugcucaaccccuacaugccaaccguaaucgagcaucucgaaagauugcagcggaaguacggcgggaugcucgugcgcaacccgcuaucccgcaauagcacgcacgagauguacuggauuucuaacggaaccgggaacaucguguccuccgugaacaugguaucccgucugcuacuuaaccgguuuacaaugacccaccgccgacccaccauugagaaggacguggaccuuggggccggcacacgccacguaaacgcugagcccgagaccccaaacauggacgugaucggggagcggaucaagcgcaucaaagaggagcauucgucuaccuggcauuacgacgacgagaaucccuacaagacgugggccuaccauggcuccuaugaaguuaaggccaccgggagcgcgagcuccaugaucaaugggguagugaagcuccugacuaagccaugggacgucgugcccauggugacccagauggccaugacggacacgacccccuucgggcagcagcgggucuucaaggagaagguggauacucgcacgccacggcccaugccgggcaccaggaaggugauggagaucacagcggaguggcuguggcgaacccucggcaggaacaaaaagccgcgccugugcacacgagaggaauucaccaagaagguccgcacgaacgccgccaugggggcggucuucaccgaagagaaccaaugggacagugcccgggcugcaguggaggaugaaggcuucuggaagcucgucgaccgcgaaagagaacuucauaagcuuggcaagugcggcucgugcgucuacaauaugaugggaaagcgcgagaagaagcugggagaguucggcaaggcgaaggggucccgggcgaucugguacauguggcucggagcacgguaccuggaguucgaagcgcugggauuucuaaacgaggaucacugguucucccgggagaacagcuacagcggcguugaaggugagggcuugcacaaacuaggcuacauauuacgcgacaucagcaagauccccggaggagccauguacgcggacgacacugcggggugggacacccggaucaccgaggacgaccugcacaaugaggagaaaauaacccagcaaauggacccugagcacagacagcuggccaacgcaaucuuuaagcucacauaucagaacaagguagugaaagugcagcggccaaccccgaagggcaccgucauggacaucauaagucgcaaagaucagcgggggagcggccaaguaggcaccuacggguuaaauaccuucaccaacauggaggcacagcuggugcgccagauggagggugagggggugcucuccaaggcggaucuggaaaauccccaccucuuagaaaagaagaucacccagugguuggagaccaaggggguugagagguuaaaaaggauggccaucaguggcgacgacugcguggucaagcccaucgaugaccgauuugccaacgcucuccuggcccuuaaugacaugggaaaggugcgcaaggacaucccccaguggcaaccguccaagggguggcacgacuggcagcaagucccguucuguucucaucauuuccaugagcugaucaugaaggacgggcggaagcugguggugccaugccguccccaagacgagcugaucggcagggcgcgcaucucccagggagccggcuggagcuuaaaggaaacggcgugccugggaaaggcguaugcucagaugugguccuugauguacuuccauagaagggaccucagacuggcgagcaacgccauuugcucagccguaccggugcacuggauccccacgagccguaccaccuggagcauucacgcccaccaccaguggaugaccacggaagacaugcuuaccguuuggaaccgcguguggauagaggacaacccguggauggaggauaagacuccagucaccacgugggaggacgugccuuauuuagggaagagggaggaccaguggugcggcucccugauugggcuuacaagucgcgcuacaugggcccagaacauccucaccgcuauccaacagguccggucccugaucggcgacgaggaguuccuggacuacaugccaucaaugaagcgcuuccgaaaagaagaggaguccgaaggggccaucugguaa

SEQ ID NO: 26129 - RNA, 9873 nt, Artificial Sequence
  derived and/or modified CDS sequence (opt11) from DENV-3__KF955460__SS-prME
accucacugugccuuaugaugauguuacccgcgacccuugccuuccaccucacaagccgggacggcgagccacggaugaucguagggaagaacgagcggggcaaaagccugcuguuuaagaccgcguccgggauaaacaugugcacccucaucgcgauggaccugggcgagaugugugacgauaccgugaccuacaaguguccucuaauagccgagguggagccagaagacaucgacuguuggugcaaucucaccagcaccugggugaccuacgggaccuguaaucaagcaggcgagcaccggcgcgauaagcggucggucgcccuggcgccccacguagguauggggcuugacacacgcacccagaccuggauguccgccgaaggcgccuggcgccagguggaaaagguggagaccugggcucugcggcacccgggguucacaauacuggcacuguuccuugcccacuacauaggcaccucccugacucagaaggugguuaucuuuacgcugcucaugcuggucacccccuccaugaccaugcggugcgugggcgucggaaaucgcgacuuugucgagggacuguccggggccaccuggguagacgugguucucgagcacggcgggugcgugacgaccauggcgaagaacaagcccacgcuggacaucgaauugcagaaaaccgaagccacccagcuagcgacccugcggaagcuaugcaucgaggguaagauuaccaauaucaccacagacagucgcugcccgacccagggcgaggccauccucccggaggagcaggaucagaacuaugugugcaagcacaccuacguggaucggggguggggcaacgguugcggcuuauucgggaaggguucccuggugaccugcgcaaaguuccaaugucucgagcccaucgagggcaaggugguccaauacgagaaccugaaguacacggugaucauuaccgugcacacaggggaccagcaccaagucggcaaugacacccagggggugacgguagagaucacgccccaggccagcacuguggaggccguucugcccgaguacggcacacuagggcuggaaugcucaccgcgcaccggccuggauuucaacgagaugauacuccugacgaugaagaacaaagccuggaugguccaccggcagugguucuuugaccuuccccuaccuuggaccucgggcgccacgaccgagacgcccaccuggaaccgcaaggagcugcuggucacuuucaagaacgcccaugccaagaaacaggaaguagucgugcuagggucccaggagggcgccaugcacaccgcgcugacgggagccaccgaaauccagaacagcggcgggaccuccaucuucgccgggcaucugaaaugccgguuaaagauggacaagcuugaacugaaaggcaugucguacgccaugugucuaaacaccuucgugcucaagaaggagguuuccgagacgcagcacgggaccauccugauaaaaguagaguacaagggggaggacgccccauguaagauccccuucagcaccgaggacgggcagggcaaggcgcauaaugggcgccuaaucaccgcgaaccccguugucacgaagaaagaggagccggugaacaucgaggccgaaccgcccuucggggagucaaacauugugaucggcaucgggaacaaggcccuuaagaucaauugguacaaaaaagggucuagcaucgggaagauguucgaggcaaccgcccggggagcccgcaggauggcuauccugggagauaccgccugggacuucgggagcgucggcgggguucugaauagccucggcaaaauggugcaccagaucuucgggucagcguauacggcccuguuuagcggcgucuccuggaucaugaagauugggaucggggugcugcucacguggauuggucuuaauagcaagaacaccucuaugucauucuccugcauagugaucggcaucaucacacuguaccuaggcgcagucgugcaggcggacaugggaugugccauaaacuggaagggaaaggaacugaaguguggaucggggaucuucgugacuaacgagguccacacuuggacggagcaguacaaguuccaggcagacucccccaagcgccucgccacugccaucgccggcgcaugggagaacggggugugcgguauucgcagcacuacgcggauggaaaaucuccuguggaagcagaucgcgaaugagcugaacuacauacugugggaaaacaauaucaagcugaccguagucgucggugauauaaucggcguguuagagcaggguaagcgcacccuuacuccccagccgauggagcugaaguacuccuggaagacgugggguaaggccaagaucgucaccgcugagacccagaacagcaguuucaucaucgacggacccaacaccccagagugccccagcgccucccgagcguggaacgugugggagguugaggacuacggguucggcgucuucacgacgaauaucuggcugaagcuacgcgagguguacacccagagcugcgaucaucggcugauguccgcagcgaucaaggaugaacgcgcuguacaugcugacaugggcuauuggaucgagucucagaagaacggguccuggaaguuagaaaaggccuccuucaucgagguaaaaacuugcaccuggccaaagucccacacgcucuggucaaacggcgugcuggagagcgacaugauaauccccaagucccuagccgggcccauuagccagcacaaccaccggccgggcuaccacacccagaccgcaggaccuuggcaccucggcaagcuggagcuugacuuuaacuacugcgaaggaacaacggugguaaucacugagaacugugguaccagaggcccuucccuccgcaccacgaccguauccgggaagcugauucacgaguggugcugccgcuccugcacccugccaccccuccgguacaugggcgaagacgggugcugguacgggauggagauccgccccaucaacgagaaggaggagaacauggucaaaucccuugucucugccggcagcgggaagguggacaacuucacaaugggcguucugugccuugccaucuuguucgaggaggucaugcgggggaaguucgggaagaagcacaugauugcgggugugcuuuucacguucgugcuccugcugaguggccagauaaccuggcgcgacauggcccacacuuugaucaugaucgguagcaacgccagcgaccgaauggggaugggcgucacauaccucgcccugaucgccacguucaaaauccagcccuuucuggcccugggguucuuccugcgcaagcucaccagccgcgagaaccugcugcucggugugggccuagcaauggccaccacccugcaauugccggaggacaucgagcaaauggccaaugggaucgcuuuaggccugaugacgcucaaauugaucacccaguucgagacuuaccaauuauggaccgcauuagugagcuugaccugcuccaacaccaucuucacccuuaccgucgcuuggcgcacggcgacccucauccucgcggggguuucgcugcucccucugugccaguccucaucaaugcggaaaaccgacuggcugcccaugacagucgccgcgaugggugugccgccccugcccuuauucaucuucucacugaaggacacgccaaagcgccgcuccuggcccuugaaugagggaguuauggccgucggcuuagugagcauucucgccuccucccuccuacggaaugaugugcccauggcuggcccccuggucgcuggcgggcuccugaucgcgugcuauguaaucacggggaccuccgccgacuugaccguggagaaggccgccgacgucacgugggaagaggaagcggagcagaccggggugagccacaaucucaugaucaccguggaugacgacgggaccaugcgcaucaaggacgacgagacugagaacauccugacgguccugcucaagaccgcacugcugaucguaagcggcauuuuccccuacagcaucccggccaccuugcugguuuggcacaccuggcagaagcagacgcagcggaguggcgugcucugggacgugccaucuccgccggagacccaaaaagcugagcucgaagaggggguguaccgaaucaagcagcagggcaucuucgggaagacccaagucggcguggggguucagaaggagggcgucuuucacaccauguggcaugugacucguggcgccgugcugacccacaacgggaagcgccuggaacccaacugggccagcgucaagaaggauuugaucucauacggaggcggcuggaggcucucugcccaguggcagaagggugaggaaguccagguaauugccguggagcccggcaagaacccgaagaauuuccagaccaugcccggcaucuuccagaccaccaccggggaaaucggcgccaucgccuuagacuucaaaccagggaccagcggcagcccgaucaucaacagagagggcaagguggucggauuguacggcaauggaguggugaccaagaauggcggguacguauccggcaucgcacagacgaaugccgaacccgacggcccuacgcccgagcucgaggaggagauguucaagaagcggaaccucaccauaauggacuugcaccccggaagcggcaagacccgcaaguacuuacccgccauaguccgggaggcaaucaagcgcaggcugcgcacccugauauuagcgcccacccgagugguggcugcggagauggaggaggcccugaaaggacuucccauccgcuaccagacaacagccacuaagagugaacauacgggccgggagaucgucgacuugaugugccacgcgaccuucaccaugcgccugcugagcccaguccgagugccuaacuacaaucucauuaucauggacgaggcccacuucacggaccccgccuccaucgccgcccgcggguacaucucgacacgaguagguaugggagaggcggccgccaucuuuaugaccgcgacgccgcccgggacggcggaagccuucccccaguccaacgcacccauccaggaugaggagaaggacauacccgagcgcagcuggaacagcggcaacgaguggaucaccgauuucgugggaaagaccgucugguucgugcccucgauaaaggccggcaacgacaucgccaacugcuuacgcaagaacggaaagaaggucauccagcugucccgaaagaccuucgacaccgaauaccaaaaaacgcgccuuaacgacugggauuucgugguaacgaccgacaucagcgaaaugggagcgaacuuuaaagccgaccgggucaucgacccacgccggugccugaagcccguuauucugacggacggcccggaacgcgucauccucgccggcccaaugcccgugaccgccgccagcgcggcgcaacggcggggacggguggggcgcaacccccagaaggagaacgaccaguauaucuucaccggccagcccuugaacaacgacgaggaccaugcccacuggaccgaagccaagaugcuccucgauaacaucaacaccccggaggggaucauacccgcuuuauucgagccugagcgggagaaguccgcggccauagauggcgaguaccgccugaaaggcgagucccggaaaacuuucgucgagcuaaugcgccgcggggaccugcccguguggcuggcccacaaggucgccucagaaggcaucaaguacacugaccgcaaguggugcuucgacggcgagcgcaacaaucagauacuagaggagaauauggauguggagaucuggacuaaggaaggcgagcgcaagaagcugcggccgcgcuggcuggaugcacgcaccuauuccgacccccucgcccugaaggaauucaaggacuuugccgcaggccgcaagucaaucgccuuagaccucgugacggagauaggacgcgugcccucccaucuugccuaccggacccgcaacgcucuggacaaucucgucaugcugcacaccagcgagcacggcgggcgagccuaccgccaugcgguggaggaguugccagagaccauggagacgcuccugcuucugggcuugaugauucugcucaccgggggcgcgaugcuguuucugaucagcggaaaggggaucggcaagaccuccaucgggcugaucugcgucaucgugagcuccggcaugcuguggauggcggacgugccucuacaguggaucgcuucagccauugugcuagaguuuuucaugaugguguuacugaucccugagccagaaaagcagcggaccccgcaggauaaccagcucgccuacguggugaucggcauccugacccuggcggcgaucguagcggccaaugagaugggccuccuggaaaccaccaagagggaccugggcauguccaaggagccgggcguggucagccccaccucauaucucgacguggaccugcaccccgccagcgccuggacacuguacgcggucgccaccaccgucaucaccccgaugcuccggcacacgaucgagaauuccaccgcgaacgucagcuuggccgcaaucgccaaccaggccgugguccugaugggauuagacaaggguuggcccaucuccaagauggaccugggcgucccccugcucgcccuggggugcuacagccaggugaauccccugacgcucaccgccgcgguccugcuguuagugacgcacuacgcaauuaucggcccgggccugcaggccaaggcuacccgcgaggcucagaagcggacagcggccgggaucaugaagaacccaacuguagacggcaucaugacgaucgaccuggaccccgucaucuaugacucgaaguuugagaagcagcucggccagguuaugcugcugguguugugugccguccagcugcugcucaugcgcaccucaugggcguuaugcgaggcucugacccucgccaccggccccaucaccacccugugggagggcuccccggggaaguuuuggaauaccacuaucgcagugucgauggccaacaucuuccggggauccuaccuugccggggcgggccucgccuucuccaucaugaaauccguggggacgggucgacggggcacugggagccagggcgagacccugggcgagaaguggaagaaaaagcuaaaccagcucagcaggaaagaguucgaccuguacaagaaguccggcaucaccgagguugaccggaccgaggccaaggaggggcugaaacgcggagagacgacccaccaugccgugucccggggguccgccaaacugcaaugguucguggagcgcaacauggucaucccagaagggcgagugaucgaccuaggcugugggcgcggcggguggagcuacuacugcgccggccucaagaaggugaccgagguccgcgguuacacaaaaggcgggcccgggcacgaagagcccguaccgauguccacguacggcuggaacaucgugaaacuaaugagcgggaaggacgucuuuuaccugccccccgagaagugugacacccuacugugcgacaucggcgaguccucccccuccccgacugucgaggagagccgaaccauccgcguccucaagauggucgagccguggcuuaagaacaaccaauuuuguaucaaaguucugaaccccuauaugccuacagugaucgagcaccucgaacggcugcagcgcaaguauggagggaugcugguccggaacccguuaucccggaacagcacgcacgagauguauuggauaucuaacggcacggggaacaucguuagcuccgugaacauggucagccggcugcugcucaacagguuuaccaugacgcaucgccgccccaccauugaaaaggacguggaccugggagcgggcacacggcacgucaacgccgagccggaaacgccgaacauggacgugaucggggaaagaaucaaaaggaucaaggaagagcacucuagcacguggcauuacgacgacgagaacccuuacaagaccugggccuaccacggcuccuacgagguuaaggccaccgggagcgcgagcucuaugaucaacggcguaguuaagcugcucacgaagccgugggacguagucccaaugguuacgcagauggccaugaccgacaccacccccuucggccagcagcgcguguuuaaggagaaggucgacacgagaacgcccagacccaugcccggcacccgaaaggugauggaaaucaccgccgaguggcucuggcgcacgcugggccggaacaagaagccgcgacucugcacucgcgaggaguucacuaagaagguacggaccaacgccgccaugggggcgguuuucacagaagagaaccagugggacagcgcccgcgcugccguggaagacgaggaguucuggaagcugguggaccgggagcgggagcugcacaagcucggcaagugcgggaguugcguuuauaacaugaugggcaagagagagaagaagcugggggaguucggcaaggcgaaaggcagccgcgccaucugguacauguggcucggggcccgguacuuagaguuugaggcgcugggcuuccugaacgaggaccacugguuuucccgcgaaaacucauacucggggguggagggcgaggggcuccacaagcugggcuacauucugcgugauaucagcaagauccccggcggggcuauguacgcggacgacaccgccggaugggacacucgcaucaccgaagacgaccuccacaaugaagagaagaucacucagcagauggauccugaacaucgccagcuggccaaugcuaucuucaaacucaccuaccaaaacaagguuguuaaaguucagcgacccaccccgaaggggaccgugauggacaucauuucccguaaagaccaacguggaagcggacaggucgguaccuacggcuugaacacguucaccaacauggaggcccagcuggugcggcagauggagggggagggcgugcuguccaaggcggaccucgaaaauccgcaccuccuagagaagaagaucacccaguggcuagaaaccaagggggucgagcgccugaaacggauggccaucagcggcgaugauugcgugguaaaacccaucgaugaucgcuuugccaaugcuuuacucgcgcugaacgacaugggcaagguucggaaggacaucccccaauggcagccguccaagggguggcacgacuggcagcaggucccauucugcagucaucacuuccaugagcucaucaugaaagacgggcgcaagcucgugguccccugccggccccaggaugagcugaucgggcgagcgcgcauuucccagggcgccggguggagccucaaggagacggcuugccucggcaaggccuacgcgcagauguggucccugauguacuuccaccggcgcgaccugcggcucgcgagcaacgccaucugcuccgccgugccggugcacuggauacccaccagccgaaccaccuggagcauccacgcccaucaccaguggaugacgaccgaggacaugcucacgguguggaaucggguuuggaucgaagacaacccauggauggaggacaagacaccugucacgaccugggaggauauuccguaucuaggcaagagggaggaccaaugguguggguccuugaucggcuugaccucucgggcgaccugggcccaaaacauacugacagccauccagcagguucgcucccucaucggggaugaagaguuccuggacuacaugcccuccaugaagcgguuccgcaaggaggaggaaucggagggcgcaaucugguag

SEQ ID NO: 26130 - RNA, 9873 nt, Artificial Sequence
  derived and/or modified CDS sequence (opt11) from DENV-3__FJ461334__SS-prME
accucgcugugucucaugaugaugcugccggcgacccuggcuuuucacuuaaccagccgggacggcgaaccgcggaugaucguggggaagaacgaacgcgggaagucucugcuauucaagacggcgagugguaucaacaugugcacccucaucgccauggaccugggcgaaaugugcgacgacacugugaccuacaagugcccccugaucgcagaaguugagccagaggacaucgacuguuggugcaaccucaccagcaccugggugaccuacgggaccugcaaccaggccggcgagcaccggcgagacaagcgguccguggcccuugcaccgcaugugggcauggggcuggacacccgcacacagacuuggaugagcgcggagggcgcuuggcgccagguggagaaggucgagacuugggcacuacgccacccgggguucaccauccuggcgcuguucuuggcccauuacaucggcacgucccuaacccagaaggugguuaucuucauccugcucauguuagucacgcccucaaugacaaugcggugcgugggggugggcaaccgcgacuucgucgaggggcuguccggagcaaccuggguggacguaguuuuggagcauggcgggugcgugacuacgauggccaagaauaagcccacgcuggacaucgaguuacagaagacagaggcaacccagcuugcgacgcuacggaagcugugcaucgaagggaagaucaccaacaucaccaccgacucccggugcccuacgcaaggagaggccauccucccugaggagcaagaccagaacuacgugugcaagcacaccuacgucgaccgcggguggggcaacgggugcggccuguucgggaagggaucccucgugaccugcgccaaguuccagugccucgagcccaucgagggcaaggugguccaguacgagaauuuaaaguacaccgugaucaucacgguccacaccggggaccagcaccaagucggcaacgacacccaaggggugaccguugagauuacgccccaggccagcaccguggaggcugugcugcccgaguacggcacccuugggcuggagugcuccccucgcacaggccuggacuuuaacgagaugauccuccugaccaugaagaacaaggccuggaugguccaccggcagugguucuucgaccuaccccucccuuggacgagcggcgccaccaccgagacccccacguggaaucgcaaggagcugcuggugaccuucaagaacgcacacgccaagaagcaggaaguggucgugcucgggucccaggagggcgccaugcacaccgcgcugacuggggcaacagaaauccaaaauucaggcgggaccuccaucuucgccggccaccucaagugccggcucaagauggauaagcuagagcugaagggcaugagcuacgccaugugccucaacaccuucgugcugaagaaggaggucuccgagacacagcaugggacgauccugauaaagguagaauacaagggcgaggacgcuccuugcaagauccccuucagcaccgaggaugggcagggcaaggcgcacaacggccgacugaucacggccaaccccguggucaccaagaaggaagaacccgugaacaucgaggccgagccgcccuuuggggagagcaacaucgugaucggcaucggggacaaggcuuuaaagaucaacugguacaaaaagggcuccagcaucgggaaaauguuugaggcgacggcccggggcgcgcgccggauggccauccugggcgacacagccugggacuucggguccgucgguggggugcucaacagcuugggcaagaugguccaccagaucuucgguuccgcguacaccgcccuguucagcggcgucuccuggaucaugaagaucggcaucggggugcugcucaccuggauaggccugaacagcaagaacacguccaugagcuucuccugcaucgugauugggauuaucacccuguaccugggcgccgucgugcaggccgacauggggugcgccaucaacuggaaggguaaggaacugaagugcggcagcggcaucuucgugaccaaugagguccacaccuggacggagcaguacaaguuucaggcggacucgcccaagcgccuggccaccgccauagccggagcgugggagaacgggguuugcggcauacgcagcaccacacggauggagaaucuccuguggaagcagauugcgaacgagcugaauuacauccucugggaaaacaacaucaaacugacgguggucgugggcgacaucaucggcguccuggagcagggcaagcgcacccucacgccgcagccgauggagcuaaaguauucauggaagaccuggggcaaagcaaaaaucgucacggccgaaacccagaacagcuccuucaucaucgacggccccaacacccccgagugccccagcgcuucccgggcguggaacgugugggagguggaggacuacggguucggcguuuucacaacgaacaucuggcugaagcuccgcgagguguauacccagagcugugaccaccggcugaugagcgccgcaaucaaggacgagagggccgugcaugccgauaugggcuacuggaucgagucccagaagaacgggagcuggaaacuggagaaagcgucauucaucgaggucaagaccugcaccuggcccaagagccacacccucugguccaacggugugcuggagagcgacaugaucauccccaagucccuggccgggccuaucagccagcacaaccaccggccgggcuaucacacgcagaccgccgggcccuggcaccucggcaaauuagagcuggacuuuaacuauugcgagggaaccaccguggucaucacggagaacugcgggacccgcggccccagccuccggaccacgacggugucagggaagcugauccacgaauggugcugccgcuccugcacccugcccccgcuucgguacaugggggaggauggguguugguacggcauggagauccgccccauaaacgagaaggaggagaacauggucaaaagccuggucagugccggcagcgggaagguggacaacuucacuaugggcguucugugccucgcgauccuguucgaggaggucaugcgggggaaguucggcaagaagcacaugauagcggggguacuguucaccuucgugcugcuucugagcggccagaucacguggcgcgacauggcccauacccucaucaugauuggcagcaacgcauccgaccggauggggaugggcgucaccuaccuggcgcucaucgccacguucaagauccagcccuuucucgcgcuggguuucuuccugcgcaagcucacgucgcgggagaaccuacuguugggcgugggccuggccauggccaccacccuccaacuccccgaggacauagaacagauggccaacgggauugcucugggcuugaugacgcugaaacuuaucacgcaguucgagaccuaucagcucuggaccgcccucgugucacugaccugcuccaacacgaucuuuacacugacugucgccuggcgcaccgccacgcuaauccucgcuggcgugagccugcuccccuugugccaauccuccuccaugcgaaagaccgacuggcugcccaugaccgucgcggccaugggcgucccaccgcugccgcuguucaucuucucucugaaggacacccccaagcgccgcuccuggccccucaaugagggggugauggccgugggccugguaagcauccuggccucaucccuccugcggaacgacgugcccauggccggcccgcuggucgccggcggucuccucaucgccugcuacgugaucacugggacguccgcagaccugaccguggagaaagccgccgacgucaccugggaagaagaggcggaacagacgggggugagccacaaccucaugauaacaguugacgacgaugggaccaugcgcaucaaggacgaugagaccgagaacauccugacgguccugcugaagacggcccugcugaucgugucuggcauuuuccccuacagcauucccgccacccuccugguguggcacacuuggcagaagcaaacccagagguccggcguccuaugggacgugcccagcccacccgagacgcagaaggccgaacucgaggaggguguguaccgcaucaagcagcaaggcauauucgggaagacccagguuggcgugggcgugcagaaggaaggcgucuuucacaccauguggcacguaacccggggcgccgugcugacacacaacgggaagcgccuggagccgaacugggcaucugucaagaaggaccucaucagcuacggcggaggguggcggcuguccacccaauggcagaaaggcgaagaaguccaaguuaucgcugucgagcccggcaagaauccgaagaacuuccagaccaugcccggcaucuuccagacuacgaccggggaaaucggcgcgaucgcucuggacuuuaagcccgggaccagcggcuccccuaucaucaaccgugagggaaaaguaguggggcuguaugggaacggcgucgugacgaagaacggcggguacguguccggaaucgcucagacgaaugccgagcccgacggcccgacccccgaguuggaggaggaaauguucaagaaacggaaccugaccaucauggaccuccacccgggaucaggcaaaacucgcaaguacuugcccgccaucguccgggaggccaucaagcgucggcuccgcacgcugauccucgcccccacccgggugguggcggcagaaauggaagaggcccugaaggggcugcccauccgcuaccaaaccacagccacgaaguccgagcacaccggccgagagaucguggaccuuaugugccaugccaccuucacgaugcgauuacugaguccagugcgggugcccaauuacaaucucaucaucauggacgaggcacacuucacggaccccgccucaaucgccgcgcgcggguacauuaguacccgggugggaaugggcgaggccgcggccauauucaugaccgccacgccgccaggcacggcugaggcauuuccccaauccaacgcccccauacaggacgaggagcgcgacaucccagagcgcagcuggaacaguggcaacgaguggaucaccgacuuuguggggaagaccgugugguucgucccaagcaucaaggccggcaacgacaucgccaacugccugcggaagaacgggaagaaagucauccaauugagucgcaagaccuucgacacggaguaccagaagacccggcuuaaugacugggacuucguggucaccaccgacaucagcgagaugggcgccaacuucaaggcggaccgcgugaucgauccccggcgcugccugaagcccgugauucuuacggacggcccggagcgggucauccucgccgggccgaugcccgugaccgccgccuccgccgcgcagcgccggggccgcguggggcgcaacccccagaaggaaaacgaccaguacaucuucaccggccaaccccugaacaacgacgaggaccaugcccauuggaccgaggccaagaugcugcucgacaacaucaacaccccggagggaaucauccccgcauuauuugagcccgagcgcgagaaguccgcugccauagauggagaguaccgguuaaagggcgagucccgcaagacguucgucgagcuuaugcggagaggggaccugcccgugugguuagcccacaagguagccagcgagggcaucaaguacacggaccguaaguggugcuucgacggggagcgcaacaaucaaauucucgaggagaacauggacguggagaucuggaccaaggagggcgagcggaaaaagcugcgcccgcgcuggcuggacgcccggaccuauucugauccccucgcgcugaaggaguucaaggacuucgcagccggccgcaagagcauugcacuggaccucgugacggaaaucggccgggucccaucccaccuggccuacaggacccggaacgcguuggacaaccucguaaugcugcauaccucggagcacggcgggagggcauaccggcacgccguagaggagcuaccggagaccauggagacgcuccugcugcucggcuuaaugauccugcucacaggaggggccaugcuguuccugaucucuggcaaggggauuggcaagaccuccauagggcucauaugcgucaucguaagcucaggcaugcuguggauggccgacguuccccugcaauggaucgccagugccauuauucucgaguucuucaugaugguccuacugauccccgagcccgagaagcagcgcaccccucaggacaaccaacucgccuauguggugauagggauccugacgcuggccgcuauuguugcggccaacgaaaugggccuccuggagacuacgaagcgagaccugggcauguccaaggagcccggggugguuagccccaccaguuauuuagacgucgaucugcaucccgccagcgccuggacgcuguacgccguagcgaccaccgugaucaccccgaugcugcgccacacgaucgagaacuccaccgccaacgucagccuggccgccaucgcgaaccaggccguggugcugaugggccucgacaagggguggccgaucuccaagauggaucuuggcguuccccugcuagccuuagguugcuacagccaggugaauccccuaacccucacggccgccguucuacugcucgucacgcauuacgcgaucaucggccccggccugcaggccaaggccacuagggaggcgcagaagcgcaccgccgcgggcaucaugaagaaccccaccguggacgggaucaugacgauagaccucgaccccguuaucuacgacuccaaguucgagaagcagcucgggcaggucaugcugcuggugcucugcgccguacagcuguuacucaugcggaccucaugggcccuuugcgaggccuugacuuuagccaccggccccaucacgacccugugggagggcuccccggggaaguucuggaacaccaccaucgcggucagcauggccaacauuuuucgcggguccuaccuggccggggccggccucgcguucagcaucaugaaguccguggggacagggcggcgcggcaccgggagccagggagagacacugggggagaaauggaagaagaaacugaaccagcucagccggaaggaguuugaccuguacaagaagucaggcauaaccgagguggaucgcacugaagccaaggaggggcugaagcggggcgagacgacgcaccacgccguaucgcgcggcuccgccaagcuccagugguucguggagcggaacaugguuaucccugaggggcgcgucaucgaccugggcugcggacgcggcggguggucauacuacugcgccggccugaagaaggugaccgagguccgcggguacaccaagggcgggcccgggcacgaggagccggucccgaugucuacguacggcuggaaucucgugaagcugaugagcgggaaggacguguuuuaccugccgcccgagaagugcgacacccugcuuugcgacaucggcgaauccagcccuuccccuaccguggaggaaucgcgcaccauccgggugcugaagaugguggagccgugguuaaagaacaaccaauucugcaucaagguccucaaccccuacaugcccacaguaaucgagcaccuggagcgccugcagcggaaauacggcgggaugcucgugcgcaauccgcugucccggaacagcacacacgagauguacuggaucucaaacggcaccgggaacaucgucagcucggugaacauggucagccgccugcuccuuaaucgguucaccaugacucacagacggcccaccaucgagaaggacgucgaccugggcgcaggcacacgccacgugaacgccgagcccgagaccccgaacauggacgucaucggagagcggaucaaacgcaucaaggaggagcacuccagcacguggcacuacgacgacgaaaaccccuacaaaacaugggcguaccacggcuccuacgaggugaaggccaccgggucagcuucauccaugaucaacggcguggucaaacuccucaccaagcccugggacguggucccuauggucacgcagauggcgaugaccgacaccacccccuucggucagcagcgggucuucaaggagaaaguggacacgcgcacgccgcggccgaugccggggacccgcaaggucauggagauaaccgccgaguggcuguggcggacguugggccgcaacaagaagccgcgccugugcacuagagaggaguucacuaagaaagugcgcaccaacgcagcuaugggggcaguuuuuacugaggagaaucagugggacagcgcgcgugccgccguggaggacgaggaguucuggaagcugguugaucgagagcgggagcuccacaagcugggaaagugcggguccugcguguacaacaugaugggcaagcgggagaagaagcuaggagaguucgggaaggcaaaggggagccgggcgauaugguacauguggcucggggcccgcuaccuggaguucgaggcucugggcuuccucaacgaggaccacugguucuccagggagaacagcuacuccggggucgaaggagaagggcuacacaagcuggguuacauccugcgcgacaucagcaagauccccgguggggccauguacgccgacgacacggcgggcugggacacgcggauuacggaggacgaucuacacaaugaggagaaaaucacgcagcagauggaccccgagcaccggcagcuggccaacgccauuuucaaauuaaccuaccagaacaagguggugaagguucaacgccccaccccgaaggggaccgugauggacaucaucucacgcaaggaccagcgggggucgggccaaguagggacauaugggcugaacacguucaccaacauggaggcacagcugguccgccaaauggagggcgagggcgugcucaguaaggcagaccuagaaaacccacaccuacucgagaagaagaucacccaguggcuggagacaaaagguguggagcggcucaagaggauggcgaucagcggcgacgacugugucgugaagcccaucgacgaccgguucgcaaacgcucuccucgcucugaaugacaugggcaaagugcgcaaggacaucccccaguggcagcccuccaagggguggcacgacuggcagcagguacccuucugcagccaccacuuccaugagcucaucaugaaagacggccggaagcuggugguccccugucgcccccaggacgagcuuaucgggcgcgcaaggauuagucagggcgcgggguggucccucaaggagacugccugccugggcaaggccuacgcacagauguggucccugauguauuuccaccgcagggaccuccgcuuagcaagcaacgcgauuugcuccgccgucccgguccauuggaucccuacuagccggaccaccuggagcauccaugcgcaccaccaguggaugacuaccgaggacaugcugaccgucuggaaccgagucuggaucgaggacaauccauggauggaggacaagacccccgugacgacaugggaggacgugcccuaccucgggaagcgggaagaccaguggugcgggucccugauuggccugaccagccgcgccaccugggcgcagaacauucucacggccauccagcagguacgcucccuuaucggugacgaggaguuccuggacuacaugcccucgaugaagcgcuuucgaaaggaggaggaguccgagggugccaucugguga

SEQ ID NO: 26131 - RNA, 9873 nt, Artificial Sequence
  derived and/or modified CDS sequence (opt11) from DENV-3__FJ461337__SS-prME
acgucgcugugccuaaugaugaugcugcccgcuacccuggccuuccaucuaaccagccgggacggcgagccacggaugaucgucgggaagaacgaacgcggcaagagccugcuguucaagaccgcgagcgggauaaacaugugcacccuuauagccauggaucugggugagaugugugaugacaccgugacauacaaaugccccuuaauugcugagguggaaccggaagacaucgacugcuggugcaacuuaaccucaaccugggugacguacgggaccugcaaucaagccggagaacaccggcgcgacaaacgguccgucgcccucgcaccccaugugggcaugggacuagacacccgcacccagaccuggaugagugccgaaggcgcuuggcggcagguugaaaaaguggagacgugggcccuccgccaccccggguucaccauccuggcucuguuccucgcccacuauaucggcacaucgcugacgcagaaggugguuaucuucauacuccucaugcugguuacgccgagcaugaccaugcggugugugggggucggcaaccgcgacuucgucgagggccugaguggggccaccuggguggacguggugcucgagcacggcgggugcgugaccacgauggccaagaacaaaccgaccuuagauaucgaguuacagaagacagaagccacgcaacuugccacgcugcggaaacugugcaucgagggaaagaucaccaauaucaccaccgacagccgcugucccacgcagggcgaggcgauccucccggaggaacaggaucagaacuacguguguaaacauaccuacguggaccggggguggggcaacggaugcggacucuucgggaagggcagucuggugaccugcgcgaaguuccagugcuuggaacccaucgagggcaaggugguccaguacgaaaacuuaaaguauaccgugauaaucacggugcacaccggggaccagcaccaggucggaaacgacacccaggggguuacaguggaaauaacgccccaagcgagcaccguggaggcugugcuucccgaguacggcacccucgggcuugagugcuccccgcgaacgggccuggacuucaacgagaugaucuuacugacuaugaagaacaaggcguggaugguccaucgccagugguucuucgaccugccccuccccuggaccagcggcgccaccaccgagacccccacguggaaccgcaaggaacugcugguuaccuucaagaacgcacacgccaagaaacaggagguggucgugcucgggucucaagaaggugccaugcauacagcgcugaccggagccacggagauccagaacagcggaggaaccuccaucuucgcaggccaccugaagugccggcugaagauggacaagcuggagcugaagggaaugagcuacgccaugugucucaacaccuucguccucaagaaggaggucuccgaaacccagcacgggacgauccugaucaagguggaauacaagggggaggacgccccgugcaagauccccuucagcaccgaggacgggcaagguaaggcgcacaacggccgccugaucaccgccaaccccguggucaccaagaaggaggagccgguaaauauagaggccgagccucccuucggggagagcaauaucgucaucggaauaggggacaaggcccucaagaucaacugguacaagaaaggguccagcaucgggaagauguucgaggcgaccgcccggggagccaggcggauggcgauucugggcgacaccgccugggauuucgggucaaugggugggguccuuaacucgcucggcaagauggugcaucagaucuucgggagugcguacaccgcacuauucagcggcguuuccuggauaaugaagaucgggaucgggguccuccucaccuggaucgggcugaacucaaagaacacgucaaugucauuuuccugcauugugaucggaaucaucacccuguacuuaggggccgugguucaggcggacaugggcugcgcgaucaauuggaagggcaaagagcuuaagugcggcagcgggauuuuugugaccaacgaggugcacaccuggacugagcaguacaaguuucaggcggacucccccaagcgccuggcuacagcuauagcgggcgccugggaaaacggggucugcggcauccgcaguaccacucgcauggaaaaccuccuguggaagcaaaucgcaaacgagcugaacuacauccucugggagaacaauaucaaacuuacgguggugguaggggauauaauaggcgugcuggagcaagguaagcgcacuuugacuccucagccgauggagcugaaguacucguggaaaaccugggggaaggcuaagauugugacggcagaaacucagaacagcuccuucauaaucgacggccccaacaccccagaguguccgagugccucacgggccuggaacguaugggagguggaagacuacggguucgggguauucaccacgaacaucuggcugaagcuccgagaggucuacacccaguccugcgaucaccgguuaaugagcgccgccaucaaagacgagcgggccguacaugcagauaugggcuacuggaucgagucccaaaagaacgguagcuggaagcuagagaaggcguccuucaucgaggugaagacaugcacauggcccaagagccacaccuugugguccaacgguguacuugaguccgacaugaucaucccaaagucccuggccggccccaucagccagcacaaccaccguccuggcuaccacacgcaaacagccgggcccuggcacuuaggcaaacuugagcuggacuucaacuacugcgaaggcaccaccguaguuaucacugaggauugcggaacgcgcggccccucccuucgaaccaccacggucagcgggaagcugauccacgaguggugcugucgcuccugcacccugccuccccuccgguacaugggggaggacgggugcugguacggcauggagauccggcccaucaacgagaaggaagagaauaugguuaaaucccucgugagcgccggcagugggaaggucgauaacuuuaccaugggcgugcugugccucgccauccuguucgaggaggugaugcgggggaaguucggcaagaagcacaugaucgcgggaguccucuucaccuucguguuauuauuauccggccagaucacauggcgcgacauggcccauacccucauaaugauuggcucuaacgcauccgaccggauggguaugggcgugaccuaccuggcacugauagcaaccuucaagauccagcccuuccuagcacuugguuucuuucuucggaaacuuacgagccgggagaaccuccuguuaggcgucggcuuggcaauggccaccacgcugcaacucccugaggauaucgagcagauggcaaaugggaucgccuugggccucaugacacucaaguugaucacucaguucgagaccuaucaguuauggacagcucucguaucacuaaccugcuccaauacgaucuucacccuuacuguagccuggcguaccgccacacucauucuugcgggggugagccugcucccgcugugccaguccagcuccaugcggaagaccgauuggcucccuaugaccguggcggcuaugggcgugccgccucugccgcuguucaucuucagccuaaaggacacucccaagcgcagguccuggcccuuaaacgagggggugauggccgugggacuggucaguaucuuggccuccagccucuugcggaacgacgugcccauggcaggcccgcugguggccggcggccuccugaucgcaugcuaugucaucacagggacauccgcggaucuuaccguggaaaaggccgcagacguuaccugggaggaggaggcggagcagacuggagucucucacaaucucaugaucaccguggacgacgacgggaccaugcgcaucaaggacgacgagaccgagaacauccugaccgugcugcucaagacagcccuguuaaucgucuccggcauauucccauacagcauacccgccacccuccugguguggcacaccuggcaaaaacagacucagcgauccgguguccugugggacguccccagcccuccagaaacgcagaaggcagaguuagaggaaggaguguaccgcaucaagcagcaaggcauuuucgguaaaacccaggugggcgucgggguacagaaggaaggcguguuccacacgauguggcacgugacccggggcgcagugcugacgcacaacgggaagcggcuggagccuaauugggcgucggugaaaaaggaccucaucucauacgguggcggguggcggcuguccgcucaguggcagaagggggaggagguccaagugaucgccguggagcccgguaagaacccuaagaacuuccagaccaugccaggcauuuuccagaccaccgcaggggagaucggcgcgaucgcgcuggacuucaagccugggacuucaggaaguccgauaauuaaccgcgagggcaaggucgugggguuguacggcaacggcgugguaacuaagaacggcggcuacgucuccgggaucgcccagaccaaugccgagccggacgggcccacgcccgagcucgaagaggagauguucaagaaacggaaccugacgaucauggaccugcacccagggucagggaagacccggaaauaccuccccgcuaucgugcgggaagcuauuaagcgccggcugcgcacccucauccucgcgcccacucggguaguggcggccgagauggaggaagcacucaaggggcugccgauccgcuaucagacgaccgccacaaagucugagcacaccggucgggagaucguagaccucaugugccacgcuaccuucaccaugcgccugcugucuccgguccgaguuccaaauuacaaucucaucauaauggacgaggcgcacuucacggaccccgccucaaucgcggcgcgcgguuacauaaguacccggguagguaugggcgaggcugccgcuaucuucaugacagcgacgccacccgggaccgccgaggcuuucccccaguccaaugcucccauccaggacgaggagcgcgacauccccgagcgcucguggaacucagggaacgaauggaucacagacuucgucgggaaaacgguaugguucguacccagcaucaaggccggcaacgacauugcgaauugcuuacguaaaaacgggaagaaggugauccaacugucccgcaagacguucgauaccgaguaccagaagacccgguugaacgacugggauuucguggucacgaccgacauaagcgagaugggcgccaacuucaaggccgaccgugucaucgacccccgccgcugucuuaagccgguaauccugacugacggcccagagcgggugauccucgccgggccgaugccugucaccgccgcuuccgcugcccagcgccggggccgcgucgggcggaacccccagaaggaaaaugaccaauacaucuucacgggccagcccuugaacaaugaugaggaccacgcccacuggacugaggccaagaugcuccucgacaauaucaacaccccagaggggaucauacccgcguuguucgagcccgaacgcgaaaaguccgccgccaucgacggcgaguaucggcugaagggcgagucccgcaagaccuucguggagcucaugcgacgcggggaccugccggucuggcuggcccauaaaguggcaucagagggcaucaaauauacugaccggaaguggugcuucgacggggagcgcaacaaccagauacuagaggaaaacauggacgucgagaucuggacgaaagagggcgagcggaagaagcugcggccgcgauggcuggacgcccgaacguacagugauccccucgcccugaaggaguucaaggacuucgcggcuggccgcaagagcauugcgcuggaccucgugaccgagauaggccgggugcccucccaucuugccuaucgcacccggaaugcacuggacaaccuagucaugcugcacacgagcgagcauggagggcgggcguaucggcacgccguugaggagcugccagagaccauggagacccuacugcuacucggucugaugauccugcugaccgggggcgcgaugcuauuucugaucagcggcaaggggaucgguaagacuucgaucgggcugaucugcgugauagucagcuccggcaugcuguggauggcagacgugccucugcaguggauagccagcgccaucgugcucgaguucuucaugaugguccugcugauacccgagcccgagaagcaaaggacaccgcaggacaaccagcucgccuacguugugaucggcauccugacccuggcugccaucguagcagcaaacgaaaugggccuccuggagacaacgaaacgggaucugggcaugagcaaggagcccggcguggugagccccaccuccuaucucgacguagacuugcaucccgccuccgcuuggacccuguacgccguggccacaacggugaucaccccgaugcucaggcacaccaucgagaacuccaccgccaacgucucucuggcggccaucgcuaaccaggcugugguguuaaugggccucgacaagggguggccuauauccaagauggaccugggcgucccacugcuggcccugggguguuacagccaggugaacccucugacgcucacagccgccguucugcuccuagucacccacuacgccaucaucggacccggccugcaagcaaaggccacccgagaagcgcaaaaacgcacggccgcagguaucaugaaaaacccgaccguagauggcaucaugacgauugaucuggaucccguaaucuacgauucaaaguucgagaagcaguuaggucaggucaugcugcuggugcuuugcgccgugcaacugcugcucaugcgaaccagcugggcccugugcgaggcgcugacccucgcgacuggcccuaucacuacccugugggaaggcuccccgggaaaguucuggaauacgacuauagcagucagcauggcaaacaucuuucgcggaucuuaccucgcgggagccggccucgccuucaguaucaugaaaagcguggggaccggucggcgggggaccggcagccagggcgagacucugggggagaaauggaagaagaagcugaaccaacuaagccggaaggaguucgauuuguacaagaagucgggcaucacugagguggaucgcacagaagccaaggaggggcugaaacggggcgagaccacccaccacgccgucagucguggcuccgcgaagcuccagugguucguggagcguaacauggugauccccgaaggucgcgucaucgaccuuggaugcggacgaggcggguggagcuauuauugcgcuggccugaagaaagugacagaggugcguggcuauacgaagggcggccccgggcacgaggaaccggucccgaugagcaccuacggcuggaaccucgugaaacuaaugucgggcaaggauguguucuaccugccgcccgagaagugcgacacccugcucugugacaucggugaguccucucccuccccgacagucgaggaaagccgcacgauccgggugcugaagaugguugagccuuggcugaaaaauaaccaguucugcaucaagguccucaaccccuauaugccgaccguuaucgagcaccucgaacggcugcagcggaaguacggcgggaugcucgugcggaauccucuguccagaaauucaacucacgagauguacuggaucagcaacggcacggggaauaucgucaguuccgugaacauggugagccgguugcucuugaaccguuucacuaugacacaccgccggcccacuaucgaaaaggacguggaccugggcgcgggcacgagacacgugaacgccgagccugagacgcccaacauggacgucaucggggagcguaucaagagaaucaaggaggagcauagcucuaccuggcacuaugaugacgagaaccccuacaaaacuugggcauaucacgguuccuacgaggugaaagccaccgggucugccagcuccaugaucaacgggguggucaagcuccuaaccaaacccugggacguagugcccaugguuacccagauggccaugaccgacacgacucccuucggccaacaacggguauuuaaggagaagguggauacccgcacgccccgccccaugcccggcacgagaaaagucauggaaaucaccgccgagugguuauggcggacccucggccguaacaagaagccgcgauuaugcaccagagaggaguuuacuaaaaaggugaggacuaacgccgcaaugggcgcuguuuucacugaggagaaucagugggacagcgcacgggcagcugucgaggacgaggaguucuggaaguuaguggacagagagcgcgagcugcauaaguuaggcaagugcggcuccugcgucuacaacaugaugggcaagagagagaagaaacucggagaguucggcaaggccaaaggcucccgggccaucugguacaugugguugggggcucgcuacuuggaguuugaggcgcucggcuuuuuaaaugaggaccacugguucuccagggagaacagcuauuccggggucgaaggcgaggggcuacacaaguugggcuauauacuccgcgacaucagcaaaaucccgggaggcgcgauguacgccgaugacaccgcgggaugggacacgcggaucacggaggaugauuugcacaacgaggagaaaauaacccagcagauggaccccgagcaccggcagcuggcaaacgcuaucuucaagcucaccuaccagaacaaagucgugaaaguccaaagacccacgccgaaggggaccgucauggacaucaucucccggaaggaccaacgggguucaggccagguggggaccuacggcuuaaauaccuuuaccaauauggaggcgcagcugguccgccagauggagggggagggcguguuaucgaaggccgaccuggaaaacccccaccuucucgagaagaaaauaacccaguggcuggagacgaaggggguugagcggcugaagcgcauggccaucaguggcgacgacugcgucgugaagccgauagacgauagguucgcaaacgcucuccuggcgcugaacgauaugggaaagguacgcaaggacaucccccaguggcagccguccaagggcuggcacgauuggcagcaaguucccuucugcagccaccacuuccacgagcugaucaugaaagacggaaggaagcugguugugcccugucgcccucaggacgaacugaucggucgggcccgaaucucccagggcgcagguuggagucucaaagaaaccgccugccugggcaaagccuacgcgcagauguggucccuuauguacuuccaucgccgugaccuucgccuggccucaaacgccauuugcucugcuguuccgguccacuggauucccaccagucggacgaccugguccauccacgcgcaccaccaguggaugacgaccgaggacaugcugacgguauggaauagggucuggaucgaggauaaccccuggauggaagacaagacccccguuaccaccugggaggacguaccguaccucggcaagagggaagaccaguggugcgggagccugaucgggcuuacaagccgcgccacuugggcccagaacaucuuaacagccauucagcagguacgaucccugaucggggaugaggaguuccuggauuacaugcccucuaugaaacgcuucaggaaggaggaagaaucggagggcgcgaucugguga

SEQ ID NO: 26132 - RNA, 9873 nt, Artificial Sequence
  derived and/or modified CDS sequence (opt11) from DENV-3__FJ461338__SS-prME
acgagucugugccuuaugaugaugcugcccgccacccuggcauuccaucuaaccagccgggacggugagccacguaugaucguaggaaagaacgagcggggcaagagccuccuguucaagaccgcguccgguauaaacaugugcacccucaucgccauggaucugggcgagaugugcgacgacaccgugacguacaagugcccucugguugcugagguagagccugaggacauagacugcuggugcaacuugaccagcacuugggugacauacgggacaugcaaccaggcaggcgagcacaggcgcgacaagagauccgucgcauuagcuccccaugugggcauggggcuggacacccguacccagacuuggaugucagcggagggagcuuggcgacagguagaaaagguagagacgugggcgcuccgccacccugguuucaccauccuggcccuguuccuugcccacuauaucggcaccucccugacucagaaggucgucaucuucauccuacucaugcuggugacgcccucuaugaccaugcggugcgugggggugggaaacagggacuucguggaaggccucuccggagcaaccuggguugacguaguguuagaacacggcgggugcgucacgacgauggcaaaaaacaaacccacccuggauaucgagcugcagaagacugaagccacccagcucgcaacgcugcggaagcugugcauagagggcaagaucaccaacaucaccaccgacagccggugucccacacagggcgaggcgauuuugccggaagaacaagaccaaaauuauguuugcaaacauaccuacguggaccguggguggggcaacgggugcggccuauuuggaaaggguucccugguaaccugugccaaguuccaguguuuggaacccaucgaggguaaagucgugcaauaugagaaccucaaguacaccgugauaaucacgguccauacuggagaccagcaccaaguggguaacgacacccagggggucaccguggagaucacgccccaggcgaguaccgucgaggccgugcugccagaauacggcacacucgggcuugaauguagucccaggacaggucuggacuuuaaugagaugauccucuuaacuaugaagaacaaagcguggauggugcaccgacagugguuuuucgaccuuccgcuccccuggacgagcggcgccaccaccgagacgccgacauggaauaaaaaggagcuccucguaacuuuuaagaacgcccacgccaaaaagcaggagguuguaguucucgggucgcaggagggagccaugcacaccgcgcugaccggcgccacugagauccagaauagcggcgggaccuccauauuugccggacaccugaagugccgccuaaagauggacaagcuagagcuuaagggcaugagcuacgccaugugucugaacaccuucguucugaagaaagaggugagcgagacccaacacgggacgaucuuaaucaaaguugaguacaagggcgaggacgccccguguaagaucccuuucucuaccgaggacggacaaggcaaagcccauaacggcaggcugaucaccgccaauccggucgucacaaagaaggaggagccugucaacaucgaagccgaaccaccguucggggagucaaacauagucauugguaucggugacaaggcccuaaaaaucaacugguacaaaaagggcuccagcaucgggaagauguuugaggcuacggcccggggcgcaaggcgcauggccauccugggagacacggccugggacuucgguuccguaggcggagugcugaacucguugggcaagaugguccaccagauuuucgguucagcauacaccgcccuuuucucuggcgugucauggauaaugaaaaucggcaucggagugcugcucacguggauagggcuuaacagcaagaauacguccaugucguuuucaugcaucgugaucgggauuaucacccuguaucuaggcgccguggugcaggccgacauggggugcgcuaucaacuggaagggcaaagaguugaagugcgguagcgggaucuuugucaccaaugaagugcacaccuggaccgagcaauacaaguuccaggccgauuccccgaaacggcuagcuacggccaucgccggggccugggaaaauggagucuguggcauucgcuccaccacucgcauggagaacuuguuguggaagcaaaucgcgaacgagcugaauuacauccucugggaaaacaacauaaagcucacgguaguugucggggacauuaucggcguacuggagcagggcaagaggacucucacgccucagccgauggagcugaaguacagcuggaagaccuggggaaaggccaagaucgugacugcggagacucagaauaguaguuucaucaucgauggcccuaacacucccgagugccccagcgcgagucgcgcguggaacgugugggaggucgaggacuacggguucggcguguucaccacgaacaucuggcuaaagcuccgggaggucuacacccagagcugcgaccaccgccugaugagcgcggcgaucaaggaugagcgcgcaguccaugccgacaugggcuacuggaucgaaucccaaaaaaacggcagcuggaaguuggagaaagcguccuucaucgagguaaagaccuguaccuggcccaagucacacacccugugguccaacggcgugcuggaaagcgacaugaucauccccaaaucccuggcggggcccaucucucagcauaaucaccgaccuggguaccacacgcagaccgccgggcccuggcaucucggcaaauuggagcuggauuuuaacuacugugaggguacgaccgucguuaucacggagaacugugggacucgggggcccagucuccgcaccaccacugugagcgggaagcugauccaugaguggugcugccggucaugcacacugcccccccucagguacaugggcgaggacgggugcugguacggcauggagaucagaccuaucaacgaaaaggaagaaaacauggucaagagcuugguguccgccgggagcgggaagguggacaacuucaccaugggcguccugugccucgccauccuguucgaggaagugaugagaggcaaguucggcaaaaagcacaugauugcgggggugcuuuucacauucguccucuuacugucuggccagaucacguggagggacauggcccacacucucaucaugauaggcucaaacgccuccgaccgcaugggcaugggcgugaccuaccuggcccugaucgcuaccuucaagauccagcccuuccucgccuuaggguucuuccugcgaaaguugacaagucgcgagaacuuacugcuggggguagggcucgccauggcaaccacucuacagcuuccggaggauaucgagcaaauggcgaacgggauugcucugggccuaaugacccucaaacugaucacccaguuugagaccuaccaacuguggaccgcgcucgucagcuugacuugcuccaacacgauauucacauugacgguggccuggaggacggcuacgcucauccuggccggagucagccugcucccgcugugucaauccagcucaaugcgaaagaccgacuggcuucccaugacgguggccgccaugggcgugccgccacugccguuguucaucuucucgcugaaagacaccccgaagcggcgcaguuggccccugaacgagggggucauggccgugggccuaguuagcaucuuagccuccucacuucugaggaaugacguacccauggccggcccucuaguggcgggggggcuccuaaucgccugcuacgucaucacagguacaagcgcggaccugaccgucgaaaaggccgccgacgucacgugggaagaggaggccgagcagacuggcgugucacacaaccuaaugaucacagucgacgacgaugggaccaugcgaaucaaagacgacgagaccgagaacauccugaccgugcugcucaagacugcccuguugaucgucucaggcaucuucccauacagcauccccgcgaccuugcuagucuggcacaccuggcagaagcagacucagcgaucuggcgugcugugggacguacccaguccgccggagacgcaaaaggccgaacuggaagagggagucuaccggaucaagcaacagggaaucuucgggaagacccagguggguguggggguccagaaggagggcguguuccauaccauguggcacguuacucgcggcgccguccugacgcacaaugguaagcgacuggaacccaacugggcguccgugaagaaggaccucauaucuuacggcggaggguggcgacuguccgcccaguggcagaagggcgaggaaguucaggucaucgcuguggagcccggcaagaauccaaagaacuuccaaacaaugcccggcaucuuccaaaccaccaccggagagaucggcgccaucgcgcuggacuuuaagcccggaaccagcggcaguccgaucauuaaccgggaggguaagguggucgggcuguauggcaacggcgugguuacuaagaacggcggguacgucucaggaaucgcucagaccaacgccgagcccgauggccccacgccggagcucgaggaggagauguucaagaagagaaaccuuacuauaauggaccuccacccggggagcggcaagacaaggaaauaucuccccgcuauugugcgcgaggccauaaaacggagacuucgcacccugauccuugcccccacacggguaguggccgccgagauggaggaggcccugaaggggcuuccuauucgguaccaaaccacagccacaaaauccgaacacacgggacgcgagaucgucgaccuuaugugccaugcgaccuuuaccaugcggcuguuaucacccguccgcguccccaacuauaaccucaucaucauggacgaggcccacuuuaccgaucccgcuuccaucgcagcccggggguauauuagcacgcgcguugggaugggcgaggcggcugcaauuuucaugaccgcgacgccuccggguacagcggaggcuuucccccaauccaacgcccccauacaggacgaagagagagacaucccagaacgcucuuggaacuccggcaacgaauggaucacggacuucgugggcaaaacggucugguuugugcccagcauuaaagccgggaacgacauagccaacugucuucgcaagaacgggaagaaggugauucagcugucccggaaaaccuucgacaccgaauaccagaagacgcgccugaaugauugggauuuuguagugaccaccgacaucuccgagaugggcgcgaauuucaaagccgaucgggugaucgauccgcgccgaugccugaagcccgucauccugaccgaugguccggaacgcgugauccucgccggaccgaugccuguuacggccgcuuccgcagcccagcggcgcggccgggucgggcgcaacccccagaaagagaacgaccaguacauauucaccggccagccccugaacaaugacgaggaucacgcccacuggacggaagcgaagaugcugcuugacaacaucaacaccccggaagggaucauccccgccuuguucgaacccgagcgggagaaguccgcggccauagacggggaguaucgcuugaagggcgaaucccgaaagaccuucguggagcucaugcgccgcggggaccucccggucuggcuggcccacaaaguggccagcgagggcaucaaauacaccgaccgcaaguggugcuucgacggagaacgaaauaaucaaauccucgaggagaacauggauguggagauuuggacaaaggaaggggagcgcaagaaguugcggccgcgcuggcuggacgcgcggacuuauagugauccccucgcgcugaaggaauucaaggacuucgccgcuggccgcaaauccauugcccucgaccucgucacugagaucgggcgggugcccucccaccuggcauaccgcacgagaaacgcgcucgacaacuuagugaugcugcacaccucugaacauggcgguagagccuaucgccaugccgucgaggagcuuccggaaaccauggagacccuccugcuguugggccugaugauccuguuaaccggcggggcaaugcuguuccugauuucugggaaggggaucgguaagaccuccauugggcucaucugcgucaucgugucuaguggcaugcuguggauggcggacgucccucugcaguggaucgcaagcgccaucguguuggaguucuucaugaugguucuguuaauccccgagcccgagaagcaacggacuccgcaggacaaccagcuugccuaugucguaauagggauucugacccuggccgcuaucguggccgcaaacgagaugggccuccuggagacgaccaagcgcgaccugggcauguccaaggagcccggugucgucagccccaccuccuaccucgacgucgaccugcaccccgcaucggccuggaccuuauacgcgguagcgaccaccguuaucacgccaauguugcggcacaccaucgaaaauucuacggcaaaugucagccuagcugcaaucgcgaaccaagccgucgugcucauggggcuugauaagggauggcccaucuccaagauggaccugggaguaccacuacuagcucucggguguuacagccaaguaaauccccuaacccuuaccgcagcggugcuacugcuaguuacccacuacgccauuaucggcccuggccugcaggcgaaggccacgcgagaggcucaaaagcggaccgcggcugggaucaugaaaaaucccaccgucgacggcauuaugacaaucgaccuagacccagugaucuacgauagcaaguucgaaaagcagcucggccaggugaugcugcugguccucugcgccguacaacuguugcugaugcgcacgagcugggcccugugugaggcccucacccuugcgacuggccccaucaccacccugugggaaggcucgccggggaaguuuuggaacaccacaaucgccgugucuauggccaacauauuccggggcucauaccuugcgggggcuggguuggccuucagcauuaugaaguccguagggacaggccgucggggcacgggaagccagggcgaaaccuugggugagaaguggaaaaagaagcuaaaccagcucuccagaaaggaauucgaccuguacaaaaaguccgguauuaccgagguagaccggaccgaggcuaaagaaggccugaaacgcggcgagacuacacaccacgccgugagccggggcuccgccaagcuccaaugguucgucgagcgcaacauggugaucccggaggggcgggugauagaccugggcugcgggcgcgguggguggagcuacuacugcgcuggacuaaagaaggucaccgaagugcgcggcuacaccaagggcgggccuggccacgaggagccagugccgaugaguaccuacggcuggaacaucgucaagcucaugucugguaaggacguguuuuaucuuccaccugagaagugcgacacacuacugugcgacauuggugaauccagccccuccccgaccguggaggaaagccggacaauccgcguccucaagaugguggaacccuggcugaagaauaaccaguucugcaucaaaguccugaacccuuauaugccaaccgucauagagcaccucgagcgacugcagcgcaaguacggcggaaugcuuguucggaacccucucucccgcaacagcacucacgagauguacuggaucuccaacggcacuggcaauaucguguccuccgucaacauggugucacgacugcugcuuaaccgcuucaccaugacccaccgacgccccacgaucgagaaggauguggaccugggcgcgggcacccggcacgugaacgccgagccugagaccccgaauauggaugugauaggggaacguaucaagagaauuaaggaagagcauucgaguacauggcacuacgacgacgagaaccccuacaagacgugggccuaccacggcuccuaugaagucaaggccacagggagcgcauccucaaugaucaacggcguggugaagcugcuaaccaagcccugggacguagugccgauggugacccagauggcuaugacugacaccacccccuuugggcaacagcgcguuuucaaagagaagguggacacccggacgcccaggcccaugcccgggacccgaaaggugauggagaucaccgccgaguggcuguggcgcacucugggccguaacaagaagccacgccucugcacaagagaggaguucacgaagaagguccggaccaacgccgccaugggcgcuguguucaccgaggagaaccagugggauucugcccgcgccgccgucgaggacgaggaguucuggaaauuaguugaccgggaacgcgagcuacacaagcucgguaaaugcggaagcugugucuauaauaugaugggcaagcgggagaagaagcugggggaguucggcaaggccaaaggcucccgcgcuaucugguauauguggcugggggcccguuaccucgaguucgaggcacuaggcuuccugaacgaggaccacugguucucccgugagaacagcuacucagggguagagggagaggggcuccacaagcuuggcuauauucugcgggacauaaguaaaauccccggcggggcaauguacgcagacgacacggccgggugggauacacgcaucacagaggacgaccugcacaaugaggaaaagaucacucagcagauggaccccgagcaccggcaacuugccaacgcaaucuucaaacuaacauaccagaacaaggucgugaagguucagcguccgaccccgaaggggaccgucauggacauuaucucccguaaagaccaacgaggcagcggucaaguggggacauacggccuaaacaccuucaccaacauggaggcccaguuagugcgccagauggagggggagggagugcugaguaaagcggaccucgagaacccacaccuauuagagaaaaagauaacgcaguggcuugagaccaaggguguggaacgccugaagcggauggccaucucuggcgacgacugcguggucaaacccaucgacgacagguucgccaaugcccuucucgcucuuaacgacaugggcaagguacggaaagacaucccccaguggcaaccguccaaggguuggcaugauuggcaacaaguaccguucugcucacaccacuuucacgaguuaaucaugaaggaugggcgcaaguuggucgugcccugccggccccaggacgaacuaauuggucgcgcuagaaucucccagggagccggguggagccugaaggagaccgcaugccucggcaaggccuacgcacagauguggucuuugauguacuuccaccggcgcgaucugcgcuuagcgagcaacgcgaucugcuccgccgucccaguccauuggaucccgacgucacgcacuacguggagcauccaugcccaucaccaguggaugaccacggaggacaugcugaccguguggaaccggguguggauagaggacaaccccuggauggaggacaagacccccgucacgaccugggaagacgucccuuaucucggcaaacgcgaggaucaguggugcggcucgcucaucgggcuuaccucgcgugcgaccugggcccagaacauccugaccgccauccaacagguccgcucccuaauaggggacgaggaguuucuggacuauaugcccagcaugaagcgguuccgaaaagaggaggagagcgagggagccaucugguga

SEQ ID NO: 26133 - RNA, 9873 nt, Artificial Sequence
  derived and/or modified CDS sequence (opt11) from DENV-3__FJ562103__SS-prME
accuccuuaugccucaugaugaugcugcccgcgacgcuggccuuucaccucacaagccgcgauggcgaaccgcgaaugaucgucgggaagaacgaaaggggcaagucccugcuguucaagacagcguccggcauuaacaugugcaccuugaucgccauggaccugggggaaaugugugacgacaccgucaccuaccggugccccuuaaucgccgagguggaacccgaagauaucgacuguugguguaaccucaccagcaccugggugaccuacggaacaugcaaccaggccggugaacaccgccgggauaagcgcaguguggcccuagcgccccacguuggcaugggacuggacacccggacccagacuuggaugagcgccgagggugccuggcgccagguggagaagguggagaccugggcacuucggcacccugguuuuaccauccuggcgcuauuccucgcccacuauaucggaacaucccugacccagaagguggugauuuucacgcugcucaugcuggucacccccagcaugaccaugcgcuguguuggaguaggcaaccgugacuuugucgaaggccuuuccggggccaccuggguggacgugguccuugagcacggcgggugcgugacgaccauggccaagaacaagcccacccuggacaucgagcugcaaaagacggaggcaacgcagcucgcgacucugcgcaagcugugcauagagggcaagaucaccaacauaaccacagacagccguugccccacgcaaggcgaggcgaucuugccagaggagcaagaccagaauuacgugugcaagcacaccuacgucgaccgcgguuggggcaacgggugcggcuuauuugggaagggcucgcuggugaccugcgcaaaguuucaaugccucgagcccauugagggaaaagugguccaguacgagaaucucaaguacaccguuaucaucaccgugcacaccggugaccagcaccaggucggcaacgacacacaagguguaacgguggagauaacaccccaggccagcaccguggaagcgguccugcccgaguacggcacccucgggcuggagugcuccccgaggaccggccuggauuucaaugagaugauacuccugacgaugaagaauaaggcguggaugguacaccgccagugguucuucgacuugccacuacccuggaccuccggcgcuaccaccgaaacgcccacguggaaccggaaggaacugcuggugaccuucaagaacgcucaugcgaagaaacaggagguggucgugcucggcucccaggagggcgccaugcacaccgcguugaccggggcaaccgagauucagaauagcggcgggaccagcaucuucgcuggccaucugaagugucgcuuaaagauggacaagcucgagcucaagggcaugagcuacgccaugugucugaauaccuucguucugaagaaagagguuagugagacgcagcacgggacaauacuaaucaagguagaguauaagggugaggacgccccgugcaagauucccuucagcaccgaggacggacagggcaaggcgcacaauggccggcugaucacggcaaauccuguggucacuaagaaggaggagcccgugaacaucgaggcagagccgcccuuuggggagagcaacaucgucauaggcauaggaaacaaggcccucaaaauuaacugguacaagaaggggucuagcauagggaagauguucgaggcgaccgcaagaggggcacggcgcauggccauccugggcgacacugcuugggacuucgguucugucggcggggugcugaauagccucggaaaaauggugcaccagaucuucggguccgcguacacagcguuauucagcggcguuuccuggauuaugaagaucggcaucgggguccugcucacauggaucggccugaacagcaaaaacaccuccaugucguuuaguuguaucgugaucgggauaaucacauuauaccuaggcgcgguugugcaggcagacauggggugugccaucaacuggaagggcaaggaguuaaagugcggaagcgggauauucgugaccaacgaggugcacacguggaccgaacaguauaaguuccaggcggauucgcccaagcgccuagccaccgcaauagccggcgcuugggagaacggcgucugcggcauccguagcaccacccgaauggagaaccuacuguggaagcagauugccaacgaauuaaacuacaucuugugggagaacaacaucaagcucaccguggucguuggggacaucauaggcguacuagagcaggggaagcggacucuuacgccccaaccgauggaacugaaguacuccuggaagaccugggguaaggccaagaucgucaccgccgagacccagaauagcuccuucauaaucgacggcccuaacaccccugagugccccagcgccagccgcgcguggaacgucugggagguggaggacuacgguuucggcgucuucacuacuaauauuuggcugaaguugcgggagguguacacccaaagcugcgaccaccgccugaugucagcugcgaucaaagaugagagagccgugcacgccgacaugggcuacuggauugagagucagaagaacgggucuuggaaacuagaaaaggcauccuucaucgaggucaagacuugcacauggcccaagagccacacccuaugguccaacggcgugcuggagagugauaugaucauccccaagucccuagccggcccuaucagccagcacaaccaccgcccggguuaccauacacagaccgcagggcccuggcaccuuggcaagcuggaacuugacuuuaacuacugugaggguacaacggucgucaucacugaaaauugcggcacccggggccccucccugcgcaccaccaccguguccgggaagcugauccacgaguggugcugccggaguugcacccugcccccgcugcgcuacaugggagaggacgggugcugguauggcauggagaucagaccaaucaacgagaaggaggagaacauggugaaaagccugguauccgccggcagcgguaagguagauaacuucaccaugggcgugcucugccucgccauccuguucgaggaggucaugcgcgggaaguucggcaagaagcauaugaucgcgggcgugcuuuuuacuuucguucuucugcuaucaggccagaucacguggcgugacauggcccacacacuaaucaugaucggcucgaaugccuccgaccgcaugggcaugggcgucaccuaccuggcccugaucgccacguuuaagauccagcccuuccucgcgcuuggguucuucuuacggaagcucaccagccgggagaaccugcugcucggcgucggccuggccauggccacgaccuugcaacuccccgaggacauagagcaaauggccaacgggaucgcacugggccugaugacgcucaagcugaucacccaguucgagaccuaccagcuguggacugccuuggugagccuaacguguuccaauacaaucuucacccugacggucgccuggcggacggccaccuugauccuggccggggugagccugcucccgcucugccaaaguucaucgaugcgcaaaacagacuggcuaccaaugacugucgcggcuaugggcgugcccccucugccguuauucaucuucagcuugaaggacacgccuaagcgccggucguggccccucaaugagggggugauggccgucggucuggugagcauacuggccuccucucuccugcggaacgacguacccauggccggcccgcuggucgccggaggccucuuaaucgccugcuacgugaucacagggaccagcgccgaccuuaccguggagaaggcagccgauguaacgugggaggaggaagccgagcagaccggcgugagccacaaccucaugaucacgguggacgacgacgggaccaugcgaaucaaggacgacgagacagagaacauucugacggucuuacucaagaccgcccugcugauagugucgggcauuuuucccuacagcauccccgccacucuucugguguggcacaccuggcagaagcaaacgcaacgcuccggcgugcugugggacguaccuaguccacccgagacccagaaggccgagcucgaggaggggguguacagaaucaagcagcaaggcaucuuugggaagacccaggucgggguggggguucaaaaagagggaguguuccacacgauguggcacguaacgcguggagccgugcugacccauaacgggaagcggcuggagccgaacugggccagcguuaagaaagaccucaucucauacggcggggguuggcgccuuucagcgcaguggcaaaagggggaggaggugcagguaaucgccguagagcccggcaagaacccuaagaacuuccagaccaugcccgguaucuuucagacaacaaccggggagauuggcgccaucgcacuggacuuuaaacccggaaccagcgggagcccaaucaucaaccgggagggcaagguggugggucuuuacgguaacggagucgugaccaagaacggcgguuacguguccggcaucgcccaaacuaacgcugagcccgacgggcccacccccgagcucgaggaggagauguucaagaagcguaaccugaccaucauggaccugcacccgggaaguggcaagacccggaaauacuuaccagccauaguacgggaggcaaucaagcggaggcugcggacguugauccucgcgcccaccagagucguggccgcugagauggaggaggcauugaaggggcuacccaucagguaccagaccaccgcaacgaaguccgagcacaccggccgggagaucguggaccucaugugccaugcgaccuucaccaugcggcugcuguccccggugcgcguccccaacuacaaucucaucaucauggacgaggcccacuucacggaccccgccucuaucgccgcccggggguauaucagcacccgcgucggcaugggcgaggcggccgccauuuucaugacagcaacgccgcccgggacggcugaggccuucccucaguccaacgcccccauccaggaugaggagaaagacauccccgagcguucuuggaacuccggcaacgaguggaucaccgacuucguagggaagacugucugguucgucccgagcaucaaggccggcaaugacauugccaacugucuucgaaagaacggcaaaaaggugauccagcuguccaggaagaccuucgacacugaguaccagaagacccggcucaacgacugggacuuuguggucaccaccgacaucagcgagaugggcgccaauuucaaggccgaccgcgucaucgacccccggcgcugccugaagcccgugaucuuaacggacggccccgagagagugauccucgccgggcccaugccuguuacugcugccuccgcugcccaacgccggggccgugugggccggaacccccagaaggagaacgaccaguacaucuucaccggccagccccugaacaacgacgaagaucacgcccacuggaccgaggccaagaugcuauuggacaauaucaacaccccggaagggauuaucccggcccuguucgagccugagcgcgaaaaguccgcagccaucgauggggaguaucggcugaagggggagucccgcaaaacguucgucgaacucaugcggcgcggggaccuaccgguguggcuagcgcacaagguggcaucagagggcauaaaguacaccgaucggaagugguguuucgacggcgaacgcaacaaccaaauccucgaggagaauauggauguggagauuuggaccaaggaaggcgaacggaagaaacugcgcccccgcuggcuggacgcgcggacauacuccgauccucucgcccugaaggaguucaaggacuucgcugccggcaggaaaagcauugccuuggaccucgugaccgagaucgggcgagugcccucacaccuggcguacaggaccagaaacgcucuggacaaucuugugaugcugcacaccagcgagcacggcgggcgcgcguaucggcacgccguggaggaacugccggagaccauggaaacucuccuguuacucgggcugaugauccuucucaccgggggagcgauguuauuccugauuucgggcaaagggaucggcaagaccuccaucggccucaucuguguuauagucuccaguggcaugcuguggauggcggacgugccccuccaguggaucgccucugcuauaguccuagaguucuuuaugauggugcugcugauccccgagccggagaagcagaggacaccucaggauaaccaguuggcuuacguggucaucgggauccugacucuggccgcaaucguggcugccaacgagaugggccucuuagagaccaccaagcgggaucucggcaugaguaaagagcccgggguggucagucccaccuccuaccucgauguagauuugcaccccgcuucggccuggacgcucuacgcgguggccaccacagucaucacuccuaugcuccgucacacgauugaaaauuccacagccaacgugagccuugcggcgaucgcuaaccaggcagugguucuuaugggacucgauaaaggguggcccauuucuaagauggaucucggugucccccuucucgcccuggggugcuacagccaggugaacccucugacccuuaccgccgccguguuauuacucguuacgcauuaugcgaucauuggcccuggucugcaggcgaaggccacccgggaagcccaaaagcgcaccgcagcagggaucaugaagaaccccacgguggacggcaucaugacgaucgaccuugaccccgucaucuacgauucgaaguucgaaaaacagcucggacaggugauguuauuggugcucugcgccgugcagcuguuacucaugcggaccagcugggcccugugcgaggcccuaacccuggcgacgggccccauuacgacccugugggagggcucgccgggcaaguucuggaauaccaccaucgcugugagcauggccaauaucuuccgcggcuccuaucuagccggggcgggccucgccuuuucuaucaugaagucgguggggacgggccggcggggaaccggcagucagggcgaaacccucggugagaaguggaagaagaagcugaaccagcucucucguaaggaguucgaccucuacaagaaguccggaaucacagagguggaccgcacugaagccaaggaaggucugaagcguggcgaaacuacacaccacgccgugagccgcggcuccgcgaagcuccaaugguucguggaacguaacaugguaauacccgaggggcgcguaaucgaccuuggcugcgggcgaggggguuggagcuauuacugcgcgggccugaaaaaggugaccgagguccguggcuacaccaagggaggacccggccacgaggagcccgugccgauguccacguacggauggaacauuguuaaacucaugucggguaaggacgucuucuaccugccgcccgaaaagugugacacccuacucugcgauaucggcgaguccucccccucuccuaccgucgaggagagucgcacgauccgggugcucaagauggucgaacccuggcuuaagaacaaucaguucugcauaaagguuuuaaaccccuacaugcccacaguaaucgagcaucucgaaaggcugcagcggaaguacggcgguaugcuggugcgcaacccucucucccguaacagcacccacgaaauguacuggauuucaaacgggacuggcaacaucgugagcuccgugaacaugguaaguagauuacugcugaaccgguuuaccaugacgcaccggagacccacaaucgagaaggacguggacuuaggcgccgggacccgccaugucaaugcugagccugaaacccccaacauggacguaaucggcgagcgaaucaagcgcauaaaagaagaacacuccagcacguggcacuacgacgacgagaaccccuacaagaccugggccuaccacggauccuacgaggugaaagccaccggcucugcgagcuccaugauaaacggcgugguuaagcugcucacaaagcccugggaugugguccccauggugacgcagauggccaugaccgacacaacaccauucggacagcagcgaguguucaaggagaaagucgacacgcgcacgccgcgaccaaugccaggcacccgcaaggugauggagaucaccgccgaguggcuguggcggacacuugggcgcaacaagaagccacgccucugcaccagagaggaauuuacaaagaaggugcgcaccaaugccgcuaugggggcggucuucaccgaagagaaccagugggacucagcgcgggccgcaguggaggacgaggaguucuggaagcugguggaucgcgagcgggaguugcacaagcugggcaagugcgguuccugcgucuacaacaugaugggcaagcgcgagaagaagcugggggaguucggaaaagcgaagggcagccgggccaucugguauauguggcugggggcccgcuaccucgaguucgaagcgcuagguuuccuaaacgaggaccacugguucucgcgggaaaacagcuacuccgggguggagggcgagggacuccacaagcugggcuauauucugcgcgauauuagcaaaauccccggcggggcuauguacgcagacgacaccgccggaugggauacccggaucacggaggacgaucuacacaacgaggagaagaucacgcaacagauggacccugagcaccgucaauuggccaacgccaucuuuaagcugaccuaccagaacaaagugguuaaggugcagcggccaaccccuaaggggacagugauggacaucaucucccguaaggaccagcggggaagcggccaggucgggacauacggacucaacacauucaccaacauggaggcccagcugguucgccagauggagggggaaggcguguuauccaaagcggaccuggaaaauccccaccuccuggagaagaaaaucacccaauggcucgaaacgaaaggggucgagcggcugaagcgcauggcaaucagcggugacgacuguguggugaagcccauugaugaccgguucgcuaacgcccuccuagcccucaacgacauggguaaggucaggaaggauaucccgcaguggcaaccgagcaagggguggcacgauuggcagcagguccccuucugcagccaccacuuccaugagcucaucaugaaggauggccggaagcucgugguccccugccgcccccaggacgagcuuauagggagagcccggaucucccagggcgccggcuggucuuuaaaggagaccgccugcuugggcaaggcguacgcccagauguggucccugauguacuuccaccgccgggacuuacgucucgcgagcaacgcgaucugcuccgccgugccgguacacuggauccccaccagucggacaaccuggagcauccaugcgcaccaucaguggaugacgaccgaggacaugcugacagucuggaaccgcguuuggauagaggacaaccccuggauggaggacaaaaccccagugacaaccugggaggacaucccguaccuaggcaagcgggaggaccaguggugugggucguugauaggacucaccuccagagcuaccugggcccagaacauccuaacggccauacagcaaguacggucccucauaggugacgaggaguuccucgacuacaugcccagcaugaaaagauuccggaaggaggaggaguccgagggggccaucugguga

SEQ ID NO: 26134 - RNA, 9873 nt, Artificial Sequence
  derived and/or modified CDS sequence (opt11) from DENV-3__FJ898456__SS-prME
acaagccugugucuaaugaugaugcugccagccacccuggccuuccaccugacaucccgggacggcgaacccaggaugaucguggggaagaacgagcgcggcaagagccugcuguucaagaccgccagugguaucaauaugugcacgcucauugccauggaucugggagagaugugcgaugacaccgugaccuauaagugucccuuaaucacugagguggaacccgaggacaucgacugcuggugcaaccucacaucuaccuggguuaccuaugggaccugcaaccaggccggcgagcacaggagagauaagcguagcguggcccuggcgccccacgugggcaugggacuggacacccgcacucagacguggaugagcgcugaaggcgccuggcggcagguggagaagguggagaccugggccuucagacaccccggguucaccauccuagcccuguuucuggcgcacuacaucgggaccucuuuaacgcaaaagguggugaucuucauccugcugauguuagucacccccagcaugaccaugcggugcguuggggugggcaaucgcgacuucgucgagggccuguccggugccacauggguggacgugguccuggagcacggcgggugcgucacgaccauggccaagaacaagcccacccucgacaucgagcuccaaaagaccgaggccacucaauuggcaacacuccggaagcuuugcaucgagggcaagaucaccaacgugaccacggacagccgcugccccacccagggugaggcgauccugcccgaagaacaggaccagaacuacgucugcaagcacaccuacguggaccgaggcuggggcaacgggugcggucuguucgggaaggguucccuggugaccugcgccaaguuccagugcuuagagagcaucgagggcaaggccguccaacacgagaaccuuaaguacacggugaucaucaccguacacacgggggaccaacaccaggucgggaacgagacccagggggugacugccgagaucacgccccaggccuccaccgucgaggcgauccugcccgaauauggcacccuggggcuagagugcuccccccgcaccggucuggacuuuaaugagaugauacugcuuacgaugaaaaacaaagccuggaugguccaccgucagugguucuuugaccugccgcugcccuggaccagcggcgccaccaccgagacgcccaccuggaauaagaaggagcuccuggugacuuucaagaacgcccacgccaagaagcaggaggucguggugcuagggagccaggagggcgcaaugcauaccgcccucacgggagccaccgagauccaaacuagcggcgggaccagcaucuucgcggggcaccugaagugccgccugaagauggacaagcucgagcugaagggcauguccuacgccaugugccuaaacgcguucguccucaagaaggagguuagcgaaacacaacacggcaccauccugaucaaaguggaguacaagggcgaggacgcccccugcaagaucccauucagcacagaagacggacagggcaaggcccacaacggacgguuaaucaccgccaaccccaucgucacgaagaaggaggagccagugaauauagaagcggagcccccguucggggaauccaauaucguuauugggaucggggauaaagccuuaaagaucaacugguauaagaaaggcagcuccaucgggaagauguucgaagccaccgcucgcggcgcccggcgcauggcgauccucggcgacacggcgugggacuucgggagcgucggcggggugcugaauucccugggcaagauggugcaccagaucuucggaagcgccuacacagcgcuuuucuccggcguuagcuggaucaugaagaucggcauaggggugcuacugacguggaucggccuaaacuccaagaacaccagcauguccuucagcugcaucgucaucgguauaaucacccuguaccugggcgccgucgugcaggcggacauggguugcgugauuaacuggaagggcaaggagcucaagugcggcuccgguauauucgucaccaaugaggugcacacuuggaccgagcaguacaaguuucaggccgacagccccaagcgacuggccaccgccaucgccggggcgugggagaacggggugugcggcauccgcuccaccacgaggauggagaaccugcucuggaagcagaucgccaacgaacugaauuacauccugugggaaaauaauaucaaacucaccaucgucgugggggacgugaucggcauccucgagcagggcaagcggacccugacgccacagccaauggagcucaaguacucguggaagacgugggggaaggccaagauugucaccgccgagacccagaauuccuccuucaucaucgauggcccgaacacaccagagugccccucagcgagccgcgcuuggaacgucugggagguggaagacuacgguuucggggucuucaccacaaacaucuggcugaagcuucgggagauguacacccagcucugcgaccaccgccugaugagcgcggccgugaaggacgagcgggccguucacgcggacaugggcuacuggaucgagucccagaaaaacgggucuuggaagcuggagaaggccucccucaucgaagucaagaccugcacguggcccaaaucgcacacgcuguggucaaacggcgugcuggagagcgacaugaucaucccgaaaucccucgcagggccuauuagccagcacaacuaccgccccggcuaccacacccagaccgccgggccguggcaccuaggcaaacuggagcuggauuucaacuacugcgagggcacuacggugguuaucaccgagaacugcgguacgcgggggcccucccuucgcaccacgaccgugagcgggaagcugauccaugaguggugcugccgguccuguacccugccgccccuccgcuauaugggcgaggaugguuguugguacggcauggagauccggccgaucaacgaaaaggaggagaacauggucaagagccuggucagcgcugguagcgggaaggcggacaacuucaccaugggcgugcucugucuggccaucuucuucgaagaggugaugcgcgguaaguuuggcaagaagcacaugaucgccggggcccuguucacguucguucuccuccugaguggccagaucacguggcgggauauggcccacacccugaucaugaucggcagcaacgccucugaccgcaugggcaugggcgugaccuaccuggcccugauugcgacguucaagauucagcccuuccucgcccugggguucuuccugcgaaagcucaccagccgcgaaaaccugcugcucggcgugggccuggcuauggccaccacccugcagcuaccugaagacaucgaacagauggccaacggcaucgcccugggccugauggcccucaagcugaucacgcaguucgagaccuaccagcuguggaccgcgcucgucucccugaugugcaguaacaccauauucacgcucaccguggccuggcggacagcuacccucauccuggccgugaucucccugcucccagucugccaguccagcuccaugcgcaagacggacugguugccuaugaccguggccgcgauggggguucccagccugccccucuucaucuuuucccugaaagacacucugaagcgccgcagcuggccccucaacgaaggcgucauggccguaggacuuguuucuauccuggccagcuccuucuugagaaacgaugugccaauggccgggcccuuaguggccggcgggcugcucauagcuugcuacguaaucaccggcacgagcgccgacuugaccguggagaaggccgcugacgugaccugggaagaggaggccgaacagaccggggucucccacaaccugaugauaacgguggacgacgacggcaccaugcggaucaaggaugacgagacagagaacauucugaccgugcugcugaaaaccgcacuccugauagucuccgggaucuuccccuauucgauccccgccacgcugcuuguguggcacaccuggcagaaacagacccagcgcagcggugugcugugggacgucccgagcccccccgagacccagaaggccgagcuggaggagggcguguaucggauaaagcagcagggcaucuucgggaaaacccagguugggguaggcguucagaaggaaggaguauuccacaccauguggcaugucacucgcggugcggugcucacccacaacggcaagcggcuggaaccuaacugggcgaacgugaagaaggaccugauuucguaugggggaggguggaaguuauccgcccaguggcagaagggcgaggaggugcagguuaucgccguggagccggggaagaacccuaaaaguuuccagacgaugcccggaaucuuccaaacaaccacgggcgagaucggugccaucgcucuggacuucaagcccggcaccucaggguccccgauuaucaaccgcgagggcaaggucguuggccuguacgggaacggcguggucaccaagaacgggggcuauguaagcgggaucgcgcagaccaacgccgaacccgacggcccuaccccggaacuggaagaagagauguucaagaagcguaaccucacgauaauggaccugcaccccggcucggggaagacccgcaaauaccugccugccaucgugcgggaggccaucaagaggcggcuccgcacucugauccuggcccccacccgggucguggccgccgagauggaggaggcccuaaaaggccugccgaucagauaccagacgaccgccaccaaaucagagcauaccgggcgggagauaguggacuugaugugccacgccacguucaccaugcgguugcuaagcccuguccgggugccgaacuauaaccugauugugauggacgaggcacacuucaccgacccggcgaguaucgccgcccgcggauacauaagcaccagggucggcaugggcgaggcggccgccaucuucaugacggcuacuccgcccggcaccgccgacgcauucccucagagcaacgcccccauacaagacgaggagcgcgacauaccggagcguucauggaacagugggaacgaguggaucaccgacuuugccggcaagacggugugguucgugccguccaucaaggccggcaacgacaucgccaacugccuccgcaagaacggcaagaaggucauccagcugagccgcaagaccuucaacacugaauaucagaagaccaagcugaacgacugggacuucguaguaacgaccgacaucagugaaaugggggcgaacuucaaggccgaucggguaauagacccucgcaggugccucaagcccgugauccugaccgacggcccggagcgcgugauccuggcgggccccaugccuguuaccguagccagcgccgcgcagagacgcggccgggugggccgcaacccccagaaggagaacgaccaauacauuuucacugggcagccguuaaauaaugacgaggaccaugcccauuggaccgaggcuaagaugcuccuagauaacaucaacacucccgagggcauuauucccgcguuauuugagcccgagcgggagaaguccgcugcaauagacggggaguaccgccugaagggcgaaagccggaagaccuuugucgagcugaugcgccggggcgaccucccgguguggcuggcgcacaagguggccuccgaggggauaaaauauacugaccggaaguggugcuucgacggcgagcggaacaaccagauccuggaggaaaacauggauguggagauuuggacgaaggagggggagaagaaaaagcucagaccccgguggcuggacgcgcgcaccuauucggacccccuggcgcucaaggaguuuaaggacuucgccgccggccguaagucaauagccuuagaccugguaaccgagauuggccgcguccccagccaccucgcccaccgcaccaggaaugcgcuggacaaccuugugaugcuucacacgagcgagcaugggggcagggccuaccggcacgccguggaggagcugccugaaaccauggagacccugcuccugcugggacugaugauccugcugaccggcggggccaugcuguuccugaucuccggaaaggggaucgggaaaacgagcaucggccuuauaugcgucguggccucaagcgggaugcucuggauggcggacgugccccugcaauggaucgcguccgccauuguccuggaguucuucaugaugguacuccuuaucccagaaccagagaagcagcgcacgccccaggacaaccaacuggccuacgugguaauuggcauccuaacccucgcugcgauuguugccgccaacgagaugggguugcucgaaaccacgaagcgggaccugggcaugagcaaggaacccggggucgucucucccaccucauaccuagauguagaccuucacccggccucugcguggacccuguacgccguggccaccacugucaucacuccgaugcugcgccacacuaucgagaacagcaccgccaacgugucccucgccgcgaucgccaaccaggcugugguccugauggggcuggacaagggcuggcccaucuccaagauggaccucggggugccccugcuggcccucggcuguuacucccaagugaacccgcugacccugaccgccgcgguacuccugcuggugacccacuacgccauuaucgggcccgggcuccaggccaaggcuaccagggaggcgcagaagcgcacggccgccggcaucaugaaaaaccccaccguggacgggaucaugaccaucgaccuggaccccgucaucuacgacagcaaguucgagaagcagcugggccagguuaugcuccuggugcugugugccguccagcuccugcugaugcggaccucuugggccuucugcgaggcacucacgcuggccaccgggccgaucacgacacugugggaggguagccccggcaaauucuggaacaccaccaucgcugugaguauggcaaauaucuuucgcgggagcuaccucgcaggcgcuggucuggccuucucgaucaugaaguccguaggaacagggaagcggggcacuggcagccagggggagacacugggagagaaauggaaaaagaagcucaaccagcugucacgaaaggaguucgaccuguacaagaaaagugggaucacugaaguagagcggaccgaggcgaaggagggccucaagcgcggggagaucacgcaccacgccgucucccggggcagcgcaaagcuccagugguucguggaacgcaacauggugauccccgagggccggguaaucgacuuagggugcggucgcgggggcugguccuacuacugcgcagggcucaaaaaggugaccgagguccggggcuauaccaagggcgggcccggccacgaagagcccgugcccaugucgacauacggguggaacaucguuaagcugauguccggcaaggacguguucuaucugccgcccgagaagugcgacacccucuuaugcgacaucggggagagcuccccgagcccaaccguggaggagucucgcacaauccgggugcugaagauggucgagcccuggcugaaaaauaaccaguucugcaucaaggugcucaauccuuauaugccaacagugauagagcacuuagagcgccugcagcgcaagcacggcggcaugcucguccggaacccccugagucgcaacucaacccacgagauguacuggaucagcaacgggacuggcaacaucguguccagcgugaacauggucucccggcuucuccugaacagguucacgaugacccaccggcggcccaccaucgaaaaggacguugaucucggggcaggcacacggcacgugaacgccgaacccgagacgcccaacauggacgugaucggcgaacggauccggcgaaucaaggaggagcacucguccacuuggcauuaugacgacgagaaccccuacaaaacgugggccuaccacgggagcuacgaggugaaggccaccggcagcgcgucaagcaugaucaacggggucgugaaacuccugacgaagcccugggacguggucccgaugguuacccagauggccaugaccgauacaacacccuucggccagcaacggguguucaaggagaaggucgacacccgcacgccccggcccaugcccgggacgcgcaaggugauggagaucacggccgaguggcuguggcggacccucggccgcaacaagcgccccagguugugcacccgugaggaguucaucaagaaggugcgcacuaacgcugcgaugggcgccgucuucacggaggagaaccagugggacuccgcccgcgccgccguggaggacgaggaguucuggaagcugguagauagggagcgagaacuccacaaguuagggaagugugguagcugcguuuauaacaugauggggaagcgggagaaaaagcugggcgaguucgggaaggcgaagggaucccgagccaucugguacaugugguugggcgcccgguaccuugaguucgaggccuugggguuucuaaacgaggaccacugguuuagccgcgagaauucguauagugguguugagggggagggcuuacacaagcugggcuacauccuccgggacaucuccaaaauccccgggggcgccauguacgcggacgacaccgccgggugggacacccgcaucaccgaggacgaccugcacaacgaagagaagaucacgcagcagauggaccccgagcacagacgccuggccaacgccaucuucaagcucacauaccagaacaagguggucaaggugcagcggccaacccccaagggcaccguuauggacaucaucagccgcaaggaccagagaggguccggccaagucggaacguaugggcugaacaccuucaccaacauggaggcgcagcugauccgccagauggagggcgaagggguccucucgaaggcggacuuagagaacccccacuuacucgagaagaaggugacccaauggcuggagaccaagggcgucgagcggcugaagcgcauggccaucuccggugacgacuguguggugaaacccauagacgacagguucgccaacgcccuccuggcccugaacgacaugggcaaaguccgcaaggacauuccucaguggcaacccagcaagggcuggcacgacuggcagcagguucccuucugcucccaccacuuccacgagcucaucaugaaggacgggcggaagcuggugguccccugccgcccgcaggacgagcugaucggccgugcgcgcauuagccagggggcgggcuggucccuccgcgagacggccugccuggggaaagccuaugcucagaugugggcccugauguacuuccaucgccgcgaccuccggcucgccagcaacgccauuuguuccgccgugcccgugcacugggucccgaccagucgcaccaccuggagcauccacgcccaccaccaguggaugacgaccgaggauaugcugaccguguggaaccggguguggauugaagacaacccguggauggaggacaagacaccgguuacgaccugggaggacgugccuuaccucggcaagcgcgaggaccaguggugcggcuccuugaucggccuggccagucgggccaccugggcccagaacauccucacagccauccagcagguccgcucccugauaggcaacgaggaguucuuagauuacaugccuagcaugaagcgcuuccgcaaagaagaggaguccgagggagcgaucugguga

SEQ ID NO: 26135 - RNA, 9873 nt, Artificial Sequence
  derived and/or modified CDS sequence (opt11) from DENV-3__JN697379__SS-prME
accucccucugucucaugaugaugcugcccgccacucucgccuuccaccucaccucccgagacggcgagccgcggaugaucguggggaaaaacgaacgcggcaagagccuuuuauucaaaaccgcgucagggaucaacaugugcacccucaucgccauggacuuaggugagaugugcgaugauaccgucacguauaaaugcccccauaucaccgagguggaaccggaggacaucgacugcuggugcaauuugacuagcaccugggugacguacgggaccuguaaccaggccggcgagcaucggcgcgacaagcggucagucgcucuagcgccccacguuggcauggggcuggauaccaggacccagacguggaugagcgccgagggcgccuggagacagguggagaaggucgagaccugggcccuccgccaucccggguucaccauccucgcccuguuccuggcucacuacaucggcaccucgcucacucagaagguggugaucuucauccugcugauguuggucaccccuagcaugacgaugcggugcguugggguggguaaccgcgacuucguggagggacuguccggggcaacuuggguggacgugguccucgagcacggcgggugcgucacgaccauggccaagaacaaacccacccucgacaucgaacugcaaaagaccgaagcuacgcagcucgcaacccuccggaagcugugcaucgagggcaaaaucacuaacaucaccacggacagccgcugccccacgcagggugaagcaaucuuacccgaggaacaggaccagaacuacgugugcaaacauaccuaugucgaccgggguuggggcaaugggugcggccuguucgguaagggcucccuugugaccugcgccaaguuccagugucuugagaguaucgagggaaaggugguccagcacgaaaaccucaaguacacggugaucaucacagugcacacgggggaccagcaucaggucgguaacgagacgcagggcgugaccgccgagaucacgucccaggcuagcaccgcagagguaauucugcccgaguacggcacccugggccucgagugcuccccacggaccggacuggacuucaacgaaaugauucugcucacgaugaagaauaaggcguggauggugcaccggcaaugguucuucgaucugccccugccauggaccagcggcgccaccacagagacaccgacuuggaaccgcaaggagcuccuggugaccuuuaagaacgcccacgccaagaagcaagaggucguggugcuagggucccaggagggcgccaugcacaccgcacuuacaggcgcuaccgagauccagaccagcggcgggaccucgaucuuugccggccaccugaaaugccggcugaagauggacaaacucaagcugaagggcauguccuacgccaugugccugaacacuuucguuuuaaagaaagagguguccgaaacgcagcacgggaccauccugauaaagguugaauacaagggagaggacgcccccugcaagauacccuucuccaccgaggacgggcagggaaaggcgcacaacggccgccugauuacagccaacccggucgugacgaagaaggaggagcccguaaacaucgaggccgaacccccuuucggggagagcaacaucguaaucgggaucggggacaaggcccugaaaaucaacugguacaggaaaggcuccagcaucgggaaaauguucgaggcaaccgcucguggcgccaggcgcauggccaucuugggcgacaccgccugggacuucgguuccguaggcggggugcugaacucucugggcaagauggugcaccaaaucuuugggucugcguacacggcccucuucuccggcguguccuggaucaugaagaucggcaucggggugcuguuaaccuggaucgggcucaacaguaagaacaccuccaugagcuuuuccugcaucgccauugguauaaucacccuguaccucggaguggucgugcaagccgacauggggugcgucaucaacuggaaggggaaggagcucaaaugcggcucggguaucuucgugacgaacgaggugcacaccuggaccgagcaauacaaauuccaggcagacuccccgaagcggcuggcgaccgccaucgcgggcgccugggaaaacggggugugcggcauacgaagcacgaccaggauggaaaaccugcucuggaagcagauagccaacgagcugaacuacaucuugugggagaacaacauuaagcucaccguggugguaggugacauuaccggugugcuggagcaggggaagcggacgcugacaccccagccgauggagcugaaguacuccuggaagacaugggggaaggcgaagauagugaccgccgagacgcaaaacagcuccuucauuauagacggcccaagcaccccggaaugcccgagcgccucccgcgccuggaacgugugggagguggaggauuauggguucggcguguucaccacuaauaucuggcuaaagcugcgggaggucuacacccagcucugugaccaccgccuuaugucggcggccgugaaagacgagcgggccgugcacgcagacaugggcuacuggaucgagucccagaaaaacgggagcuggaaguuagagaaggcaucccucaucgaagucaagacguguacguggcccaaaucccacacgcugugguccaacggggugcuugagagugauaugauaauucccaagucccuagcggggccgaucucccagcauaaccaucgccccggcuaucacacccagacugccggccccuggcacuugggcaagcuggagcucgauuucaacuacugcgaggggaccaccguggucaucucggagaacugcgguacucggggcccgagucugcguaccaccaccguguccgggaagcugauccacgaguggugcugccgaagcugcacgcuaccaccccugcgcuacaugggcgaggaugggugcugguacggcauggaaauccggccaaucaacgaaaaagaggagaauauggucaagucccuggccagcgcgggcuccgggaaagucgacaacuucacaaugggcguucucugccuggccaucuuauuugaagaagugaugcgcgggaaguuuggcaagaaacacaugaucgcugggguacucuucacguuugugcugcugcucucugggcagauuaccuggcgugacauggcccacacccugauaaugaucggcucaaacgugagcgacaggaugggcaugggcgucacguaccuggcccucaucgcgaccuucaagauccagcccuuccuggcccugggguucuuucuccgaaagcugaccagccgcgaaaaucugcuacuuggcgugggccucgcgauggccgccacccuccggcugccugaggacaucgagcaaauggccaacgggaucgcauugggccucauggcgcugaaacuuauuacgcaguucgagaccuaccagcuguggacugcccuggugucuuugaccugcagcaacacgaucuucacacuaacgguggccuggcgcacagccacccugauccuggcggggaucucccucuugcccgugugccagucguccucuaugcggaagaccgacuggcugccuaugaccgucgccgccaugggcgugccgccccuuccccuguucaucuucucccugaaggacacccuuaagcggcggucguggccacugaacgaaggggugauggccgucggccuggucaguauccuggccagcucccugcugcggaacgacguuccgauggcgggcccccucguugccgggggcuuauuaauagccugcuacgucaucacugguaccagcgccgaucuaaccgucgagaaggcugcagacguaacgugggaggaagaagccgaacagacgggcgugucccacaaccugaugaucacgguggacgaugacgggaccaugcgcauaaaagaugacgaaaccgagaacauccugaccguccucuuaaagacggcgcugcucaucgugucugguaucuucccguacuccauccccgccacccugcugguguggcacaccuggcaaaagcagacccagagaagcggcguccucugggacguuccgagcccacccgagacgcaaaaagcugaacuggaggagggcguguauaggauuaagcagcaaggaauauucgggaagacccagguaggugugggggugcagaaggagggcgucuuucacaccauguggcacguaacccggggcgcagugcugacgcacaacggcaagcggcucgagcccaacugggcuagcgucaagaaggaccugaucagcuacggcgggggcuggcggcuguccgcccaauggcagaagggggaggagguacaggugaucgccgucgagcccgggaagaaccccaaaaacuuccaaacuaugccggggaucuuccagaccaccacgggggaaaucggcgcuaucgcgcuggacuucaagcccgggacuuccggauccccuaucauaaaccgggaggggaagguuguugggcucuacggcaacggggucgugaccaagaacggcgguuacguguccggcauagcccagaccaacgccgaacccgacggacccacgccggaacuggaagaggagauguucaagaaaaggaaccuaaccaucauggaccuccaccccggcuccggcaaaacccgcaaguaccugccugccauaguccgggaggcuaucaagcgccggcugcgcacccucauccuggcccccacacgggugguggccgccgagauggaggaggcccugaaagguuugccaaucagguaccagaccacugccacuaagagcgaacacacgggccgggagaucgucgaccugaugugccacgccaccuucacgaugcgccugcucucacccgugcgggugcccaacuacaaccuaauuaucauggacgaggcccacuucaccgacccagccagcaucgccgcgagggguuauaucuccacccgcgugggcaugggcgaggccgcugccaucuucaugaccgcuacuccgccagggaccgcagacgccuucccccaguccaacgccccaauccaggacgaagaacgggacauaccggagcgcucauggaacagcggcaacgaguggauaacggacuucgucggaaagaccgugugguucgucccauccaucaaagccggcaacgacaucgcgaauugccuucggaagaacgggaaaaaggugauccagcuaucaagaaaaacuuucgacaccgaguaucagaagacgaagcugaacgacugggacuuuguggugaccaccgacaucuccgagaugggcgccaauuucaaggccgaccggguuaucgacccccgucggugcuugaagccaguuauccucaccgacggcccagagcgcgucaucuuggcagggccaaugccugugacuguggccagcgcggcccagcggaggggccgagucggucgcaacccacagaaggagaacgaccaauacaucuucaugggucagccgcugaacaacgacgaggaccacgcccacuggaccgaggccaagaugcuccuggacaacaucaacacccccgagggaaucauccccgcccuguuugagcccgagcgcgagaaauccgcagcaauagacggcgaauaccgccucaagggagagagccggaagaccuucguggagcugaugcgccggggcgaccugccggucuggcucgcccauaaaguggccagcgaggguaucaaguacaccgaccgcaaguggugcuucgauggggagcggaacaaccaaauccuggaggagaacauggacguggagaucuggacuaaagaaggcgagaagaagaagcuccgcccgcgcuggcucgacgcgcggaccuauagcgacccccuggcccugaaggaguucaaggacuucgcggccgggcggaaaagcaucgcccucgaccucguuaccgagauugggcggguccccucccaccuugcccaccgcacccggaacgcucucgacaaccuggugaugcugcacacgagcgagcacggcgggcgcgccuauaggcacgccguagaggaacucccggagaccauggagacacugcugcuccugggccugaugauccuccugaccgggggcgcgaugcuuuuucugaucuccggcaaagggaucggcaagacgucuaucggucugaucugcguuaucgcguccagcggcaugcuguggauggccgacguuccacuccaguggaucgccucugccaucguacuggaguucuucaugauggugcugcucauccccgagccugagaagcagcgcaccccacaggacaaccagcuggccuaugugguaaucgggauccugacccucgcggccaucguggccgcuaacgagaugggccugcuggagacuacgaagcgggaccucggcaugagcaaggaacccggggugguuuccccuacgagcuaccuggacguggaccuucaccccgccagcgcguggacgcuauacgcaguugccaccacagucaucacgcccaugcugcgccauaccauagagaacucgacagccaacgugucccuggcggccaucgccaaucaggccgugguccucaugggccuggauaagggguggcccaucagcaagauggaccugggcgugccucuccuggcuuuagggugcuacucccaggugaacccgcugacgcuggcggccgcggucuuacuccuggugacgcauuacgcuaucaucggccccgggcugcaggccaaagcaacgcgggaggcccagaagcgcaccgccgcagggauuaugaagaaccccacuguagauggcaucaugaccaucgaccucgaccccguaaucuaugauaguaaguucgagaaacaguuaggacaggucaugcugcucgugcugugcgccguacaauuacuacugaugcggaccuccugggcgcugugugaagugcucacucuggcaacgggcccgauaacuacccugugggagggcagccccgggaaguuuuggaacaccacaaucgccguauccauggccaacauuuuccgcggcagcuaccuagcgggggcgggacuggccuucagcaucaugaagucaguagggaccgguaagcggggcacaggcagccagggcgagacccugggggagaaguggaagaaaaagcucaaccaacuuagccgcaaggaauuugaccuauauaagaaaagcggcaucaccgagguggaccggaccgaagccaaggagggacucaaacgcggcgagaucacccaucacgccguuucccgggguucagcgaagcugcagugguucgucgagcgcaacauggugauccccgaggggcgggugaucgaccucggauguggucgcggaggguggagcuacuacugcgcaggacucaagaaggucacagaagugcgcggcuacacaaaagggggccccggucacgaggagccgguacccaugagcacguacggcuggaacaucgucaagcugauguccgggaaggacguguuuuaucuuccacccgagaagugcgacacccugcucugcgacaucggcgagagcuccccgagcccuaccguggaggagucccggaccauccgcguccugaagaugguggagcccuggcugaagaacaaucaguucugcaucaaaguucucaaucccuacaugccgacggugaucgagcaccuggagcggcugcagcguaaacauggcggcaugcucgugcgaaacccgcugucacgcaacuccacccacgagauguacuggaucuccaacggcacggggaauaucguguccagcgucaacauggugucccggcugcuccugaacagauucacuaugacccaccggcgacccaccaucgagaaagacguggaccuuggcgccggcacccggcaugugaacgcugagcccgagaccccuaauauggacgucaucggggaacgcaucaagcggaucaaggaggagcacagcagcacguggcacuacgacgacgagaaccccuauaagacaugggcuuaccacggcucuuacgaggucaaggcgacuggcagcgccucaagcaugauuaacggcguuguaaaacuccugacgaagccgugggaugucgugcccauggugacucagauggccaugaccgacaccaccccguuugggcagcagcgagucuucaaggaaaagguggacacgcggacuccccggccuaugcccgggacccggaaggugauggaaaucacggccgaguggcuguggcgcacgcucgggcggaauaagcgcccccgccugugcacccgggaggaguucacaaagaaggugaggaccaacgccgcgaugggggccgucuucacugaggagaaccagugggacuccgcucgggccgcgguggaagacgaagaguucuggaagcuggucgaccgcgagcgggaguugcacaaacugggcaaaugcggaagcuguguguacaacaugaugggcaagcgcgagaaaaagcugggcgaguucggaaaggccaaaggaucccgagcuauuugguacauguggcucggagcccguuacuuggaguucgaggcccugggauuccuaaaugaggaccacugguuuucacgggaaaauuccuauucugggguugagggcgaagggcugcauaaacugggcuacauacuccgugacaucucgaagauucccggcggggcgauguaugccgacgacacugcagguugggacacccggauuaccgaggacgauuuacacaaugaagagaagaucacgcaacagauggaccccgagcaccgccagcuggccaaugcuaucuucaagcucaccuaccagaacaaagucgugaaggugcagcggccaacccccaagggaaccguuauggacaucaucagccgcaaggaccagcggggcuccggccagguagggacguacggucugaacacauucaccaacauggaagcgcagcuuauccgccagauggagggggagggggugcucagcaaggcugacuuagaaaacccccauccccuggaaaagaagauuacccaguggcuagagacuaaagggguugagagacugaagcgcauggccaucuccggcgacgacugcgucgucaagccuaucgacgaucgguucgcaaacgcgcugcucgcgcuaaacgauauggggaaaguuagaaaggacaucccccaguggcaacccuccaagggcuggcaugacuggcaacaggugccuuucuguucacaucauuuccacgagcugaucaugaaggacggccggaagcucgugguuccgugccgcccccaggacgaauuaaucgggcgcgcccgaauaagccagggcgccgguuggucccugcgcgagacggccugccucggcaaggcauacgcgcagauguggacccugauguacuuucaccggcgcgaccugcggcuugccucuaacgccauaugcagcgccgugccggugcauuggguccccacaucccguaccacguggucgauccaugcccaccaccaguggaugaccaccgaggacaugcucaccguguggaaccgggucuggaucgaggacaaccccuggauggaggacaagacgccagucacuacgugggaggacgugcccuaccucggaaagagggaagaccaauggugugguucgcucaucggcuuaacaagccgggcaacuugggcccagaacauucugaccgccauccaacagguccguucccucaucggcaacgaggaguucuuggauuacaugccgucgaugaagagguuccgcaaggaggaggagucagagggcgccaucugguga

SEQ ID NO: 26136 - RNA, 9873 nt, Artificial Sequence
  derived and/or modified CDS sequence (opt11) from DENV-3__JQ045687__SS-prME
accagccucugccugaugaugaugcuaccggcaacccuugcauuucaccuaacaagcagagacggggaacccaggaugaucgucgggaaaaaugaacggggaaaaagccuucucuucaaaaccgcaucaggaauaaauauguguacacucauugcaauggaucuaggagaaaugugugacgacacgguaacguacaaaugcccccugguagcggaaguagaaccggaagacaucgacuguugguguaaucucacguccacauggguuaccuacggcacaugcaaccaggcuggagaacauaggcgcgacaaacgaagcguggcauuagcaccccacgugggaaugggcuuggacacccggacgcaaacguggaugucagcagaaggcgcguggcgccaggucgaaaaaguagaaacaugggcauugagacacccaggcuucacuauacuugccuuauuccuagcgcauuacaucggaacgucgcugacccaaaaaguggucauuuucauccuucucaugcugguuacgcccuccaugacgaugcguugcguggguguaggaaaccgcgacuucguagaaggucucucuggggccacguggguggauguugugcuggaacacggcgguugcguaacaacaauggccaaaaacaaaccaacccucgauaucgaacuacagaaaaccgaagcuacacaacuugcgacguuaaggaaauuaugcauagaaggaaaaauaacgaauauuacgacggauagccgcugccccacccaaggcgaagcgauacucccggaagaacaggaccaaaauuauguaugcaaacauacauacguggauagaggauggggaaacggaugcggcuuguucggaaagggaucgcuugugaccugcgcgaaauuccaaugucucgagccgauugaaggaaaagucguacaguaugaaaaccucaaguacaccgugaucaucacagugcauacgggagaucaacaucaggugggcaacgacacacagggagucacagucgagauaaccccacaggcaucaacgguggaggcgguccucccagaguacgggacccuagggcucgaaugcaguccccggacagggcuggacuucaaugagaugauacuccucacuaugaaaaacaaggccuggaugguacaccggcagugguucuuugaccuaccacuaccauggaccucaggugcaaccacagaaaccccgacuuggaacaagaaagaacucuuagugacuuucaaaaaugcucacgccaagaaacaagaaguggucguccugggcucgcaagaaggagcaaugcacacagccuuaaccggagccacagagauacaaaacagcggcggcacgucaauuuuugccggccacuuaaaaugccguuugaaaauggacaaacuagagcuaaaaggcaugagcuacgcgaugugccuaaacacauucgugcucaagaaagaaguuucagaaacacaacacggcacaauccugauaaaaguugaauacaaaggcgaggacgccccuugcaaaauaccuuuuaguacggaagacgggcaagggaaggcucauaacgggcgccucauuaccgccaauccagucgucacgaagaaagaagaaccaguaaacauagaagcagaaccuccauucggcgagagcaacauuguaauugggauaggagacaaggcccuaaaaauaaacugguauaagaaaggcaguucuauaggaaaaauguucgaagccaccgcgcggggugcacggcggauggcgauccugggagauaccgcuugggacuuuggguccgucgggggaguacuaaacagccucgggaaaauggugcaucagauauucggauccgcguauacggcccuauuuucagguguauccuggauaaugaaaauaggaaucggagugcuucucaccuggauuggccuaaauucaaagaacacgagcaugucauucaguugcaucgucauaggcaucauaacacuauacuugggggccguaguacaagcggauauggguugcgcaaucaacuggaagggcaaagaacucaaaugugggagcggaaucuucgucacaaaugaaguacacacuuggaccgaacaauacaaauuccaagcggauaguccgaaacgauuagccacggccaucgcgggugcaugggaaaacgguguaugcgggauacggagcaccacgcggauggagaaccuacuguggaaacagauagcaaacgaauugaacuacaucuuaugggaaaacaauaucaaacuaaccguggugguaggagacauuaucggcguacuugagcaagguaaacggacucuaaccccacaaccgauggagcugaaguacucauggaagacuuggggcaaggccaagauuguaaccgcggaaacacaaaacucaucauucauaauagauggucccaacacuccggaauguccaucugcgagcagggccuggaacgugugggagguagaagacuacggauucggaguuuucacuaccaacaucuggcuaaaacugcgugaagucuacacccaaagcugcgaucacaggcucaugagcgcagcaaucaaagacgagagagcuguacacgcggacaugggcuacuggauugaaagccaaaagaacggauccuggaagcuggaaaaggcuaguuucauagaaguuaagacaugcacuuggccgaaaagccacacgcuauggaguaacggaguacucgaaagcgauaugauaaucccgaaaagccuagcaggaccaauuagccaacacaaccaccgucccggauaucacacccaaacggcagggccauggcauuugggaaagcuagaacucgauuucaacuacugcgaaggcaccacaguagucauaacagagaacugcggaacgagaggaccaagccuuagaacgacaacugucagcgggaagcucauucaugaaugguguugucggucgugcacccuacccccgcuaagauacaugggggaagacggauguugguacggcauggaaaucagaccgaucaacgagaaagaagaaaacaugguaaagagcuuaguaagcgccgggucggggaaggucgacaacuuuacuaugggaguacucugucucgccauucuguuugaggaagucaugcggggaaaguucgggaagaaacacaugauagccgguguacuauucacuuucguccuucuccucagcggacaaauaacauggcgggauauggcacauacccugaucaugaucgguucaaacgcgucggaccgcauggggaugggcguaaccuacuuagcguugaucgcaacguuuaagauacaaccuuuccuggcucucggauuuuuccuacgaaaauuaacaagcagagaaaaccuccuacugggugucgguuuagccauggcaacgacacuccagcuacccgaggacauagaacagauggccaacgggaucgcccuaggacucaugacccucaaacugauaacacaguucgaaaccuaccagcucuggaccgcgcuaguaucgcuuacauguuccaacacgauauucacccugaccgucgcauggagaaccgccacacucaucuuagccggagugucgcugcuaccacucugucagucaaguuccaugcguaagacagacugguuaccuaugacugucgccgcaaugggggucccaccguuaccucuuuuuauuuucucacuaaaagacacgccuaagcgacgcucauggccacugaacgaggguguaauggccguugggcuagugucaauacuagcuaguucucuucugcguaacgauguuccaauggccgggccucugguggcaggcggucuccuaaucgcuugcuacgugauuaccgggaccagcgccgaccucacggucgaaaaagccgcagauguaaccugggaagaagaggccgaacagacaggcguuagccauaaccucaugaucaccgucgacgaugacgguacuaugcgcaucaaagaugacgaaaccgagaacauccucacaguccuacucaaaacggcccuucuaauugucagcgguaucuuccccuacagcaucccagcuacgcugcuaguuuggcacaccuggcaaaagcaaacgcaaaggucaggaguccuaugggacguaccuucgccaccggaaacacaaaaggccgagcuggaggaaggaguauaucggauaaaacaacaaggaaucuucggaaaaacccaaguugguguaggaguacaaaaagaaggagucuuccacacaauguggcacguaacucgaggagccguccugacacacaacgguaaaagacuggagcccaacugggcguccguaaagaaagaccuuauaaguuacggcggaggguggcgucuuuccgcccaguggcaaaagggcgaagagguacagguuauagcugucgaaccaggcaaaaaucccaaaaacuuccaaacaaugcccggaauauuucaaacgacuacgggcgaaauaggcgcgauagcacuagacuucaaacccggaaccaguggaaguccgaucauaaaccgggaaggcaagguaguaggacucuauggcaauggcgugguaacgaaaaacgguggguacgucaguggcauagcccaaacaaaugcagaaccagauggaccaacacccgaguuagaagaagagauguucaaaaagcguaaccuaaccaccauggaccugcauccgggcagcggaaaaacacgcaaguauuuacccgccauagucagagaagcaaucaaacguagacuacggacccuaauccucgcaccaacgaggguggucgcugcggaaauggaggaggcccucaaaggauuaccgauucgauaucagacgacggccacaaagagugagcacacaggucgcgagaucguggaccugaugugucacgcaaccuucaccaugcgacugcucucccccguacgagugccuaauuauaaccuaauaauaauggacgaagcccauuucacagauccagcgagcauagcugccagaggcuacaucucaaccagagucggcaugggagaagccgccgccaucuucaugacagcgaccccucccgggacugccgaagcauucccgcagagcaacgcgccgauacaggacgaagagagggacauaccagagaggucauggaacuccgguaacgaauggaucacagacuuuguggggaagacaguaugguucgucccaaguauaaaggcggggaaugacaucgcaaauugccuccggaaaaacggaaagaagguuauucaacucucgagaaagaccuucgacacagaauaccagaaaaccagacuaaaugauugggacuuuguagucacgaccgacauuucugagaugggugcgaacuuuaaagcagaccgcgucauugauccgcggaggugccuaaagcccguaauacucacggacggccccgagcgggucaucuuggccggcccuaugccagucacggcagcaagcgcagcacagcgccgcggccgcgucggccggaacccccaaaaagaaaacgaucaauacaucuuuacuggacaaccacuaaacaacgaugaagaccaugcgcauuggacggaggcaaagaugcuacuggacaacaucaacacaccggaagggaucaucccggcguuauucgagcccgaacgagaaaagagcgcggcgaucgauggcgaguaccgacucaaaggcgaaagcagaaaaacuuuuguggaguuaaugaggcgcggggaccuaccaguauggcuggcgcacaagguggcguccgagggcaucaaauacacugacagaaaauggugcuuugacggggaaagaaauaaccagauacuggaagagaauauggauguggaaauuuggacaaaagaaggcgaaagaaagaaauugcgcccccguuggcuggaugcccgaacuuacagcgauccacuugcacuuaaagaguucaaggauuucgcagcaggaaggaaaucaaucgcccuggaucucguaacugaaauugggcgcguaccuagucacuuggccuaccgcacacgcaaugcucuagauaaccucguuaugcuccauacaagcgaacauggcggacgagcuuaucgacacgccguugaagaacuaccggaaaccauggagacauuacuacuucuaggauuaaugaucuugcugacaggcggagcaaugcuguucuuaauaucaggaaaaggcauagggaagacgucaauugggcugauauguguuauagucucuagcgggauguuguggauggcugacgucccucuacaauggaucgcguccgcaauagugcuggaguucuuuaugaugguuuugcucauuccagaaccagaaaaacaaagaacaccccaggauaaccagcuagcguacguaguuaucggcauucugacacucgcggcaaucguggcggcgaaugaaaugggauuguuggaaacaacgaagagggaucucggcaugucgaaagaaccgggcguagucagcccgaccaguuaccuagacguugaccugcacccagcaagcgccuggacguuguacgccguugccacgacggucaucaccccaaugcuaagacauaccaucgagaacucgacggccaacguaagucucgcugccauagcuaaccaggcagucguacugaugggacuagacaaaggguggccgaucucgaaaauggaccucggaguaccacuccuggcauugggaugcuauucacaaguaaacccuuuaacccuuacggccgccguccuccugcucgucacucauuacgcuaucauuggucccggccugcaagcgaaagcaacacgagaggcacagaagcgaacggccgcaggcauaaugaagaauccgaccguagacggaaucaugacgauagaccucgaccccgugauuuacgacuccaaguucgagaaacagcucgggcaaguuaugcuccuagugcucugcgccguccaauugcuacugaugaggaccucgugggcgcucugugaggcgcucacccuugccaccgggccuauaacaacccucugggaagggucgcccggaaaguucuggaacacgacgaucgcagucagcauggcgaacauauucaggggcucauaccuagcgggcgcggggcuagcauucagcauuaugaaaagcguagggaccggccgacguggcaccggcucccagggagaaacccuaggagagaaauggaagaagaaauuaaaccaacuaagccgcaaggaguucgaccucuacaaaaagucuggcauaaccgaggucgauagaacagaggcaaaggagggacuuaaaagaggagagaccacacaccaugcaguguccagaggauccgccaaauuacaaugguucgucgaacguaacaugguaaucccugaggggagggugauagacuuaggcugcggacgcggcggcugguccuacuacugcgcuggccucaaaaaggugacagaggugagggguuacacaaaaggcgggcccgggcacgaagaaccugucccaauguccaccuacggcuggaacauugugaaacuuaugaguggcaaggacguuuucuaucuacccccugaaaagugcgacacguuacucugcgauauaggcgaaaguaguccgucccccacgguagaagaguccagaacaauuagaguauugaaaauggucgagccauggcucaagaauaaccaguucugcaucaaagugcuaaacccuuacaugcccacgguaauagaacaccuugaacgccuacaacgcaaguauggaggaaugcugguacgaaacccauugucucgcaauaguacccaugaaauguacuggaucagcaacggaaccggcaacauaguaaguagcgucaacauggucagucgacuacugcuuaacagauucacaaugacgcaucgacgaccgacuaucgaaaaagauguggaccucggggcgggcaccagacacgugaacgccgaaccagaaacgccuaacauggacgucauaggcgagagaauaaagagaauaaaggaggagcacagcaguaccuggcacuacgacgacgaaaauccguacaaaacgugggccuaccacgggaguuacgaagucaaagccacaggauccgccuccuccaugauaaacggugucgugaagcuguugacaaaaccaugggauguaguccccauggugacgcaaauggcaaugacagacacaacaccauucggccagcaacgcguuuucaaggaaaaaguagacaccagaaccccacgaccgaugccaggaacgcgcaaaguuauggaaaucacagcagaauggcucuggcgaacgcuuggccgaaacaagaagcccagauugugcacccgcgaagaguucaccaagaaaguaaggaccaaugcugcuaugggcgcaguguucaccgaagagaaccaaugggacagcgcgcgggcagccguagaagacgaggaguucuggaaguuaguagaucgugaaagggagcuacacaagcugggcaaaugcggauccugcguguauaacaugaugggaaagcgggaaaagaaacuaggggaguucgggaaagcgaaaggaucacgggcaauaugguacauguggcugggggcccgcuaccucgaguucgaggcccugggguuccuaaacgaggaucacugguucagccgagaaaauagcuacagcggcguugagggugagggccuucacaagcuagguuacauacuccgagacaucagcaaaauaccggguggugcgauguacgcagacgauaccgccggcugggauacgcgcaucacagaagacgauuuacacaacgaagagaaaauuacgcaacaaauggaccccgagcaucggcagcuagcaaacgcaaucuuuaaauuaacguaccagaacaaagucgugaaaguacaaaggcccacaccgaagggaacuguuauggacauaaucucgagaaaggaucaacggggcagcgggcaaguaggcacguauggacucaauaccuucacuaacauggaggcacagcucguacgccaaauggaaggugaaggcgugcuaagcaaggccgaccuagagaacccacaucugcucgagaaaaagauuacccaguggcucgagacaaagggaguagaacgacugaaacgaauggcaauuagcggcgacgacugcgugguaaaaccaaucgacgaccgguuugcaaacgcauuauuagcccucaacgacauggguaaagugcgaaaggacauaccgcaauggcaaccaucgaaaggcuggcacgacuggcagcaaguacccuucuguagucaucauuuucaugaacuuaucaugaaagacgggaggaagcuagucguacccugccguccgcaggacgaacugauaggcagagcacggauaucgcagggggcuggcuggagucucaaggagaccgcuugccucggaaaagccuacgcccagauguggucccugauguacuuccaucggcgcgaucugcgacucgcgaguaacgcaaucugcagcgcagucccgguccacuggaucccgacguccaggaccacauggaguauacacgcccaucaccaguggaugacgacggaagacaugcugacaguuuggaaccgugucuggaucgaagacaauccauggauggaggauaaaacaccgguaacaacaugggaagacgucccauaccucggcaagcgcgaagaccaauggugcgguagucuaauuggacuaacaucgcgcgccaccugggcacaaaacauauugaccgcuauccaacaagugcggaguuugaucggagaugaagaguuccuggauuacaugcccuccaugaagcgauucaggaaagaagaggagagcgaaggcgccaucugguga

SEQ ID NO: 26137 - RNA, 9873 nt, Artificial Sequence
  derived and/or modified CDS sequence (opt11) from DENV-3__JQ045689__SS-prME
accagucugugucucaugaugaugcugcccgcgacuuuggcuuuccaucucaccagccgggacggcgaaccgagaaugaucguugggaagaacgagcgcggaaaaagccugcuguucaagaccgcguccgggaucaauaugugcacucucaucgcgauggaccugggcgagaugugcgacgacaccgucaccuacaagugcccccugaucgccgagguggagcccgaggacaucgacugcuggugcaaccucaccagcaccugggugaccuacgggacaugcaaccaggccggcgagcaccggcgugacaagcgguccguagcccuggcgccccacguuggcaugggacuggauacccgcacgcagaccuggaugagcgccgagggcgccuggcggcaauucgagaaggucgagacgugggcucuccgccacccgggguucaccauauuagcgcuguuucuagcccacuacaucgguacgucacugacacagaaggucgugaucuucauccuacucaugcuaguaacgcccucaaugaccaugcgguguguaggggucggcaaccgcgacuucguggaaggccuguccggggccaccugggucgacguagugcucgaacacggcgggugcgucaccacgauggccaagaacaagcccacccucgacaucgaacugcagaaaaccgaggccacucagcuugcgacucuccggaagcuaugcaucgagggcaagaucaccaacaucaccaccgacagccgcugccccacgcagggcgaggccaucuuaccggaggagcaggaccagaacuacguguguaagcacaccuauguggaccggggguggggcaacgggugcggccuguucgggaagggcucccuggugaccugugccaaguuucagugccucgagcccaucgagggaaaggugguucaguacgaaaaccugaaauacaccgucaucauuacggugcacacuggggaccagcaccaggucgggaacgacacccaaggggugacgguggagaucacgccccaggcaagcaccguugaggcuguguugccagaguacggcacccucgggcucgaguguuccccgcgcaccggccuggacuucaacgagaugauccuccucaccaugaagaacaaggcguggauggugcauaggcagugguucuucgaccugcccuugccuuggacaagcggcgccaccaccgagacccccacguggaaccgcaaggagcugcuggucaccuucaagaaugcccacgccaagaagcaagaggugguggucuuggggagucaggagggugccaugcacaccgcgcugaccggcgccacagagauccagaacagcggcggaaccuccaucuucgccggccaucugaagugccggcuaaagauggacaagcuggaguugaagggcaugucguacgccaugugcuugaacaccuucguucugaagaaggagguguccgaaacccaacacgggacgauccugaucaagguggaguacaaaggcgaagacgccccgugcaagaucccuuucagcaccgaggacggacaagguaaagcacacaauggacgccugauuaccgcgaaccccguggugaccaagaaggaggagcccgucaacaucgaagcggagccacccuucggggagucaaacaucgugauuggcaucggcgauaaggcccucaagaucaacugguacaagaaggguuccagcaucgguaagauguucgaggccacggcccggggcgccaggcggauggccauccugggcgauaccgccugggacuucggcuccgugggcgggguccugaacagccucgggaagaugguccaccagaucuucggguccgcuuacaccgccuuauucagcggcgucuccuggaucaugaagaucgggauuggcguacuacucacuuggaucggccugaauagcaaaaauacguccaugagcuuuuccugcaucgugaucgggaucaucacacuguaccucggcgccguaguucaggccgacauggguugcgcaaucaacuggaaaggaaaggaguuaaagugcggcagcgggaucuucgugaccaacgaggugcacacguggacugagcaguacaaguuccaagcagacagccccaaacgccuugcuacggccauagccggagccugggaaaauggggucugcggcauccguagcacgaccagaauggagaaccuccuguggaagcagaucgcgaacgaacugaacuauauccucugggagaacaacaucaagcugacugugguggucggcgacauuaucggcgugcucgagcagggcaagcgcacccucaccccgcagccgauggaguugaaguacuccuggaagaccugggggaaggccaagaucgugacggccgaaacccagaacagcuccuucaucaucgacgggcccaacacccccgagugccccagcgccucgcgggcguggaacgucugggaaguagaggacuacggguuuggcguguucaccacgaacaucugguuaaagcuccgcgaagucuacacccaguccugcgaccaccgguuaaugucugccgcgaucaaggacgaacgcgcugugcacgccgacaugggcuacuggaucgagucccagaagaacgggagcuggaagcuggagaaggcuuccuucauugaggugaaaaccugcaccuggcccaagagccacacccucugguccaacggcguccuggaaucggacaugaucaucccaaaaucgcuugccggucccaucagccagcauaaccaccggccuggcuaccacacgcagaccgccgggccauggcaucugggcaagcuggagcuggacuucaacuacugcgaaggcaccaccguggugaucacggagaacugcgggacccguggccccucccuccggaccaccacugucucugguaagcugauccacgaauggugcugucgcuccugcacacugcccccgcuccgguacaugggcgaggacgggugcugguacggcauggagauucgccccaucaacgagaaggaggagaauauggucaaaagccugguauccgccgggagcggcaaggucgacaacuucaccaugggcguguuaugcuuggcuauccuuuucgaagaggugaugcgcgggaaguucggcaagaagcauaugaucgccgggguacucuucaccuucguacuccuuuuguccggccaaaucaccuggcgcgauauggcccacacucucaucaugaucggcuccaacgccagcgaccggauggggaugggagugaccuaccuggcgcugaucgccaccuuuaagauccaacccuucuuagcgcugggguuuuuccugcgcaagcucacgagccgggagaaccugcuguugggcgucggccuggcgauggcgaccacccugcagcuccccgaagacauugagcagauggcgaacgggaucgcgcugggccuuaugacccuuaaacugaucacgcaguucgagaccuaccagcuguggaccgcccucguuucacucacgugcucaaauacuauauucacccugaccguggccuggcgaacggccacgcucauacuggcuggggucagccugcucccgcugugccaguccuccuccaugcggaagaccgacuggcugcccaugaccguggcggccaugggcguaccgccccugccgcuguuuaucuucagccuuaaggacacgcccaagcgccgcuccuggccccucaacgaggggguaauggccgugggccugguuagcauccuugcaucuagccuccugagaaaugacgugcccauggccggcccgcugguggcaggcgggcuccugaucgccugcuacgucaucacgggaaccuccgcagaccugaccguggagaaagcagccgacgugaccugggaggaggaagcggaacaaacgggggucagccauaaccucaugaucaccguggaugacgacggaaccaugcguaucaaggacgacgagaccgaaaacauucugaccguacugcucaagacagcccuccugauugucuccggcaucuucccuuauagcaucccggccacccuccuuguguggcacaccuggcaaaaacagacucagcgguccggcgugcuaugggacguaccuucgccgcccgagacgcaaaaagccgagcucgaggagggaguguaccgcaucaagcaacagggcaucuuuggaaagacccagguaggcgugggggugcagaaggaaggcguauuccacaccauguggcacgucacccgaggcgccgugcuaacgcacaaugggaagcgccuggagccuaacugggcguccgugaaaaaggaucucauauccuacggcggcggcuggcggcuguccgcccaguggcagaagggggaggagguccaggugaucgccguggagccuggcaagaaccccaagaacuuccagaccaugcccgggauauuccagacaaccacgggggagaucggcgccaucgcgcuggauuucaagcccgggacaagugggagcccuauaauaaaucgcgagggcaaggucgugggguuguacggcaacggggucgucaccaagaacgguggguauguguccgguaucgcgcagaccaacgccgagcccgacggcccgacacccgaauuagaggaggaaauguucaagaagcgcaaucugaccaucauggaucugcacccggggagcggcaagacccgcaaguaccuccccgccaucgugagagaggcaauaaagcgucggcugcgcacccugauccuugcgccuacgcgggucguggcggcagagauggaggaggcccugaaggggcuccccauccgcuaccagaccaccgccaccaaguccgagcacacgggccgggagaucguggaccucaugugccaugcgaccuuuaccaugcggcugcugagcccgguucgggugccuaacuacaaccucaucaucauggacgaggcccacuucaccgaccccgccuccaucgccgccagaggauacaucaguacgcgggugggcaugggcgaggcggccgccaucuucaugacggccaccccgcccgggaccgcagaggccuucccccaauccaacgcaccaauccaggacgaggagcgcgauauucccgagcgcagcuggaacuccggaaaugaguggauaacugacuucgucgggaagaccgugugguucgugcccuccaucaaggccggcaacgacaucgcuaacugccugcggaagaacgggaaaaagguuauccagcugucccgcaagaccuucgacacggaguaccagaagacgaggcuaaacgacugggacuucguggugaccaccgacaucagcgagaugggcgccaacuucaaggcugaccgggucaucgacccccggcgcugccugaagccggugauucugaccgacggacccgagcggguuauucucgccgggccgaugcccgugacggcagccucugcggcacaacgccggggacgcguugggcgcaacccccaaaaagagaacgaccaauacaucuucaccggccagccccugaacaacgacgaggaccacgcccacuggaccgaggccaagaugcugcucgacaacauaaauacacccgaggggaucauucccgcgcuguucgagcccgagcgcgaaaagucggcggcgaucgacggcgaauaccggcugaagggcgagucccgcaagaccuucguggaacucaugcggcgcggggaccugccggucuggcuggcgcacaagguggccagcgagggcaucaaauacacggaucggaaauggugcuucgauggggagcgcaacaaccagauccucgaagagaacauggacgucgagaucuggaccaaggagggcgagcgaaagaaacugcgcccgcgcuggcuggacgcgcgcaccuauucugacccccucgcccugaaagaguuuaaagauuucgcggccggccgcaaaagcaucgcccuggaccucgugaccgagaucgggcgggugcccucgcacuuggcgcaucgcacgcggaacgcccuagauaaccucgucaugcugcacaccagcgagcacggcgggcgagccuaccggcacgccguggaggagcugccggagaccauggagacgcuccugcugcucggccugaugaucuugcucaccgggggcgcaaugcuguuccugaucagcggcaaggggaucggcaagacauccaucggguuaaucugugucaucgugagcuccggcaugcuauggauggcggacgugccccugcaguggaucgccagcgccaucgugcucgaguucuucaugaugguacucuugaucccugagcccgagaagcagcgcaccccgcaggacaaccagcuagccuacguggugauugggauccucacccuggcggcgauuguugccgcuaacgagaugggcuugcucgagacgaccaaacgagaccuaggcauguccaaagaacccggaguggugucgccaaccuccuaccucgacgucgaccugcaccccgccagcgcguggaccuuguaugcggucgccacuaccgugaucacuccgauguuacgccacaccauugagaacuccacggccaacgucagccuggccgcgaucgcuaaccaggccguggugcugaugggccucgacaagggguggcccaucucuaagauggacuuaggcgucccgcugcucgccuuggggugcuacagccaggugaacccgcuaacccucacugcugcggugcuuuuacucgugacccacuaugcuauaauagggccgggcuugcaagcaaaggcgacccgggaggcccagaagcgcaccgcggccgggaucaugaagaaccccaccguggauggcauuaugacuaucgaccuggaccccgugaucuacgacuccaaguucgagaagcagcucgggcaggucaugcugcuggugcucugcgcggugcaacuucuucucaugcggacgagcugggcccugugcgaggcccugacccucgcaaccggccccaucaccacucugugggagggaucaccggggaaauucuggaacaccaccaucgcgguaagcauggccaacaucuuccgcgguuccuaccuagccggagcgggccucgccuucagcaucaugaaguccguagggaccggccggcgcggcacggggagccaaggagagacccugggagagaaguggaagaagaagcugaaucaguugagccggaaggaguucgaccuguacaagaagaguggaauuaccgagguggaucgcaccgaggccaaggaggggcugaaaaggggcgagaccacgcaccacgccgucagccgcggcuccgccaaguuacaaugguucguggagcggaacauggugacgcccgaggggcgggucaucgaccugggcugcgggcgcggcggcuggagcuacuacugcgcgggacugaagaaggugaccgaggugcggggcuauaccaagggcggccccgggcacgaggagcccgucccaauguccacguacggcuggaacaucgugaaacucaugagugggaaggacguguucuaccugccgcccgagaagugcgacacucuucugugcgacaucggcgagucuagccccuccccgaccgucgaagaaucgcgcaccauccgggugcucaagaugguggagcccuggcuaaagaacaaccaguucuguauaaagguccugaaccccuacaugcccacggugaucgagcaccucgagcguuugcagcggaaguacggagggauguuagugcggaacccgcucucucgaaacagcacgcacgagauguacuggaucucaaacggcacaggcaauaucgucagcuccgugaacauggugagcaggcugcugcucaaccgauucaccaugacacaccgccgcccaaccaucgagaaggacgucgaccugggcgccggcacucgccacgugaacgcggagcccgagaccccgaacauggauguaaucggggagagaaucaagcgcauuaaagaggagcauuccagcacguggcacuacgacgacgagaacccguacaagaccugggcuuaccacgggagcuacgaaguaaaggccacaggcagcgcgucauccaugaucaauggcgugguuaagcugcucaccaagccuugggacguagugcccauggucacgcagauggccaugaccgacaccaccccguucgggcagcagcguguguuuaaggagaaggucgacacgcgcacgccccggcccaugcccgguacccguaagguaauggagaucaccgcagaauggcuuuggcgaacguuaggccgcaauaagaagccccgucuaugcacccgugaggaguucaccaaaaagguccgcaccaacgccgccaugggggcaguguucacggaggagaaccagugggacagcgcucgggcugcuguugaggacgaggaguucuggaagcugguggaccgcgagagggagcugcacaagcucgggaagugcggguccugcgucuacaacaugauggggaagagagagaagaagcugggggaguucggcaaggcgaagggcagccgugccaucugguacauguggcuaggagcccgauaccucgaguucgaggcccugggcuuccuaaaugaggaccacugguucagccgggagaacagcuauucuggugucgagggcgaggggcuccacaaacuuggcuauauccuccgggacauaagcaagauuccgggcggcgcaauguacgcggacgacaccgccggcugggacacccggaucaccgaggacgaccuccacaacgaggagaagaucacgcagcagauggaccccgaacaucgccaacuggcuaaugccaucuuuaagcugaccuaccagaacaagguggugaaagugcagcggcccaccccgaaggggaccgugauggauauuauauccagaaaggaccagcgugggagcgggcaaguggggaccuacggccugaauaccuucaccaauauggaggcccagcugguccgccagauggagggggagggaguacugucuaaggcggacuuggagaacccccaccuccuggagaagaagaucacccaguggcucgagacuaaggggguggagcggcugaagcgcauggccaucuccggcgacgacugugucgugaagcccaucgacgaccgguucgccaacgcccugcucgcccugaacgacaugggcaagguccgcaaggacaucccgcaguggcagccguccaagggguggcacgacuggcaacagguccccuucugcagccaccauuuucacgagcuuaucaugaaagacggccggaaacucgucgugccuugccggccccaggacgaguugaucgggagggcgcggaucucccagggcgccggguggagccugaaggagacagccugcuugggcaaggccuacgcgcagauguggucccugauguauuuccaccgccgggaucuucgccucgcguccaacgcgaucugcuccgccguccccgugcacuggauccccaccagcaggaccaccuggagcauccaugcccaccaccaguggaugacgacugaggacaugcugaccguguggaaccgcgucuggaucgaagacaacccuuggauggaggacaagacccccgugacgaccugggaggacaucccguacuuaggcaagcgggaagaccaguggugcgggucgcucaucggacuuaccucccgcgcgaccugggcccagaacauacugacggcuauccagcagguacggucccugaucggggacgaggaguuccuggacuacaugcccuccaugaagcgcuuuaggaaagaggaggaguccgagggugccaucugguga

SEQ ID NO: 26138 - RNA, 9873 nt, Artificial Sequence
  derived and/or modified CDS sequence (opt11) from DENV-3__JQ045691__SS-prME
accagccucugucugaugaugaugcuacccgcaacccuggcguuccacuuaacgucgcgagacggagaaccgcggaugaucguaggcaaaaacgaacgugggaaaagccuccuuuuuaaaaccgcgagcggaauuaauaugugcacgcugaucgccauggaccugggagagaugugcgaugauacagugaccuacaaauguccacucauagcagaaguggagccagaggacauugacugcuggugcaaccugacaucaacaugggucacauacgguacgugcaaucaagcaggcgagcacaggagagauaaaagaucuguagcgcuagcuccacauauaggcauggggcucgacacccgcacgcaaacauggaugucggcagaaggagccuggagacaaguagaaaagguggaaaccugggcccuuagacaccccggcuucacaauccucgcgcuauuccuagcucauuauauagggaccucacugacccaaaaaguaguaauuuucauccuccuaaugcucgucaccccgucgaugacaaugcgcugcguuggcgugggaaaccgagauuucgucgaggggcuauccggagcuaccuggguggacguaguccuagaacacggaggcugcgugacaacgauggccaaaaauaaaccgacccuagacauagaguuacagaaaacagaagcgacgcaauuggcaacguuaagaaagcugugcauagaggguaaaaucacuaacaucacgacugacagccgaugucccacacaaggagaggcaauccugcccgaggaacaagaucaaaacuacguaugcaagcacacguacguagaccggggauggggaaacggauguggacuguucggaaaagguucccuggugaccugcgccaaguuccaauguuuagagcccauagaggguaaagucguacaguacgaaaaccuaaaguacacggucaucaucaccguucauacaggggaucaacaccaggucggcaacgacacacagggagucacgguagaaaucacaccgcaagccagcacaguagaagcaauacuacccgaauacgggacgcuaggacuggagugcucaccaaggacaggacuagacuucaacgaaaugauccuucuaacgaugaagaacaaagccuggaugguccaccgacagugguucuucgaccuaccccuaccguggaccagcggagcaacaacagaaaccccgaccuggaaccggaaggaacuccuaguaaccuucaaaaacgcgcaugccaagaaacaggagguaguaguccuaggaagccaggagggagcgaugcacacugcguuaacuggggcaacugagauacaaauaucgggugggacaucgauauucgcaggacauuugaaaugcaggcucaaaauggauaaacucgagcugaaaggaaugagcuacgccaugugccuaaauacguucguacucaagaaggagguaucggaaacacaacauggcacaauacuaaucaagguagaguacaaaggcgaagaugcgccgugcaaaauacccuucagcacugaagauggccaaggaaaagcccacaacggccgacugaucacggcaaaccccgucguaaccaagaaagaggagcccgucaauauugaagcagagccgcccuuuggggagucgaauaucgucaucgggauaggggacaaagcccucaaaauaaacugguacaagaaaggaucaucgaucggaaaaauguuugaggcgacagccagaggggcaagacgcauggcaauccucggugacacagcaugggacuuuggaucagugggcgggguccuuaauucccuagggaaaaugguccaccagaucuuugguucugcauacacagccuuguucucuggagucucauggauaaugaaaauagggauagggguacuucugacguggauaggacuaaacucgaagaacacauccaugagcuucuccuguaucgugauugggauaauuacucuauaccucggggcagugguucaggcugacauggggugcgcaauuaacuggaagggcaaagaauuaaaauguggcagcgggaucuucguuacaaacgaaguacacacguggacagagcaauacaaguuccaggcggacagccccaagcgauuagcaaccgccauagcaggcgcaugggaaaauggagugugcggaaucaggaguaccacccgcauggagaaccucuuauggaagcagauagccaacgagcuaaacuacauacuaugggagaacaacaucaaauuaaccgucguugucggcgacaucauagggguacuagagcagggcaagagaacgcugaccccgcaaccaauggagcugaaguauaguuggaaaacauggggcaaagccaagaucgugaccgccgaaacucagaacucuucauuuauaaucgauggucccaacacuccagaauguccaagcgccagccgggcauggaauguaugggaggucgaggauuauggguuuggcgucuucaccacgaacaucugguugaaacugcgagagguauauacacaaaguugcgaucauagguugaugagcgcagcgaucaaagaugaacgagccgugcacgccgacaugggauacuggauagagagucagaaaaacggcuccuggaaauuagaaaaagcgaguuucauagagguaaagacuugcacauggccgaaaucgcacacccuauggagcaacggagugcuugaaagcgacaugauaaucccgaaaucguuagcagggcccaucucacaacacaaccaccgcccuggauaccacacccagaccgccggaccguggcaccucggcaagcuagaacuggacuucaauuauugcgagggaacuacgguaguaauaacagaaaacugcgguaccagagggccaucacucagaaccacaacgguaagcggaaaacuaauccaugaguggugcugucgaagcugcacacucccgccucugagauacaugggugaggauggauguugguaugguauggagauacggccgauuaacgaaaaagaagagaacauggugaaaagccuagucucggcaggaucgggaaagguagacaacuuuacgaugggaguacuaugccuggcaauccuguucgaagaaguaaugagagguaaauucggcaagaaacacaugauugcuggcguacuauucacguuuguguugcuauuaaguggccagauaacauggcgagacauggcucacacgcuaaucaugaucggcucgaaugccuccgaccgaaugggaaugggagugacguaccuggcacucaucgcgacauucaaaauacagccguuccuggcgcugggcuucuuucugcgaaaauugacaagcagagagaaccugcuguuggguguaggacucgcuauggcaaccacccuacagcuccccgaagacauugaacagauggcuaacgggauugcgcuaggccugaugacccucaaacuaauaacacaauucgaaacauaccagcuguggaccgcacuggugucacuaacuuguaguaacacgauauucacgcucacggucgcauggaggaccgccacguuaauauuagcagggguuagccuccuaccguuaugccaaaguucuuccaugcgcaaaaccgacuggcucccgaugacgguagcggcaaugggagugccgccacucccacuguucauauucucccuaaaagauacccccaaaaagagaucuuggccauuaaacgaggguguaauggcugucggguuaguuucuauauuagcaucaucccuacuaaggaacgacguacccauggcagggccgcuaguugcaggagggcugcuaauagcaugcuacgucauaaccgggaccucagcggaccuuaccguagagaaagccgcggacgugacgugggaagaggaagcggagcaaaccgguguuucgcauaauuuaaugaucacgguugacgacgacggaaccaugcgaauuaaagacgacgaaacagaaaacauacucaccguacuccuaaaaaccgcucuauuaauagugaguggcaucuuucccuacaguauaccagcuacccuccugguauggcacacguggcagaaacaaacacaaaggucaggugucuuaugggacgugccguccccacccgaaacccaaaaggcggaacucgaagagggaguguaccguaucaagcagcagggcauuuucggcaagacacaggugggcguugggguucagaaagaaggcguauuccacacaauguggcauguaacacgaggggcaguccucacucacaauggaaaacgccuagagccaaacugggcgagcgugaagaaagaccuaaucaguuacgggggcggcuggcgucucagcgcgcaauggcaaaagggagaagagguacaaguaauagcggucgaaccaggcaaaaaucccaagaacuuccaaaccaugccagggaucuuccagacgacaaccggagaaauuggagcuauagcccuagacuucaaaccaggcacguccggaagcccaaucauaaacagagaaggcaaagugguggggcuguaugguaacggcgucguaaccaaaaacggaggguacguaagcggcaucgcccagaccaacgcagaaccagacggcccaaccccggaauuggaggaagaaauguucaagaaaagaaaccuuacgauaauggaccuacacccaggaagcggaaagacgcggaaguaccucccagccaucguaagagaagcgauaaagcgucgccucagaacccuaauacucgcgcccacacgugucguagcggcggagauggaagaagcauuaaaaggacuuccaauaagauaccaaacaacagcaacuaagagcgagcacaccggcagagagauugucgauuuaaugugccacgccacauucacaaugcgacuacugucaccggucagagucccaaauuacaaccugauaauaauggacgaggcgcacuucacagacccggccuccaucgcagcaaggggauacaucagcacacgcgucgggaugggcgaagccgcagcaaucuucaugaccgcgacgccaccgggcacggcagaggcauucccucaaucuaacgcuccgauacaggacgaagaacgggacauaccagagcggucauggaacagcggaaacgaauggauuaccgacuuugucggcaaaacaguaugguucguacccaguaucaaggcgggcaaugauauagcuaacugucuucggaagaacggcaagaaaguaauucaacuaagccgcaaaacguucgacaccgaauaucagaaaaccaggcugaaugauugggacuucguagucaccaccgauaucucggagaugggggcaaauuucaaagccgaucgcguuaucgacccgcggagaugccucaaaccgguaauauuaaccgacggucccgaaagagugauacuggcagggccaaugccaguuaccgcagcgagcgccgcgcaaaggcgggggcgaguuggacggaacccacagaaagaaaacgaucaauacaucuuuacgggccaaccacugaacaacgacgaggaccacgcccacuggaccgaggcaaaaaugcuucuagacaacaucaacaccccggaagggauaaucccggcacucuucgaaccggaacgcgaaaaauccgcggcaauugauggagaguaucgccuuaagggcgagucgagaaaaacauucguagagcuuaugcgucgcggagaccugccgguauggcuagcccauaagguagcuucugaaggaauaaaauauacugaccgaaaguggugcuucgacggagaacgcaauaaccaaauacuggaagaaaauauggauguagagauauggacuaaggagggcgagaggaagaaacugcggccucgguggcucgacgcacgaacguacagcgauccccuggcacuaaaggaguucaaagacuucgcagccgggagaaagagcauagcgcuagaccuagucaccgaaaucgguagaguaccaucacauuuggcacacaggacacgaaacgcacuagacaacuugguaaugcuacauacgucagaacacggaggccgcgcuuacagacaugcuguagaagaacuccccgaaacgauggagacucuucuacuccucggccucaugauacuacucacaggaggagccauguuauuccuuuugaguggcaaaggaaucggcaagacaaguaucggacucaucugcgucauaguuucauccgggauguuauggauggcagacguaccacuacaauggauagcuucagcaauugugcuugaguucuucaugauggucuuacuaaucccagagccagaaaagcaaagaacgccacaggauaaucaacuggcuuacguggucauuggcauccucacccuugcagcaauagucgcugcuaacgaaaugggccuacuagagaccaccaaaagggaccuggggaugucuaaggagcccggaguagugucacccacgaguuaccuagacguggaucuacaccccgcaagcgcguggacguuguaugcaguggcaacaacggucaucaccccgaugcuccgucauaccaucgaaaauagcacagcgaacgugagccuugccgcgauagccaaccaggcagucguguuaaugggucucgacaaaggguggccaaucucgaagauggacuugggcgucccucuccuggcccuaggauguuacucccaggucaauccacuuacccuaacggccgccgugcugcuucuggucacccacuacgcgauaaucgggccugggcuacaagcgaaagcaacacgagaagcgcaaaaacggaccgccgcgggaaucaugaaaaaccccaccguagacggcauuaugacaaucgaccuugacccaguuauuuacgauucaaaguucgaaaaacaauuggggcagguaauguuauugguucucugcgccguccaguuacugcucaugcgcaccagcugggcacucugugaggcccucacgcuagccacagguccaauuacgacguugugggaaggcagccccgggaaauuuuggaacacuaccaucgcuguauccauggccaauaucuucagaggaagcuaccucgcuggagccggacuugcguuuucgauaaugaagagugucggcacaggacgucgcgggacggggagccagggagaaacccucggggaaaaguggaagaagaaacuuaaccaacuuuccaggaaggaguucgaccuauacaagaaaagugggauaaccgaggucgacaggacagaagccaaggagggacugaaacggggagaaacaacgcaccacgcaguaucgcgcggcuccgcgaaauugcaaugguucgucgagaggaacauggugaucccugaaggcagggugaucgaccucggcugcggccgggguggcuggucguacuacugcgccggucugaagaaaguaacggaaguccguggauacacaaaagggggccccggucacgaggagccgguacccaugucaaccuacggauggaaccuggugaaauuaaugagcggaaaggauguauuuuaccuuccgcccgaaaagugcgacacguugcucugcgacaucggugaaagcagcccaucgagcacaguggaggagucgagaaccauccgcguguuaaagaugguggagccauggcuuaaaaacaaccaauucugcaucaaaguauugaauccuuacaugcccaccguaauugaacaccuagaaaggcuccaaaggaaauacggaggcaugcucguaagaaacccgcucucgcguaacuccacucacgaaauguauuggauaucgaacggcaccgguaacauugucaguucggucaacauggugucacgcuuacuacucaauagguucaccaugacgcacagaagaccaacuauagaaaaagacguagaucuaggggcgggcacccgccaugucaacgcagaaccagagacgccgaacauggacguaaucggagagagaaucaagagaaucaaggaggagcacagcuccacauggcacuaugacgacgaaaaccccuacaaaacgugggcguaucacgggagcuacgagguuaaagcuacgggcagcgcaagcagcaugauaaaugggguugugaaacuucucacaaaaccaugggacgucguucccauggugacccagauggcaaugacugacacaacacccuucggccaacaaaggguguucaaggagaaaguagacacaagaacaccccgugcuaugccgggcacucgcaaaguuauggagaucaccgcugaaugguuauggcgcacccucgggcguaacaagaaaccaagacucugcacaagagaagaguuuacgaagaaagugcgcacaaacgccgcuaugggagcgguuuucacugaagaaaaucaaugggacucagccagagcggcagucgaagacgaagaguuuuggaagcucgucgacagggaaagggagcuccacaaacucggaaaaugcggcagcugcgucuacaauaugaugggaaaacgagagaagaaauugggggaguucggcaaggcgaaggggucacgagcaaucugguacauguggcuaggggcucgcuaccuggaguucgaggccuuaggauuccugaacgaagaccauugguucucccgggagaacagcuacucaggaguagaaggggaaggcuuacacaaauugggauacauccugagagacaucuccaagauacccggaggagcgauguacgcugacgacaccgcgggcugggauacgcgcauuaccgaagacgaccuucacaacgaagagaagauaacccaacaaauggacccagagcaucggcaacuagcgaacgcgaucuucaagcugacauaccaaaacaaagucgucaaaguacagagacccacucccaaaggaacugucauggauauaaucucaaggaaagaccaaagagggucagggcaaguagggaccuacggucuaaacaccuucacaaacauggaagcccagcucgugcgccaaauggaaggagagggaguccuaucuaaggcagaccuugaaaacucccaccuacucgagaagaaaauaacucaguggcuggaaacaaagggaguugaacgccuaaaacguauggcgauaagcggggacgacugugucgucaagccaauagacgacagauuugcgaaugcgcuacuggcauuaaacgacaugggcaagguacgcaaagauaucccucaauggcagcccucaaagggguggcacgacuggcaacaagucccuuuuugcucccaccacuuccacgaacucauaaugaaggacggcagaaaacucgucguaccgugccgaccccaggacgaacucauaggacgggccaggaucucccagggagcaggauggagccuuaaggagacagcgugccugggaaaagcauaugcccagauguggagccucauguacuuucacaggcgugaccuuagauuggcauccaacgccauuugcagcgcuguaccgguccauuggaucccuacgagcagaaccaccuggucgauacacgcccaccaccaauggaugacgacagaagauaugcugaccguauggaaucguguguggaucgaagacaauccguggauggaagacaagaccccaguaacgacgugggaagacguacccuaucuaggcaagcgugaagaccaguggugcggcagccucauagggcugaccagcagagcaacgugggcgcagaauauccuaacagcaauacaacaggugaggucacuaauaggugacgaagaguuccuggacuauaugcccucgaugaaacgauuccggaaggaagaagaaucggaaggcgcaaucugguag

SEQ ID NO: 26139 - RNA, 9873 nt, Artificial Sequence
  derived and/or modified CDS sequence (opt11) from DENV-3__JQ045692__SS-prME
accagccugugcuuaaugaugaugcuucccgccacacuggcuuuccaccucacuagucgcgacggcgagccgcggaugaucgugggcaagaacgagcgcggcaagagccuguuauuuaagaccgcgagcgggauaaacaugugcacccucaucgcgauggaccugggggagaugugcgaugacaccgugacguacaaguguccauuaaucgccgaggucgagcccgaggacaucgacugcugguguaaucuuacuagcacaugggugacauacgguaccugcaaccaggcgggugaacaccggagagacaagcggagcgucgcccuggcgccucacguaggcaugggguuggauacccgcacccagaccuggaugagcgcugagggcgccuggcggcagguagaaaaagucgagaccugggcccuccgccacccgggauucaccauucuggcgcuguuccucgcccauuacaucggcaccucccugacacagaaaguggugaucuucauucugcucaugcucgucacgcccucaaugaccaugcggugugugggggucggcaacagagacuucguagagggacugucuggggcaacuuggguggacguggugcucgagcacggcggcugcgugacgacgauggccaagaacaagcccacccuggacaucgagcugcaaaagaccgaggcuacacagcuagcgacgcugcgcaagcugugcaucgaggguaagaucaccaauaucaccaccgacucuaggugccccacucagggcgaggccauccucccggaggagcaggaccagaacuacgugugcaagcacaccuacguggaccgagggugggggaacgggugcggccuguuugggaagggcucccuggucacgugcgccaaguuccaaugccucgagcccauagagggcaaagugguccaauaugagaaccugaaguauaccgugaucaucacggugcacaccggagaucagcaucaagucgggaacgacacccagggggugacagucgagaucacgccccaggcgaguacggucgaggccauccugccagaguauggcacacucgggcucgagugcuccccccgcaccggccuggacuucaacgaaaugauccuccugacaaugaagaauaaagcguggauggugcaucggcagugguuuuucgaccucccgcuccccuggacuagcggcgccaccaccgaaacccccacguggaaccgcaaggagcuucuggucaccuuuaagaacgcccacgccaagaagcaagaggugguggucuuggggagucaggagggugcgaugcacaccgcauugaccggagccacggagauccaaaucucgggcggcaccuccaucuuugccggccaucugaagugccggcucaagauggacaagcuggagcugaagggcauguccuacgccaugugccucaacacuuucgugcugaaaaaggaggucuccgagacccagcacgggacuauccugaucaagguggaguacaagggcgaggacgccccguguaaaauccccuucucuaccgaggaugggcagggcaaagcccacaaugggcggcugaucacggcgaauccgguggugacuaagaaagaggagccugucaacaucgaagccgaaccgcccuucggggagucaaauauagugauaggcaucggggacaaagcccucaagaucaacugguauaagaaggguuccagcaucgggaaaauguucgaggcgacggcgcggggcgcaaggcggauggcaaucuuaggggacaccgccugggacuucgguucagugggcggaguccugaacagccucggcaagaugguucaccaaaucuuuggguccgcuuacaccgcucuguucaguggaguguccuggaucaugaagauaggaaucgggguucugcugaccuggaucggccugaacuccaagaacaccuccaugagcuuuucaugcaucgugauaggaauuauaacacuguaccuaggcgccgugguccaggccgacauggggugcgccauaaacuggaagggcaaagagcugaaaugcggaagcgggauauucgugaccaacgaaguucauacguggacugagcaguauaaguuucaagccgacucaccgaaacgccuggccaccgccaucgccggcgccugggagaacggugugugcggcauucggucaaccacucggauggagaaccuccuguggaagcaaaucgcgaacgaguuaaauuacauacucugggagaauaacauaaaguugacagugguggugggggacaucaucggcgugcuggagcagggcaaacggacgcugacgccccagccgauggagcugaaguacuccuggaagaccuggggcaaggccaagaucgugacggcggagacacagaauagcucauucauaaucgauggacccaacacccccgagugccccagcgccuccagggcauggaacguaugggaaguagaggauuacggguucggcguguucacaacgaacaucuggcugaaauuacgcgaggucuacacacagucaugcgaccaccggcugaugagcgccgccaucaaggacgagcgcgccgugcacgcagacaugggcuacuggaucgagucccagaagaaugggagcuggaaacuggagaaggcgucguuuauagaggugaagaccugcaccuggccgaaaagccacacccucugguccaacggcguucuagaguccgacaugaucauucccaagucccuggcgggucccauaagccagcacaaccaucggccgggcuaccacacucagacagccgggcccuggcaccucggcaaacuggagcuggacuucaauuacugcgaaggcacgacuguuguaauuacagagaauugcgggacgcgcggcccuucgcucagaacaaccacggucucagggaagcugauccacgaguggugcugccgcuccugcacccucccgccgcuccgguacaugggcgaggacggaugcugguacggcauggagaucaggccuauuaacgagaaggaggagaacaugguuaagagccuaguguccgccggcagcgggaagguggauaacuucaccaugggcguccugugccucgccauccuguuugaggaggugaugcgaggcaaguucggcaagaaacacaugaucgcuggggugcuguucaccuucgugcuccugcuguccggucagaucacguggcgcgacauggcucacacucucaucaugauaggcagcaacgccuccgaccggauggggaugggcgugacauaccuggcccugaucgcaacguuuaagauacagccguucuuagcguuaggguucuucuuacguaagcucacgagccgggagaaccugcugcucggcguaggcuuggccauggcaacuacgcugcagcucccagaggacauugagcagauggcuaacgggaucgcgcuuggccugaugaccuuaaaacugaucacgcaguucgagacauaccaacucuggaccgccuuggucucacugacauguuccaauacgaucuucacucucacgguggcguggcgcacugcuacgcucauccuggcagggguaagccugcuaccgcugugucaauccagcuccaugcggaagaccgacuggcugcccaugacuguggcggccaugggcgugccgccccucccccucuuuaucuucagccucaaagacacaccgaaaaggcgcuccuggccccucaacgaggggguuauggccgugggacuggugagcauccuggccucaagccuacugaggaaugacgugccuauggccggcccacuuguugcggguggguuacucaucgccuguuacgucauuacggggacguccgccgaccugacaguagagaaggccgccgaugugaccugggaggaggaggccgagcagacgggggucucccacaaccucaugaucaccgucgacgacgacgggacaaugcggaucaaggacgacgagaccgaaaacauacucacaguguuacucaagacggcccuucugauagucuccggcaucuucccuuacagcauccccgcuacucuccugguauggcacaccuggcagaagcagacccaacgaagcgggguccuuugggacguccccucuccgcccgaggcucagaaagcggaacucgaagaggggguguaccgcaucaagcagcagggcauauucggaaagacccaaguaggaguggggguucaaaaggagggcgucuuccacacgauguggcacgucaccaggggugcggugcugacccauaacgggaagcgccuggagcccaauugggcguccgugaagaaagaccucaucucuuacggugggggcuggcggcuguccgcucaauggcagaagggugaggaaguccagguuaucgccguggagccaggcaagaacccgaagaacuuccaaaccaugcccggcaucuuccagaccaccaccggggagauuggcgcgaucgcgcuggacuucaagcccgggacuagcggaagcccuauaauaaacagagagggaaagguggucgggcuguacggcaauggcgucgucaccaagaacggcggauacguauccggcauagcccagaccaacgcugagccggacggccccacccccgagcucgaggaggaaauguucaagaagcggaaccugaccaucauggaucugcacccggggagcggcaaaacccguaaguaccucccugccaucgugcgggaagcuaucaagcggcgucugcguacccugauucucgccccuacccgggucguggccgccgagauggaggaggcccucaaggggcugcccauacgauaucagacuaccgcgaccaaguccgagcacacaggacgggagaucguggaccuuaugugccacgcaacguucaccaugagacugcugucgccgguacggguucccaauuacaaccuuaucaucauggacgaggcccacuucaccgacccggccuccaucgcagcgagaggauauauuagcaccagaguuggcaugggggaggccgccgcuaucuuuaugacggccacuccgcccgggaccgccgaggccuucccccagucgaacgcucccauccaagaugaggagagagacauccccgaacgaagcuggaacuccggaaacgaguggaucacggacuucguagguaagacggugugguucguuccgucaaucaaagccggcaacgacauagccaacugucugcggaaaaacgggaagaaggucauccaacucucccggaaaacuuucgacaccgaguaucagaagacccgucucaacgacugggauuucgucgugacgaccgacaucagcgagaugggcgcaaacuucaaagccgaccgcgucaucgauccccggcgcugucugaaacccgugauccugaccgacggcccugagcgcgugauccucgccgggccgaugcccgucaccgccgcguccgccgcacagcgccggggccgcguugggcgaaacccccagaaggagaacgaccaauauaucuuuacaggccagccucucaacaacgacgaggaucaugcccacuggacagaggccaaaaugcugcucgacaacaucaacacccccgaagggaucauaccagcgcuguucgagcccgagagagagaaguccgccgcuaucgacggagaguaccggcugaagggugagucacgcaagacuuucguggagcucaugagacgcggggaccugcccgucuggcuggcccacaagguggcaagcgagggaaucaaguacaccgaucggaaguggugcuucgacggggagaggaacaaccagauccucgaggagaacauggaugucgagaucuggaccaaggagggcgagagaaaaaaauugcgcccgcgcuggcuggaugcccggacauacagugauccccucgcccugaaggaguucaaggacuucgccgcuggcaggaagagcaucgcgcuagaccuugugaccgagaucgggcgggugcccucccaccuagcccaccgcacccggaacgcgcucgacaaccucgucaugcugcacacgagcgagcauggcggucgcgccuaccggcaugccguggaagagcugccggagacgauggaaaccuuucucuugcugggccucaugauccuacugaccgggggcgcgaugcuguuccugcugagcggcaaggggaucgguaaaacauccaucgggcucaucugcgucaucguaucguccggcaugcuauggauggcugacgugccucugcaguggauugcaucggccauagugcuugaauucuucaugauggugcuccugauccccgagcccgagaaacagcgcacaccgcaggacaaccagcucgccuacgucgugaucgggauucugacauuggcggccaucgucgcugccaacgagaugggcuugcuggagacgacaaagcgggaccugggcaugagcaaggagcccggcguggugagccccaccuccuaccuggacguggaccugcauccggcgagugcguggacccuauacgccguggccacaacggucaucaccccaaugcuuaggcauacaauagagaacucuaccgcuaacgugagccuggcggccauugccaaccaggcugucguacugaugggacucgauaagggguggcccaucuccaagauggacuuaggcguuccccugcucgcacuugggugcuauagccaggugaacccccugacgcucaccgcggcagugcucuuacucgucacucacuacgcgaucaucggcccgggccuacaggcgaaggcaacucgggaggcccagaagcgcacugccgccgggaucaugaagaaccccaccguggacggaauuaugaccauagaccuggaccccgugaucuacgauuccaaauucgagaaacagcucggucaggugaugcugcucguauugugcgccgugcagcuuuugcucaugagaaccagcugggcacugugcgaggcgcuuacgcucgccacgggccccaucacuacccugugggagggcuccccggggaaguucuggaacacaacgaucgccguaucaauggccaacauauuccguggcuccuaccuggcgggagccggucuugccuuuagcaucaugaaguccguggggacagggcgacgcggcaccgggucgcagggcgagacgcugggagagaaguggaagaagaaacuuaaccagcucagccggaaggaguuugaccuauacaagaaauccggcaucaccgagguggaccgcaccgaggccaaggaggggcugaagcggggcgagacuacccaccacgccgucagccgcggcuccgcgaagcuccagugguucguggagagaaacaugguuauacccgagggcagggucauagaccugggcugcgggaggggcggguggucauacuacugcgccggccucaaaaaggugacggaggugcgaggcuacaccaagggcggucccgggcacgaagagcccgugccgauguccaccuacggcuggaaccuggugaaacugaugucgggcaaggacgucuucuaccugccgccagagaagugcgauaccuuacucugcgacauaggcgaauccagccccucuaguacgguggaggagucccggaccauccgggugcuuaagaugguggagccguggcuuaagaauaaucaguucuguauuaagguccucaacccauauaugccgaccgugaucgaacaccuugagcgccugcagaggaaguacggcgggaugcucguuagaaacccucugagccguaacuccacccacgagauguacuggaucaguaauggaacgggcaacaucguauccagcgugaacauggugagucgccuguugcugaaucgguucacgaugacacaucgccggccgacgaucgagaaggacgucgaccugggcgccgguacgcgccacgugaacgccgagcccgagacccccaacauggacgucauuggcgaacggaucaaacgcauuaaggaagaacacagcuccaccuggcauuacgacgaugagaacccuuacaagacaugggcuuaccacggaagcuacgaagugaaggcgacaggaagugccucuagcaugaucaacggcgucguaaagcuuuuaaccaaacccugggacgugguucccauggucacacagauggcuaugacagacacaacucccuuugggcaacagcggguguuuaaagagaagguggacacacgcaccccgagggcgaugcccggcacgagaaaagucauggagaucaccgccgaguggcuguggcggacgcucggccgcaauaagaagccccgccugugcacacgggaggaguuuacgaagaaagugcgcaccaacgcggccaugggugccgucuuuacggaggagaaccagugggacuccgcccgagcggcuguugaagacgaggaguucuggaaacugguggacagggagcgggaguuacacaaacuaggcaagugugggucgugcguguauaacaugaugggaaagcgcgagaaaaagcugggagaguucgguaaggccaagggaucccgggccaucugguacauguggcucggugcccgcuaccuggaguuugaggcgcuuggcuuucucaacgaggaccacugguucagccgggagaacuccuacuccgggguugagggcgaaggccugcacaagcugggauacauucuccgcgauaucuccaagaucccagguggugccauguacgcagacgauaccgccggcugggacacgcgcaucaccgaggacgaccugcacaacgaggaaaagaucacccagcagauggacccggagcaccgccagcuggccaacgcuaucuucaagcucaccuaucaaaacaagguggugaagguccagcggcccacgcccaaggggaccgugauggacauuauaagccggaaggaccaacggggcuccggucaggugggcaccuacgggcugaacaccuucacgaacauggaggcccaguuagugcgccagauggagggugagggcgugcugagcaaggccgaccuggagaacccccaccuccucgaaaagaaaauaacgcaauggcuggagaccaagggcguugagcggcucaagcgcauggccaucucaggggacgacugcgucgugaagccgauagaugaccgguucgccaacgcgcuccuggcccuuaacgacaugggcaaggugcgcaaggacauaccucaguggcagccaucaaagggguggcacgacuggcagcagguccccuucugcucgcaccacuuccaugaacucaucaugaaggauggccggaagcugguggugccgugccgcccgcaggacgagcugaucgggagggcgcguaucagccagggcgcuggcugguccuugaaagagacagccugccuaggcaaggcguacgcgcagauguggagccugauguacuuccaccgccgggaccuccggcuggccuccaacgcaauaugcagcgcgguccccgugcacuggauccccacuagccgaacgacguggucuauacacgcccaccaucaauggaugaccaccgaggacaugcugacuguauggaaucgcgucuggaucgaggauaacccguggauggaggacaagacccccguaaccacgugggaggacguaccuuaccucggcaagcgggaagaccaguggugcggcagccuaaucggccugaccucccgugccaccugggcccagaacaucuuaaccgccauccagcagguccguagccugaucggggacgaggaguuccuggacuacaugccuuccaugaagcgcuuccgcaaggaggaagaaagugaaggcgcgaucugguga

SEQ ID NO: 26140 - RNA, 9873 nt, Artificial Sequence
  derived and/or modified CDS sequence (opt11) from DENV-3__JQ045694__SS-prME
accagccuuugccucaugaugaugcugcccgcaacccuggccuuucaucucaccagccgugacggugaaccgcggaugaucguggguaagaacgaaaggggcaagucccuucuguucaagaccgccucuggaauaaacaugugcacccugaucgccauggaucucggcgagaugugugacgacaccgugacguauaaaugcccacugauagccgagguggagccugaagauaucgacugcugguguaaccugacgagcaccuggguaaccuaugggacgugcaaccaggccggcgagcaccggcgcgacaagcgauccguggccuuggcaccccauguggggauggggcuggacacccgcacccaaaccuggaugagcgcggagggcgcuuggcgccagguggaaaagguggaaacuugggcgcugcgccacccagguuucaccauucuagcacuguuccuugcccacuauaucggcacgagcuuaacccaaaagguagugaucuucauuuuacucaugcuagucacgcccucaaugacaaugagaugcgugggagugggcaacagggacuucgucgaaggccucuccggggcgaccuggguggacgugguccuggagcacgggggaugugugaccacaauggccaagaauaaacccacccuggacaucgaacugcagaagaccgaggccacccaguuagcuacgcugcgcaaauuauguauugagggcaagaucaccaauaucaccaccgacucucggugccccacgcaaggcgaagccauuuugccggaggagcaggaccaaaacuacgugugcaagcauacauaugucgacagaggguggggcaacggguguggccuauuugguaagggaucucuaguaaccugugcgaaauuccagugucuugagcccauugagggaaaagugguccaauacgaaaaccugaaauacaccgugaucaucacuguucacaccggcgaucaacaccagguaggaaacgauacacagggugugaccguggagauaacgccacaggccucgacuguagaggcugugcugccugaauacggaaccuuaggacuggagugcucaccccgcacuggccuggacuuuaaugaaaugauccugcucacaaugaagaacaaggccuggaugguccaccggcaaugguuuuucgaucuuccccucccguggaccucaggcgccacgacggagaccccuaccuggaaucggaaggaauugcuggucacguucaaaaacgcacacgccaagaagcaggaggucguagugcucgggucccaggagggcgcaaugcauacagcgcugaccggggccacggagauccagaacagcggcgggaccuccaucuucgccggccaccugaaguguaggcuuaagauggacaaacuugagcugaagggcaugucauacgccaugugccucaacaccuuuguguugaagaaggaggucucagagacacagcaugggacgauccuaaucaagguagaguacaagggcgaggaugcuccguguaaaauccccuuuagcaccgaagacgggcagggcaaagcacauaacggccgccugauaacugccaaccccguggucacgaagaaggaagaaccagugaacaucgaagccgaaccucccuucggcgaguccaacauugucauugguaucggagacaaggcgcucaaaaucaacugguacaagaagggcuccaguauuggcaagauguucgaggcuaccgcccggggcgcccgcaggauggccauccugggcgauaccgccugggacuuuggguccgucggggguguccugaauucauugggcaagauggugcaucagauauucgguucugcguacacggcgcuuuucuccggcguuuccuggaucaugaagauuggcaucgguguacugcucacuuggaucggccugaacucaaaaaauacaaguaugagcuucuccugcaucguuaucgggaucaucacccuguaucucggcgccguggugcaagccgacauggggugcgccauaaacuggaagggcaaggaguuaaaaugcggcagcggaauuuucgugacaaaugagguccacacuuggacggagcaguacaaguuccaggcggacuccccaaagcgucuggccaccgcuaucgccggcgccugggagaacgggguuugcggcauccgcuccacaacccgaauggagaaucuguuauggaagcagaucgcgaaugagcugaacuacauccucugggagaauaacaucaagcugacgguuguggugggggacaucaucggcgugcuggagcagggcaagcgcacccuaacgccucagccuauggagcugaaguauucuuggaaaaccugggggaaagccaagaucgucacggccgagacacagaacucguccuucaucaucgacggaccgaauacacccgagugccccagcgcaagucgugcguggaacguaugggagguggaggacuauggguucggcgucuucacaacuaacauuuggcugaaacuccgcgagguguacacccaguccugcgaccaucgguuaaugagcgccgcgauaaaggacgagcgcgccgugcacgcggacaugggguacuggaucgagucucaaaagaacgguucauggaaguuagagaaggcuuccuucaucgaggucaagaccuguacuuggccaaaaagccacacccucuggucuaacggggugcuugaaagcgacaugaucaucccgaaaagccuggccgggccuaucucacagcauaaucaccggccgggguaccacacacagaccgccgggcccuggcaccucggcaagcuggagcuagacuucaacuacugugagggcaccacugucgucaucacggagaacugcgguacgcguggccccucccuccggaccaccacggugucugggaagcuaauacacgagugguguugccgcaguugcaccuugccuccgcuccgauacaugggagaggauggaugcugguacggcauggagauacgcccuaucaacgagaaggaggagaauauggucaagucucuugucucggcaggcagcgggaaggucgacaacuuuaccaugggcguacugugccucgccauccucuucgaggagguaaugcgcgggaaguucggcaagaagcacaugauugcgggggugcuguuuaccuuugugcuacugcuguccgggcagaucacguggcgagauauggcccauacccucauaaugaucggaucuaacgcguccgauaggauggggaugggcguuacuuauuuagcgcugauagccaccuucaaaauccagcccuuccuagcgcuggguuucuucuugcgaaaacucacgucgcgggaaaaccugcugcucgggguuggacuggccauggcuacaacguugcaacuccccgaagauauagagcaaauggcaaacgggaucgcgcugggccugaugacacugaaauugaucacgcaauuugagaccuaucagcuguggaccgcccuuguuagccuuaccuguucgaacacgaucuucacccugaccguagccuggcgcaccgcuacgcuaauccuggcugggguuucacuuuugccguugugccaauccagcaguaugcggaaaaccgacuggcugccgaugaccgucgcggccaugggugugcccccccucccgcuuuucaucuucagccugaaggacacgccaaagcgcagaaguuggccccucaacgaggggguaauggccguuggcuuggucuccauccuugcguccagccuccuacgcaacgacgugccaauggccgggccucuagucgccggagggcuauuaaucgcuugcuacgugaucacugggaccuccgcagaccugacuguggaaaaggccgccgacgucacaugggaggaagaggccgagcaaacgggugugagccacaaccugaugaucaccguggaugaugacgggaccaugcgcaucaaggacgacgaaacugagaauauacugaccgugcuccucaaaacggcacugcugauagucucaggcaucuuucccuacagcauccccgccacccuucugguguggcauaccuggcagaagcagacgcagcggagcgguguguuaugggauguccccagccccccagaaacccagaaggcugagcuugaggaggggguguaccguaucaagcagcagggcauauucgguaagacucaggucgguguuggaguccagaaggaaggagucuuccacaccauguggcacgucacccggggcgccguguuaacgcacaacgggaagagacuugagcccaacugggcaucggugaagaaagaccucauuucuuacggcggaggauggcggcuguccgcucaguggcagaaaggggaagaaguccaagugaucgcugucgagcccggcaagaacccgaagaacuuccagaccaugcccggcaucuuccaaaccaccacuggggagauuggggccauugcgcuggacuucaaacccggcacuuccggcagcccaauaaucaacagggagggcaaagucgucggguuguacggcaacgggguagugaccaagaacggagguuacguguccggcauagcccagaccaacgccgagccugauggacccacacccgagcucgaagaggaaauguucaagaagaggaaucugaccaucauggaccugcauccggggagcgggaaaacucguaaauaccuucccgccaucgugcgggaagcuaucaaacgacggcugcgcacauugauucuagcgcccaccagagucguugccgccgaaauggaagaggcccuuaaggggcucccuauccguuaccagacaacugcuaccaaauccgagcacacgggccgggaaaucguagaucucaugugccacgccaccuucacaaugcgacugcugucaccgauucgggugccgaacuacaaccucaucaucauggacgaagcgcacuuuacggacccggcguccaucgccgcccgcggguauauuucaacgcggguaggcaugggcgaagcggcugccauauuuaugaccgcuacaccgcccggaaccgcugaggccuucccccagucgaaugcgcccauucaggacgaagagcgcgacauuccagagcgcagcuggaacaguggcaaugaauggaucaccgacuucgucgggaaaaccgugugguucgugcccagcaucaaggccggcaaugauauugcgaacugucuccggaaaaacgggaaaaaggucauccaacugucccgcaagacguuugauaccgaauaccagaagacgcgccucaacgacugggauuuuguggugacuacagacaucagugagaugggcgcgaacuucaaggcggacagggucauugauccccggagaugccucaagcccgugauucuaacggauggcccagaacgugugauccucgcaggaccgaugcccgucacagcugcuuccgcggcucagcgccggggccgcguugggcggaacccgcagaaagaaaaugaccaguacauauucaccggccagccgcuaaacaaugaugaagaucacgcccacuggaccgaggccaagaugcugcuggauaauaucaacaccccggagggaauuauccccgcccuguuugagcccgagcgggagaaguccgcagcaaucgacggagaguaccgacugaagggugaaucaaggaaaaccuuuguagaacucaugcggcgcggggaccuucccguguggcuggcccacaagguggcgagcgagggaauaaaguacacugaccggaaguggugcuuugacggggagcgcaauaaccagauccucgaggaaaacauggaugucgagauuuggacgaaggagggggagcggaagaagcugcgcccgcgcuggcuggacgcgcggaccuacucugacccgcucgcguuaaaggaauuuaaagacuuugccgcgggccgcaagaguaucgcacuugaucucgugaccgaaauugggcgggugcccucccaccuggcguaccggacgcggaaugcgcuggacaaccucgucaugcuacacaccagcgagcauggcgggcgcgccuaucgucacgccguggaagagcugccagagacgauggagacccuccugcugcuuggccugaugauucuccucaccgggggagccaugcuguuucuaaugagcggcaaggggauaggcaaaacguccaucggccucauaugugucauuguaagcagcggaauguuauggauggcggacgucccuuuacaguggauugccagcgccaucgucuuggaguucuucaugaugguacugcucauaccagaacccgagaagcagcgcaccccgcaggauaaucagcucgccuacguggugauagggauacuuacccuggcagcgaucgucgcagcaaaugagaugggucuccuggaaacgaccaagcgggaccuggggauguccaaagagcccggcgucguuucucccaccuccuacuuagacguugaccugcaccccgcuucugccuggacgcuuuacgcgguggccacgaccguaaucacaccgaugcuucgccacaccaucgagaacuccacugccaacguuagccuggccgccauugccaaccaggcugugguccugaugggccucgauaagggauggccuaucucgaagauggaccugggcguacccuugcucgcccuaggguguuacagccaagugaacccccugacccugaccgcugcggugcuacugcucgugacccauuaugccaucaucggcccgggccuccaggcuaaggcgacgcgggaggcccagaagcgcaccgcggcugggauaaugaagaacccuaccgucgauggcaucaugaccauugaccuggaccccguaaucuacgacuccaaauucgagaagcagcuuggucaagucaugcuccugguucucugcgccgugcagcuguuguugaugcguacgucuugggcccugugcgaggcccugaccuuagccaccggucccaucacuacguuaugggaggguuccccggggaaauucuggaacacaacuauagccgucaguauggccaacauuuuccgcggcucauacuuagccggagcgggacucgccuucagcaucaugaaguccguggggacgggccggcgcggcacggggccacagggcgagacccugggggagaaguggaagaagaagcugaaccagcuuucacgaaaggaauucgauuuguacaagaaguccggaauaaccgagguagaccgcaccgaggccaaggaggggcugaagaggggggagacgacgcaccacgccguauccagagggagcgccaagcuacaaugguucguggagcgcaacauggucauucccgaagggcgcgucauagaccuggggugcggucggggcggcuggucauauuacugcgcaggcuugaagaaagugaccgaggugcggggcuacaccaagggcggccccgggcacgaggagccggucccaaugucuaccuacggcuggaaccucgugaagcugaugagcggccgcgacguauucuaucugccacccgagaaaugcgauacccugcugugcgauaucggcgagagcuccccuucaccuacaguggaggagucaaggaccauccgcgugcugaagaugguggaacccuggcugaagaacaaccaguucugcaucaaaguccucaaccccuacaugccgacggugaucgagcauuuggagcggcuacaacgcaaguauggaggcauguuggugcggaauccccugagccgcaauuccacgcacgaaauguacuggauaagcaacggcacaggcaacaucgucucgagcgugaacauggugucgcgucuucuacuaaacagauucacuaugacccaccgucgucccaccauagaaaaggacguagaucuaggugcaggaacccggcacguaaaugccgagccugaaacccccaacauggacgucauaggggagcgcaucaagcggaucaaggaggagcacagcagcaccuggcauuacgacgacgagaaccccuacaagacuugggccuaccaugguagcuaugagguuaaggccaccggguccgcuagcagcaugaucaacggcguggucaagcucuugacaaagcccugggacgucguuccgauggucacccaaauggccaugacagacacaacccccuucgggcagcagcgcguguucaaggagaaaguagacacaaggacgccaaggcccaugccggguacgcggaaggucauggagaucaccgccgaaugguuguggcgcacccugggucgcaauaagaaaccccgacugugcacgcgggaggaguucacgaaaaaagugcguacuaacgccgcgaugggagcaguuuuuaccgaggaaaaccagugggacagugcuagagcugccgucgaagacgaggaguucuggaaacugguggacagggagcgcgaacuccacaaacugggcaaaugcggaucaugcguguacaacaugauggguaaacgggagaagaagcugggggaguuugguaaagcaaagggcucccgugcgaucugguauaugugguugggggcccgguaccuggaguucgaggcccuugguuuccugaacgaggaucacugguuuagccgggagaacaguuauaguggcgucgagggcgaggguuugcacaagcuggguuacauacuaagagacaucucuaaaauccccggcggggccauguacgcggaugauacggcuggaugggauacccgcauaacagaggacgaccuucacaacgaagagaagaucacccagcagauggaccccgagcaucggcagcuagccaaugccaucuucaagcugacuuaucagaacaagguugugaagguccagagaccgacccccaaggguaccguuauggauauuauaagcagaaaggaccaaagaggcuccggacaggugggcaccuacggccugaauacuuucacgaauauggaggcucaacucguccgacaaauggagggagagggcguccucagcaaggcggaccuggagaacccccaucucuuagagaagaaaaucacccaauggcuagagaccgagggaguggaacgccucaagcggauggccaucuccggcgacgacugugucgugaagccgauagacgaccgcuucgcgaacgcucuccuggcucuuaacgacaugggcaagguacgcaaggauauuccacaauggcagccguccaagggguggcaugacuggcaacagguccccuucugcagccaccacuuccaugagcucaucaugaaggacggacgaaaacuuguggucccaugccgcccccaggacgaacucaucgggcgggcuaggaucagccagggugccggguggucccucaaggaaacggcaugucuggggaaagccuacgcacagauguggagcuugauguauuuccaccggcgcgaccugaggcuggcguccaacgcgauaugcucggccguaccgguacacuggauacccacgucccgaacaacguggaguauacacgcccaccaccaguggaugaccacggaggacaugcucaccguguggaacaggguuuggauugaagacaaucccuggauggaggacaagaccccggugaccacuugggaagaugucccguaccucgggaagagagaggaccaguggugcgggagccugauuggucugaccucacgggcgacaugggcccaaaacauccucacagcgauucagcagguccggagccugauuggcgacgaggaguuucuggacuauaugcccuccaugaaacgguuucgcaaagaggaggagagcgaaggcgccauuugguga

SEQ ID NO: 26141 - RNA, 9873 nt, Artificial Sequence
  derived and/or modified CDS sequence (opt11) from DENV-3__GU363549__SS-prME
accagccugugccucaugaugauucuacccgccgcccuggcguuccaccuuacuucacgggacggagagccgcggaugaucguggggaagaacgagcggggaaagagccuguuguuuaagacugccuccgggauaaacaugugcacucucauugccauggaccugggcgagaugugcgacgauaccguuaccuauaagugcccacacaucaccgagguggagccagaggacauugauugcuggugcaaccucaccagcaccugggugacguacgggaccugcaaccaggccggugaacaccgccgggacaaacgauccguagccuuagcgccccacgugggcauggggcuggacaccaggacucagaccuggaugagcgcagagggcgcuuggaggcaggucgagaagguggagacaugggcauugcgucaccccggguucaccaucuuagcucuguuccuggcccauuauauuggcacaucccucacccagaagguggugaucuucaucuugcugaugcucguuacacccagcaugacgaugcggugcguaggcguggguaaucgagauuuugucgaaggccuguccggggccaccuggguggaugugguccuggagcauggcggaugcgugaccacgauggccaaaaacaagcccacgcuggacaucgagcugcagaagaccgaggccacccagcuggcgacuuugcggaaacugugcaucgaggguaagaucaccaacaucacuaccgacucacggugccccacccagggcgaggccgugcugccugaggagcaggaucaaaacuacgucugcaagcacacauacguggaccgggguuggggcaacgggugcggccucuucgggaaggggucgcugguaaccugugcgaaguuccagugccuggagcccauagagggcaaagucgugcaauacgagaaccucaaguacacagugauuauaacgguccacaccggggaucagcaucaaguggggaacgagacccagggugucacagcagagaucacgccucaggccagcaccaccgaagcuauccuacccgaguacgguacccuugggcuugagugcuccccacgcaccggccuggauuucaacgagaugauccuacucacgaugaagaacaaagccuggauggugcauaggcagugguucuucgaucugccccuccccuggaccagcggcgccaccacggagacgcccacguggaaccguaaggagcuacuagugaccuucaagaacgcacacgcaaagaagcaggagguuguggugcuggggucccaggagggcgcaaugcacacagcauuaacgggggccaccgagauacagaauuccggcgggacauccaucuucgcgggccaccuaaagugccgguuaaaaauggacaagcucgagcugaaaggcaugucauacgccaugugcacaaauaccuucguccugaagaaggagguguccgagacccagcaugggaccauccucaucaagguugaauacaagggcgaggacgcgccuugcaagauucccuuuagcacggaggacgagcaggggaaggcgcacaacggccgcuuaauaaccgccaaccccguuguaacaaagaaggaggagccuguuaacaucgaagcagagccgcccuuuggcgagagcaauauagucaucgggaucggggacaacgcguuaaaaauuaacugguacaaaaaggggucuagcaucggcaagauguucgaggccaccgcccggggggcgcgccggauggccauccugggcgauaccgcgugggacuucggauccgucgggggcguguugaacagccuagguaagaugguccaucaaaucuucggcuccgccuacaccgcgcuuuucagcgggguauccugggugaugaagauuggcaucgggguacuccugaccuggaucggccugaacagcaagaacaccucaaugagcuucuccugcauagcaaucggaauuauaacucuguaucuuggggccguagugcaagcggacauggggugcgucaucaacuggaaagggaaggagcugaagugugggagcggcaucuucgugacgaacgaagugcacaccuggaccgagcaguacaaguuucaggccgacucccccaagcgccucgccacugcaauugccggugcgugggagaacggggucugugggauucgaagcacgacccggauggaaaaccugcuguggaagcagauugccaacgagcucaacuacauacucugggagaacaacauaaaguugaccgugguggucggcgacaccaucgggguacucgagcagggcaagcgcacucugacgccccagccuauggagcugaaguacuccuggaagaccuggggcaaggccaagauugugaccgccgagacacagaacucgucuuuuaucaucgacggccccaacacucccgaaugcccgagcgcgucccgggcuuggaaugugugggagguggaggacuacggcuucggagucuucacgaccaacaucuggcucaagcugcgugaggucuacacccagaugugcgaccaccggcugaugagcgccgccgugaaggacgagcgcgccgugcacgcggacaugggcuacuggaucgagagccagaaaaacggaucguggaagcucgagaaagcgagucugaucgaagugaagacgugcacauggccaaagucacacaccuuauggaguaaugggguucuagaguccgauaugauaauccccaagagccuggccggccccaucucgcagcacaauuaccggccaggcuaccacacccagacggccggccccuggcaccuggguaagcucgagcuggacuuuaacuauugugaagggaccacugucgucauuacggaaaacugcggcacgcgaggacccucuuuacgcaccaccacggugucugguaagcucauccaugaguggugcugucgcucgugcacgcugcccccacugcgguauaugggagaggacggaugcugguacgggauggagaucagacccaucucggaaaaggaggagaauauggucaagagccucguuucggccggcagcggcaagguggacaacuucaccaugggggugcugugucuggccauccucuucgaggagguaaugcgggggaaguucgguaagaagcacaugaucgccgggguguucuuaaccuucaugcuccucuugagcggucaaaucaccuggcgcgacauggcccacacguugauuaugaucggcagcaacgcaucggaccgaaugggcaugggugugacuuaccucgcccugaucgcgacuuucaagauccagccauuccuggccuuggguuucuuuuugcggaagcugaccagccgugagaaucuucuguuggggguuggccucgccauggcaacgaccauacaacugccagaggauaucgagcagauggcgaacggcaucgcccuggggcucauggcacugaagcugauuacccaauucgagacguaccagcucuggacggcccugaucagccuuaccuguuccaacaccaucuuuacccucaccgucgccuggcggacagcgacccugauccuggcuggcgugagccuccuuccggugugucagucuagcuccaugcggaagaccgacuggcugcccaugacgguggcggccaugggggugccuccgcucccacuguucauauucucucugaaggauaccuugaaaaggcguagcuggccucugaacgagggugucauggccguuggccuggugagcauucucgcuuccagccugcuacggaacgacguccccauggccgggccccucguggccggcgggcugcucaucgccugcuacgucaucacuggaaccuccgccgaucuuacaguggagaaggcggcugaugugacgugggaggaagaggccgaacagaccggggucagccacaaccuuaugaucaccguggaugacgacggcaccaugcgcaucaaggacgaugagacggagaacauucuuaccguacuacucaagacggcacugcucaucgucuccggcauuuucccguacagcauccccgccacccugcugguguggcacaccuggcagaaacagacucagagguccggcgugcuaugggacguccccucuccaccggagacccagaaggcggaacuggaggaggggguguaccgcauuaagcagcaggguauacuggguaaaacccaggugggcgucggaguccaaaaagaggggguguuccacacaauguggcacgucacuagaggcgcagugcucacccauaacggcaaacgccuggagccgaacugggccuccgugaagaaggaccugaucagcuacggaggcggguggcggcucucagcccaguggcagaagggcgaggagguccaagugauagcggucgagccaggaaagaaccccaagaacuuucagaccaugccaggcaccuuccagaccacgacuggcgagauaggagcaaucgcccuggacuucaagccugggacgagcgguagcccuauaauaaaccgugagggcaaagugguugggcuguacgggaauggcguggucaccaagaacgggggcuacguguccggcaucgcccaaacaaacgccgaaccggacgggccuacacccgaguuggaagaagagauguucaagaaaagaaacuuaacgauaauggaccugcaccccgguagcgguaagacccgaaaguaccugccugcaauugugcgcgaggccauaaagcgccggcuccgcacccuaauccuggccccuacccggguaguggccgccgagauggaggaagcgcucaagggccugcccauacgauaccagacgacugccaccaagagcgaacacacugggcgagagaucguggaucugaugcgccaugccacguucaccaugcggcuccugagcccuguucgcgugccgaacuacaaccugaucauuauggacgaggcccacuucaccgaccccgcauccaucgcggcacggggguacaucagcacgcgcgucggaaugggcgaggccgcugcgaucuucaugacggccacgccgccgggaacugccgacgccuucccucaaucaaacgcccccauccaagacgaggagagagacauacccgagcgcagcuggaauuccgggaaugaguggaucaccgacuucgcgggcaagacggucugguucguacccagcaucaaagcagggaacgacaucgcuaauugccuacgaaagaacggaaagaaggugauccagcuguccaggaaaaccuucgauaccgaguaccagaagaccaagcuuaaugacugggacuucguugucacgacagacaucucagaaaugggcgccaacuucaaagccgauagagugauagauccgcggcgcugccucaagcccgucauccugaccgacgguccagagcgcgugauccucgcagguccuaugccagugaccgucgcuuccgcagcccagcgccgggggcgugugggccgaaacccgcaaaaggagaacgaucaguacauauuuacugggcagccacucaacaaugacgaggaccacgcgcacuggaccgaggcaaagaugcugcuggacaacauaaacacccccgagggcaucauaccggcccucuucgagcccgaacgcgagaaauccgccgccauagacggagaguacaggcugaagggcgaaucccgcaagaccuucguggagcuaaugcggcgcggagaucugccugucuggcuggcgcacaagguggccagcgaggguaucaaguacaccgaccggaagugguguuuugacggccagcgcaacaaucagauccuagaggagaacauggacgucgagaucuggaccaaagagggggagaagaagaagcuccggccccgcuggcuggaugcacgcacuuauucggacccucuggcccucaaggaguuuaaggacuuugccgcgggucggaagaguaucgccuuggaccuagugacagaaauuggcagggugccgagucaccucgcccacagaacucgcaacgcccuggacaaccuaguaauguugcacacgagcgagcacgggggacgggcguaccgccacgcgguagaagaacugcccgagaccauggagaccuugcuccugcuggggcuuaugauucugcugaccggaggcgccaugcuguuccugaucagcgggaagggcaucgggaagacguccaucggacugaucugugugauugccagcuccgggaugcucuggauggccgagauaccgcugcaguggaucgcgucugccaucguccuagaguucuucaugauggugcuccugauacccgagccggagaagcagcgaacgccccaggacaaccagcuggccuauguggucaucgggauccucacccuggcagccauuaucgccgcgaacgagauggggcugcuugagaccacaaagcgcgaccugggcaugagcaaggagccgggcguugugagccccacauccuaccuggauguagaccuccauccagccagcgccuggacccucuacgccguggcgacaaccgugaucacccccaugcugcggcacaccaucgagaacuccacagccaauguaagccucgccgccauagcuaaccaagcggucguguuaauggggcuggacaagggcuggccgauuuccaagauggacuugggagucccccugcuggcucucgggugcuacucccaggugaacccccugacgcugacagcugccguccuccugcucgucacccacuacgcgaucaucggcccuggccugcaggccaaggccacccgcgaggcccagaagcggacggccgccggcaucaugaagaaccccacuguggacggaaucaucaccauugaccuagacccaguuaucuacgacagcaaguuugagaagcagcuggggcaggucaugcucuuggugcucugcgccgugcagcuccuucugaugcgcaccagcugggcccucugugaggcgcugacgcuggccaccgggccaaucacuacccugugggagggcuccccaggcaaauucuggaacacgaccaucgcugucucgauggcaaauaucuuccggggguccuaccucgccggcgcaggguuggccuuuuccaucaugaaguccguuggcacaggaaaacgcggaacuggcagccaaggggagacccucggcgagaaguggaaaaagaaguugaaucagcuuagccgaaaggaguucgaccucuacaagaaaucuggaauaacggagguggaucgcacggaggcgaaggaggggcucaagagaggugaaaccacacaccacgccgucucucgcggcuccgcaaaacugcagugguuuguggagcggaacauggugaucccggagggccgcguuaucgaccucgggugcggccgcggcggcuggagcuauuauugcgcaggacugaagaagguaacggaagugcgcggcuacaccaagggcgggcccgggcaugaagagcccguccccaugagcacccacggguggaacauagugaagcugaugucuggaaaggauguauucuaucuaccgcccgagaagugcgacacccuguuaugcgacauuggagagucaucacccagccccacggucgaggaaagccgcaccauccggguguuaaagaugguggaaccguggcucaagaacaaccaguucugcauuaagguccuaaaccccuacaugccggcaguuaucgagcaucuugagcgcuugcaaagaaagcacggaggcaugcuggucaggaacccacugucccguaacucgacccaugaaauguacuggaucuccaacggaacuggcaauauagucagcuccguaaacauggugagccgccuacucuuaaaccgguuuacgaugacucaucggcggccgaccaucgaaaaggauguugaccuaggggcuggcacccgccauguaaacgcggagcccgagacgcccaauauggacguaaucggcgagcgcaucaggcggauuaaggaggagcacaacuccaccuggcauuacgaugacgagaacccguacaagaccugggccuaccacggguccuaugagguaaaggccaccggcuccgcaucgagcaugaucaacggcgucgugaaacuacugacgaaacccugggauguagugcccauggucacccagauggcgaugaccgacaccacgccguuuggccagcagagaguguucaaggagaaaguggacacgcggacccccaggcccaugcccggaacccggaaggucauggaaaucacggccgaguggcucuggcgcacgcugggacggaacaagcgcccccgccugugcacgcgggaggaguucaccaagaagguccgaacuaaugcugcgaugggugcgguguucaccgaggagaaccagugggacuccgccaaagccgccgucgaggacgaggaguucuggaagcucguggaccgggagcgcgagcuacacaagcuggggaagugcggguccugcguguacaacaugauggggaagcgggagaaaaagcucggugaauuugggaaagcgaaaggcucgcgugcgaucugguacauguggcugggagcccguuaccuggaguuugaggcccucggguuccugaacgaagaccacugguuuagccgagagaacuccuacucaggcgucgagggagagggucugcauaagcucggguacauccuucgggacaucuccaaaaucccuggcggagcaauguacgcagacgacaccgcuggaugggacacgcgcauuacggaagacgaccuucacaacgaggagaagauuacccagcagaugaacccagagcaccggcuccuggcuaacgcaaucuuuaagcugaccuaccagaacaagguuguuaagguccagcgccccacccccacaggcacagugauggacaucauuucucggaaagaucagcgcggguccggccagguggggaccuacggguugaacaccuucaccaacauggaagcccagcucgucaggcaaauggaaggcgagggggugcugucuaaggccgaccucgagaacccgcaccugccagagaagaagaucacgcaguggcuggagacuaaggggguggagcgccucaagcggauggcgaucuccggugacgacugcguugugaaaccaaucgaugaucguuucgcuaaugcccugcuggcccucaacgacaugggcaaagugcggaaagacauuccccaguggcaaccguccaaaggcuggcacgauuggcagcagguccccuucuguucccaccacuuucacgagcugauuaugaaagacgggcgcaagcuaguggugcccugucggccccaggacgaguugaucggccgcgcucgcaucagccagggugccggcuggucacugcgugagaccgcaugucuggggaaagcuuacgcccagauguggagccucauguauuuccaucgccgggaucugcgccuggcguccaacgccaucugcagcgccgucccggugcacuggguucccaccagccggaccaccuggucuauccacgcccaccaccaguggaugaccacagaggacauguugaccguauggaaucgcguauggaucgaggacaauccguggauggaggauaaaacacccgugaccaccugggagaacguaccguaccuaggcaagcgggaggaccaguggugcggcagccugaucgggcuaacaucccgagcuacuugggcacagaacaucagcaccgcuauucagcaaguccggagcuugauuggcaacgaggaguuccuggauuacaugcccagcaugaagcgauucagaaaggaagaggaguccgagggggccaucugguga

SEQ ID NO: 26142 - RNA, 9873 nt, Artificial Sequence
  derived and/or modified CDS sequence (opt11) from DENV-3__KJ622197__SS-prME
accagccugugccugaugaugaugcugcccgccacccuggcguuucaccucaccagccgugacggugagccccguaugaucguuggaaagaacgagcggggcaagagccuguuguucaagacggcgagcgguaucaauaugugcacccucauagccauggaucugggcgagaugugcgacgacacuguaaccuacaaguguccccuuaucgccgagguggagcccgaggacaucgacugcuggugcaacuuaacaucgaccuggguuaccuacggaacgugcaaucaggccggcgaacaccggagggacaaacggucgguggcccuggcgccacacguggguaugggacuggacaccagaacccaaaccuggaugagcgcggaaggcgccuggcgucagguggagaaagucgaaaccugggcgcuucgacaucccgguuucaccauacuagcgcuauuccuagcccacuacauuggcacgucccucacccagaagguggugauauucauacugcugaugcuggucacucccuccauggccaugcggugcgugggcguuggcaaucgcgacuucgucgaaggccuaagcggagcgaccuggguggacguugugcucgagcacggugggugcguaacaacgauggccaagaauaaacccacacuggacauugagcugcagaaaaccgaggcgacccaacucgcgacccugcggaagcugugcaucgaggguaagaucacgaacauuacgaccgacagccgcugccccacucagggcgaggcgauccuccccgaagagcaggaccagaacuacguguguaagcacacguacgucgaucggggguggggcaaugguugcggccuguuugggaaagggucucugguaaccugcgcuaaauuucagugccucgagagcauagagggaaaaguaguccagcacgagaaccuuaaauauacagugacgaucacaguccacaccggggaccagcaccaggucggcaacgacacccagggggugacugccgaaaucacgccccaggcgaguaccgucgaagcgauucugcccgaguacggcaccuugggacuggaaugcagcccgcgcacuggcuuggauuucaacgaaaugauccuccugaccaugaaaaacaaggcguggaugguacaccgucaaugguuuuucgaccugccguugccguggacgucaggcgccaucaccgagacccccacuuggaacaggaaggagcuacuggugacguucaagaaugcccacgcuaagaagcaagaggucgugguucuggggagccaggagggggccaugcacacagccuuaaccggggccaccgagauccagaacagcggugggacgagcaucuucgccggccaccugaagugccgucugaagauggacaagcuggagcuuaaggggauguccuacgcgaugugccucaacaccuuugugcugaagaaggaggugagcgaaacccaacacgggacuauacugaucaagguggaguauaagggcgaggacgcgcccugcaaaaucccauucagcacggaggaugggcaaggcaaagcccacaacggccgccugauuaccgccaaccccgucgugacaaaaaaggaggagcccgugaacaucgaggcugagcccccguucggagaguccaacaucgucauugguauaggggacaaggcccuuaagaucaauugguauaaaaagggcucuucaauagggaagauguucgaggccaccgcgcggggcgcgcgccguauggccauucuaggcgacacggcuugggacuucggaagcgugggagggguacugaacucccuaggcaagauggugcaucagaucuucggaagcgccuacacagcccuguucggggguguuuccuggaucaugaagaucggaaucggcgugcugcucacauggaucgggcugaacuccaagaacacgaguaugagcuuuuccuguaucgugaucggcaucaucacgcuuuaucucgggaccgucguacaggccgacaugggcugcgucaucaacuggaaggggaaggagcugaaaugcggaagcggaaucuucgugaccaacgaagugcacaccuggacggagcaguacaaguuccaggcggauagucccaagcgccuggccacagccaucgccggggccugggaaaacggcgucugcggcauccgcagcaccacccggauggagaaccuacuguggaagcagaucgcgaaugagcugaacuacauccucugggagaacaacaucaaguuaacggugguggucggcgacaucauaggcguucuggagcaggggaagcgcacgcucacgccccaacccauggaguuaaaauacucuuggaagaccugggggaaggccaagaucgugacggcagagauccagaacagcaguuucaucaucgacgggccaaauacacccgagugccccucugccucccgggcguggaacgucugggagguggaggacuacggcuucggcguguucacgaccaacaucugguuaaagcuucgagagguuuacacgcaaacuugcgaucaucgucugauguccgccgccauaaaggaugagagggccguccaugccgacaugggguacuggauugagucucaaaagaacggcuccuggaaguuagaaaaggcgucauucaucgaggugaagaccuguaccuggccuaagucucauacccuauggucgaacgggguccuggaauccgacaugaucauuccgaaaagccuggccggacccauuucccagcacaaccauaggcccggguaccacacgcagaccgccggcccguggcaucugggcaaguuagaacuggacuucaauuacugcgaggggaccaccguggugaucacggagaacugcgggaccagaggucccagcuugcggaccaccacggucuccggcaaacugauccacgaauggugcugccgcaguugcacccucccgccccugcgguacaugggagaggacggcugcugguacggcauggagauccgcccaaucaacgagaaggaggagaacauggugaagucccuggugagcgcggguucuggcaaagucgacaacuuuacgauggggguacugugccucgccauacuauucgaggaggugaugcggggcaaguucgggaagaaacacaugaucgccggcguccuucucacguuuaugcuguugcuaagcggccagauuacuuggcgcgacauggcacacaccuugauaaugaucggguccaacgcuucggaccggaugggcaugggggugacuuaccuggcccuuaucgccaccuucaagauccagcccuuucuggcguugggcuucuuccuucgcaagcugacgucccgggaaaacuuacuccugggcguugggcuggccauggcgacgacccugcagcugcccgaagacaucgagcagauggccaacggcaucgcgcucgggcucauggccuuaaagcugaucacccaguucgaaacguaccagcucuggaccgcuuuagucagccugaccugcagcaauaccauauuuacucuuaccguugccuggcgcacggcgacccugauccuggcgggcguuucccuccugcccgucugccagagcuccagcaugcggaagacggacuggcugccgguggcagucgcugccaugggggugccaccgcucccccuguucaucuucagccugaaagacacgcuuaagcgccgcuccuggccgcugaaugagggcgugauggccgugggccuggugucgauccucgcgucaagucugcugcggaacgacguccccauggccgggccucucgucgcagggggacugcucauagccugcuacguuaucaccggaacaagcgccgaccucacgguagagaaagcugccgacguuaccugggaggaggaggcagagcagaccggggucucccacaaucuaaugaucaccguggacgacgacggaacgaugcgaaucaaggacgaugagaccgagaacauccugaccguccuauuaaagacugcucugcucaucgugucuggcaucuuccccuacuccauacccgcuacccugcugguuuggcacacguggcagaagcagacccagaggagcggaguccucugggacgugcccagcccgccagagacccagaaggcggagcuggaggaaggcguguaccgcauuaaacaacagggaaucuucggcaaaacccagguuggggucgguguucaaaaggaaggcgucuuucacacaauguggcaugugaccaggggggcugugcuaacgcauaacggcaagcgccucgagccgaacugggccucagucaagaaggaucugaucuccuacgguggugguuggcggcugagcgcccaguggcagaagggcgaagagguccaaguaaucgcggucgagcccgggcgaaacccuaagaacuuccagaccaugccugggauuuuccagacgaccacgggcgagauaggugcuaucgcguuagacuucaagccuggcaccagcggcucucccaucaucaaucgggaagggaagguuguaggccucuacgggaacggcguugugacgaagaaugggggcuacgugagcggcaucgcccaagcgaacgcggaacccgacgguccaacccccgagcuggaggaggagauguuuaaaaaacgcaaucugaccaucauggaccuccaccccgguuccggcaagacucggaaauaccugcccgccaucguucgcgaggccaucaagcggcgcuuacggacguugauucuggcgccgacccgcgugguggcggcggagauggaggaggccuugaaaggccucccgauccgguaccaaaccacugccaccaaguccgagcauaccggcagagaaauuguugaccugaugugccaugcgaccuucaccaugcggcugcucucgcccgugcgcgugcccaacuacaaucugaucaucauggacgaggcucauuuuacggacccggcaagcaucgccgcacggggcuacaucuccacacgcgucgguaugggggaagccgcugcgauuuucaugaccgccacuccgcccggcacggccgaggccuucccgcaaagcaacgccccgauccaggacgaggagcgugacauccccgagcggaguuggaacagcgggaacgaguggaucaccgacuucguaggaaagacugugugguucguccccuccaucaaggccgggaacgauaucgcuaacugccugcguaagaacggcaaaaaggugauacaacucagccggaagaccuucgauacugaguaucagaagaccaagcuaaacgauugggacuucguugucacuaccgacaucuccgagaugggggcuaacuucaaggccgaccgcguuaucgacccccggcggugccugaagccggugaucuuaacugacgggcccgagcggguaaucuuggcuggccccaugccggugaccgccgccagcgcggcccagcgccgggggcgcgugggccggaacccgcagaaggagaacgaccaguacauuuucacuggucagccccugaacaaugacgaggaccaugcgcacuggaccgaggcuaagaugcuccuggacaacaucaacacccccgagggcauaauccccgcucuuuucgagccggagcgugagaaguccgccgcgaucgauggugaguaccggcugaagggggagagccgcaagaccuucgucgaguuaaugagacgcggcgaccuccccguguggcucgcccauaaggucgccucugaggguaucaaguacaccgaucgaaaguggugcuucgacggcgagcgcaauaaccagaucuuagaggagaacauggacgucgaaaucuggaccaaagaaggcgagcgaaagaaauugcgcccacgcuggcucgacgcgcggaccuacagcaauccgcuggccuugaaagaguucaaggacuucgcggcugggcgcaagagcaucgcacucgaccuggugacagaaaucggccgggucccgagccaccuggcccaccgcaccaggaacgcucuagacaacuuagucaugcugcacaccagugagcauggagggcgcgcauaccgacacgccguugaggagcuccccgagaccauggaaacgcuccugcuccuggggcugaugauacuccuaacgggcggcgccaugcucuuucucaucuccgggaagggcaucgggaagaccuccaucggacugaucugugucaucgugucaagcggcaugcucuggauggcggauguaccccuccaguggauugccagcgcgaucgugcuggaguucuucaugauggugcugcuaaucccggagcccgaaaagcagaggacgccccaggauaaccagcuggccuacgucgucauagggauccuuacgcucgccgccaucgucgcagcgaaugagaugggccugcuggagacuaccaagcgggaccuugggaugucuaaggagcccggcguugucucccccaccagcuaccuggacguggaucugcaccccgccagugcauggacucucuacgcagucgcgacaaccgucauuacccccauguugcgccauacgaucgagaacagcaccgcgaacgucagucuggccgccauagcgaaccaagccguggucuuaaugggcuuagacaagggguggcccaucagcaaaauggaucuggggguaccguuacuggcacugggcugcuacagucaggucaacccccucacauugaccgccgccguacugcuccugguaacgcacuacgccauuaucggccccggcuugcaggcuaaggccacccgggaggcacagaagcgaaccgccgccgguaucaugaagaacccgaccgucgacgggaucaugacgaucgaucucgaccccgucaucuacgauaguaaguuugagaaacagcuuggacaggugaugcuccucgugcugugugcgguccagcugcuacugaugcggacuuccugggcgcugugugaagccuuaacccuggcgacaggccccauuacgacccugugggaggggagccccgggaaguucuggaacaccaccauugcgguguccauggccaacaucuuccgugggucguacuuggcaggcgccgggcuggccuucuccaucaugaaguccgugggcacgggcaagcggggaacagguucccagggggagacccugggcgagaaguggaaaaagaagcucaaccaguuaagccgccgggaguucgagcuguauaagaaauccgguaucaccgaggucgaccguacggaggcuaaggagggccucaaacggggcgagaccacccaccacgccgugucccgcggaucugccaaguugcagugguucguggagcgaaacauggucauuccugagggccgcgucauagaucuggggugcggacgcgggggcugguccuauuacugcgccggccuaaaaaaggugaccgagguucgggguuacaccaagggugggccgggccacgaagagcccgugcccaugagcacuuacggcuggaacaccgugaaguugauguccgguaaagacgucuucuaccugcccccggagaaaugugacacccugcuaugcgauaucggcgagucuagccccucgcccaccguggaggaaucccgcaccauaagagugcucaaaauggucgagcccuggcugaaaaacaaucaguucugcaucaaggugcucaacccguacaugcccaccgugaucgagcaccuggaacgccugcaacggaaacacgggggcaugcucgugcggaacccccucagccgaaacuccacccacgaaauguacuggauaagcaacgggaccggcaauaucguguccagcgucaacauggucuccaggcugcugcugaaccgauuuacgaugacccacagaaggccuaccauagaaaaggacguagaccucggcgccgguaccaggcacguaaaugcggagccugaaacgccgaacauggacguaauuggcgagcggauuaagcgcaucaaggaggagcacagcaguaccuggcauuacgaugacgagaaccccuacaaaaccugggccuaccacgggagcuacgaggugaaggccaccggguccgccagcucaaugauaaacggaguggugaagcuccugacgaagccgugggacguggucccaauggugacccagauggccaugaccgacaccacgcccuuuggccagcagcgaguguucaaggagaaggucgacacccgcacgccgcggcccaugccgggcacccgcaaggugauggagaucaccgcggaguggcuuuggcggacccugggccggaacaaacgcccucggcugugcaccagagaggaguuuaccaagaagguucggacgaacgcggccaugggcgccgucuucaccgaggaaaaccaaugggaguccgcgagggccgccguggaggacgaggaguucuggaagcugguggggcgggagcgcgaacuacauaagcuggggaagugcgggagcugugucuacaacaugaugggaaagcgugagaagaagcugggcgaguucgggaaggccaaggggucacgugccaucugguacauguggcucggugcgcgguaccuggaauucgaggcucuaggcuuccucaacgaggaucacugguucagccgcgagaacagcuacucagggguggagggcgagggccugcacaaacugggguacauccuccgggacaucucuaagaucccaggcggcgccauguacgcggacgacacagcugggugggacacucgcaucacagaggacgacuuacacaacgaggagaaaaucacccagcagauggacccggagcaccggcaacuggcaaacgccauuuucaaacucaccuaccagaacaagguggucaaggugcaacggccuacccccaaaggaacggugauggacaucaucucacggaaggaucagcgcgggagcggucaggugggcaccuacggccugaacaccuucaccaauauggaagcccaguuaauccggcagauggaaggcgagggcgugcucucaaaggccgaccuggagaacccucaucuccuagagaagaagaucacacaguggcucgagacgaagggaguugagcgacugaaaagaauggcaaucuccggggacgacugugucguuaagcccauagaugaucgcuucgcuaaugcccuccuugccuuaaacgacaugggaaaggugcggaaagacaucccccaguggcagcccuccaagggguggcacgacuggcagcaaguccccuucugcucccaucacuuccaugagcucauaaugaaggauggucguaaacugguggugccuugucgcccccaggacgagcugaucgggcgggcgcgcaucagccagggugccggguggucauuaaaggaaacugcgugccuagguaaggcguacgcgcaaauguggucauugauguacuuccaucggcgcgaccuccgacuggcaaguaacgcgauuugcagcgccguccccgugcacugggugcccaccucgcgcacgacguggagcauacacgcccaucaccaauggaugaccaccgaggauaugcuaacugucuggaacagaguguggaucgaggauaaccccuggauggaggacaagacgcccguaaccacaugggaggacgugcccuaccucggaaaacgugaggaccaguggugcgggucguuaaucggccugacaucccgggccacgugggcccagaacauccucaccgcgauucagcagguucgcagccugauuggggacgaggaguuuuuggacuacaugcccaguaugaagcgguuccgcaaggaggaggagagugagggcgccauaugguga

SEQ ID NO: 26143 - RNA, 9873 nt, Artificial Sequence
  derived and/or modified CDS sequence (opt11) from DENV-3__KJ622198__SS-prME
accagccugugucucaugaugaugcuucccgccaccuuggccuuccaccucacaagccgggacggcgaaccccggaugaucguagggaaaaacgagcggggcaagucacugcuguucaagacugcgagcgggauuaacaugugcacucucauagccauggaccugggcgagaugugcgacgacaccguuaccuacaagugcccccuuaucgccgaaguugaacccgaggacauagacugcuggugcaaucucaccuccacuugggugacguacgggacgugcaaccaggccggcgagcaccggcgcgacaaacgguccgucgcccucgcgccacacguuggcauggggcuggacacccgcacccagaccuggaugagcgccgaaggcgccuggcgacagguggagaaggucgagacgugggcguugcgccaccccggguucaccauacuggcgcuguuccucgcccacuacaucggcaccucccugacccagaaggucgugaucuucauccugcucaugcugguaacgcccaguauggccaugagaugcguggggguaggcaaucgcgacuucgucgaggggcucuccggggccaccuggguagaugugguacucgagcacggcggcugcguaacgacuauggccaagaacaagcccacccuggacaucgaacugcagaagaccgaagcaacccagcucgccacgcuccguaaacugugcaucgagggcaagaucaccaauauaacuacagauagccggugucccacccagggcgaagccauccuuccugaggaacaggaccagaacuacgugugcaaacacacguacguagaccgcggauggggcaacggcugcggccuguucgguaaggguucccugguaaccugcgccaaguuccagugccuggagucaaucgaaggcaaggugguccagcacgaaaaccugaaguacaccgugacaaucacggugcacaccggggaccagcaccaggugggcaaugauacgcagggcgugaccgccgagaucacgccccaggcguccaccgucgaggcuaucuugcccgaguacggcacgcucggucuagagugcucuccccgcaccggccuggacuucaacgagaugauccucuugaccaugaagaacaaggccuggaugguacaccgucagugguuuuucgacuuaccacuccccuggacgaguggagccaucaccgagacccccacguggaaccgcaaggaacugcuggugacguucaagaacgcgcaugcuaagaagcaagaagucguggugcucgggagccaggagggcgccaugcacaccgcccugaccggagccacugagauccaaaauuccggagggacuagcaucuucgccggccacuuaaagugccggcuaaagauggacaagcuggagcugaagggcauguccuacgcgaugugucuaaacaccuucguccugaagaaggaggugagcgagacccagcacgggacgauacugaucaaaguggaguacaaaggugaagacgcacccugcaagaucccauucagcacggaggacggccagggaaaggcccauaacggccgccuuaucaccgccaacccgguggugaccaagaaggaggagcccgucaacaucgaagcggagccgccguuuggcgaguccaacaucgucaucggcaucggggauaaggcacucaagaucaacugguacaagaagggcucaucaaucgggaagauguucgaagcgacggccagaggcgcucgccggauggcgauucugggagacaccgccugggacuucgggagcgugggcggggugcugaacucccucggaaagaugguucaccagaucuucgggucugccuauacugcccuguucggaggcguguccuggauaaugaagaucgggaucggcgugcuguugaccuggaucggucuuaacucuaagaacaccucgaugagcuucuccuguaucgucaucggcaucaucacgcuuuaccuugggaccgucgugcaggccgacauggguugcguaauaaacuggaagggcaaggagcugaaaugcgggagcggcauauucgugaccaacgaaguccacaccuggacggagcaguauaaguuccaggcggacaguccgaagagauuagccaccgccaucgccggugcaugggaaaacggcgucuguggcauccgcagcacaacccggauggagaaccuccuguggaagcagaucgcgaacgagcuuaacuacauccucugggagaacaacauuaagcugacaguaguggucggcgacaucaucggcguacuggagcaggggaagcgcacccucacaccacaacccauggaauuaaaguauuccuggaagaccuggggcaaggccaagaucgugacggccgaaauucagaacagcuccuucaucaucgacgguccgaacacccccgaaugccccagcgcuucccgggcguggaacgucugggagguggaggauuacggguucggcguguucaccaccaacaucuggcugaagcuccgcgaagucuacacgcagaccugcgaccaccggcuuaugagcgcagcuaucaaggacgagagagcagugcaugccgacaugggauacuggauugaaagccagaagaauggcuccuggaagcuggagaaagcgagcuucaucgaggucaagaccugcacguggccuaagagucacacuuuguggagcaacggggucuuagaguccgacaugaucauuccaaaaagccuggccggcccaaucucccagcacaaucaccggccuggguaucacacgcagacugcaggcccguggcaucucggcaagcuggaacuggauuucaacuauugcgaggggaccacagugguaaucacggagaacugcggcacccgcggccccagucuccggaccaccacugucuccgguaagcugauucacgaguggugcugucgcucuugcacccugccgccccuccgguauaugggggaggacggcugcugguauggaauggagauacgcccgaucaacgagaaggaggaaaauaugguaaagucccuaguaagcgccggguccggcaaagucgacaacuucaccaugggggugcugugccuagccauucuguucgaggaaguuaugcgugguaaauucgggaagaaacacaugaucgcaggcguccugcuuaccuuuaugcuguugcucagcggccagaucacguggcgggacauggcccacacccugaucaugaucggguccaacgccagugaccggaugggcaugggcguuacuuacuuggcccucaucgcgaccuucaagauccagcccuuucuggcgcugggcuucuuucuccguaagcugacgucuagggagaaccugcugcugggcgugggccuggcgauggccaccacccuccagcugccugaagacaucgagcagauggccaacggcaucgcacugggccucauggcccugaaacugaucacgcaguuugaaacauaccaguuguggaccgcccuggucagccugaccugcagcaacacgaucuucacgcucaccguggcuuggcgcaccgccacccugauccuggcgggcguuagucuccugccugucugccaaagcucuagcaugcguaaaacggacuggcugccuguggccgucgccgccaugggcguuccgccccugccucuguucaucuucagucugaaggacacccucaagcgccgcucguggccguuaaaugaaggcgucauggccgucggccugguuuccauccucgcgucaucccuguugcguaacgacgugcccauggccgggccccuaguggccggcgggcugcugaucgccugcuacguuaucacaggcacuagcgcagaccucacaguggagaaggcggccgacgucaccugggaggaagaagccgagcagacuggggugucucacaaccuaaugaucacaguggacgacgacgguacgaugcgaaucaaggacgaugaaaccgaaaacauucugacuguccugcugaaaaccgcccuucucaucgugagcgguaucuucccuuacuccaucccggcgacccuguuaguguggcacacauggcagaagcagacccagcggagcgggguacuaugggacgugcccagcccgcccgagacacagaaagcugagcuggaggagggcguguaccgcauaaagcaacaaggaaucuucggcaagacccaggucggggugggggugcagaaggaaggcgucuuccacacgauguggcacgugacccgcggggccgucuugacucacaacggcaagcgccucgagccgaacugggccagcgugaagaaagaucugauuuccuacgggggcggguggcggcugagcgcccaguggcagaagggcgaggagguccagguaauugcggucgagcccgggcgcaaccccaaaaacuuccagaccaugccggggauauuccagacgaccaccggcgagaucggggcuauagcucuggauuuuaagccgggaaccuccggcucccccauaaucaaccgugaagggaaggugguaggccucuacgggaauggcgucguuacaaagaacgggggauacgugucaggcauagcgcaggccaaugcggagcccgacgggccgacgcccgagcuggaagaggagauguucaaaaagcgcaaccugacaaucauggaccuccacccgggcagcgggaagacacggaaguaccuacccgccaucguccgggaggcgaucaaacggcguuuacggacgcucauuuuggcaccgaccagagugguggccgcggaaauggaggaggcacugaagggccuccccauccgguaccagaccaccgcaacuaaauccgagcacacagggcgcgagaucgucgaccugaugugccacgcuacuuucaccaugcggcugcuaucccccgugcgcgucccaaacuacaacuugaucaucauggacgaggcccacuucacggacccggcgaguaucgccgcgagaggcuacaucuccacccgcgucggcaugggggaggccgcggccaucuuuaugacggcuacgccacccggcacggccgaggccuucccucagagcaaugcgccuauacaggacgaggagcgcgacauccccgaacgguccuggaacuccgggaacgaguggaucaccgacuucguggguaagaccgugugguucguccccuccaucaaagccgggaacgacaucgcuaauugucugcgcaagaacggcaagaaggugauccaacucucacggaagacguuugacacggaguaucagaaaacaaagcugaacgacugggacuucguggucacuaccgacaucuccgagaugggcgccaacuucaaggccgaccgcgugaucgacccccggcgcugccugaagccugugauccucacggaugggccugaacgcgucauccuggcgggcccaaugcccgugaccgccgccagcgccgcccagcgccgggggagagucggucggaacccgcagaaagagaacgaccaguacauauucaccgggcagccccucaauaacgacgaggaucacgcgcacuggaccgaggccaagaugcuccuggacaacauuaauacgcccgagggcauuauccccgcccuguucgagccggagcgcgagaagagugccgcgaucgauggcgaguaccggcucaagggggagucgaggaagaccuuuguagagcugaugcggcgcggcgaccugcccguguggcucgcccacaaagucgcuuccgaagggaucaaguacaccgaucggaaguggugcuucgauggcgagcgcaauaaccaaauucuggaggagaacauggacguugaaauuuggaccaaggagggggagcggaagaaacuucgccccagauggcucgacgcccggaccuacucgaacccgcuggcccuuaaagaguucaaagauuucgcggcggggcgcaaguccaucgcgcucgaccuugugacggaaauaggccgggucccgagccaccucgcccaccguacccggaacgcucucgacaaccuuguuaugcugcacaccuccgagcacgggggccgcgcguaucgccacgccguugaggagcuccccgagaccauggagacgcuacuccuccuaggacugaugauacuccugaccggcggagcaaugcuauuccucauuagcgggaagggcaucgggaagaccucuaucggccugaucugcgucauugugucgucugggaugcuguggauggccgacgugcccuugcaguggaucgccuccgcaaucguccuggaguucuucaugauggugcuccugaucccggagcccgagaagcagcgcacaccccaggacaaccagcuggccuacgucgucaucggcauccugacgcucgcagccaucguagccgcgaacgagaugggcuugcuggagaccaccaaacgggaccucgggaugucgaaagagcccgguguggucuccccgaccagcuaucuggacguggaccugcaccccgccuccgccuggacgcucuaugcgguggcgacuaccgucaucacccccaugcugcgccacacgauugagaacagcacagccaacgugucccuggccgcgaucgccaaccaggcggugguccucaugggguuggacaagggcuggcccauuagcaaaauggaccuuggcgugccguuacuggcacuaggcugcuacucccaggugaacccacucacccugaccgccgcuguccuccuacuggugacccacuacgccaucaucggucccggguuacaggccaaagccacccgggaagcccagaaaagaaccgcagcaggcaucaugaagaaccccacaguggacgggauaaugacgaucgacuuagacccggucaucuacgacagcaaguuugagaaacagcugggacaggugaugcugcucgugcugugcgcgguccagcugcugcugaugcgaaccucuugggcacugugcgaggcccucacccuggccaccggccccaucacaacccugugggagggcucacccggcaaguucuggaacaccaccaucgcgguguccauggccaacaucuuccgcgggagcuaccucgccggcgccgggcuggccuucuccaucaugaaguccgugggcacaggcaagcgggggaccggcucccagggggagacccugggggagaaauggaagaagaaacucaaucagcugucgcgccgggaguucgagcuguacaagaaaagcgggaucacggaggucgaccgcacagaggcgaaggagggccugaagcguggcgagaccacucaccacgcagugagccggggaagcgccaaauugcagugguucguggagcggaacaugguaauccccgaggggcgcgugaucgaccugggguguggccgcgggggcuggaguuacuacugugccggacucaaaaagguuacagaggugcggggguacacaaagggcgggccaggacacgaggagcccgugccaaugaguacauacgguuggaacaccgugaagcuaauguccggaaaggaugucuucuaccugcccccagagaaaugcgacacccugcucugugacauuggagagagccuccccucccccaccguugaggagagccgcacuauccggguguugaagauggucgagcccuggcucaagaacaaucaguuuugcaucaagguauuaaacccguacaugcccacagugaucgagcaccuggagcgcuugcagcguaagcacgggggcaugcugguccgaaacccucugucccguaacucuacccaugagauguauuggaucuccaacggcacaggcaacaucgugucauccgugaauauggucagccgcuuacugcugaaccgguucacgaugacccaccgccggcccaccaucgagaaggacguugaccucggcgccgggacccgccacgucaacgcggaaccggagacucccaacauggaugugaucggcgaacggaucaagcgcauuaaggaggaacacuccucaaccuggcauuacgacgacgagaauccguacaagaccugggccuaucacggguccuacgaggugaaggccaccggcuccgccuccagcaugauuaacgggguagugaaguugcugaccaagccaugggacgugguccccauggugacccagauggccaugacagacaccacgcccuuuggccagcagcggguguucaaagaaaaagucgacaccagaacuccucggccgaugcccggcacccguaaggugauggagaucacggcggaguggcucuggcguacccugggacgcaauaaacgcccucggcugugcacccgcgaggaguucaccaagaaagugcggacaaacgccgccaugggcgccguguucaccgaggagaaccagugggaaagugcccgcgccgccguggaggacgaggaguuuuggaagcuaguggggcgggaacgcgagcugcacaaacugggcaagugcggguccugcgucuacaacaugaugggcaagcgggagaagaagcucggagaguucgggaaggccaagggcagccgcgcaaucugguauauguggcuaggggcgagauaccuugaguuugaagcccucggcuuccugaacgaggaccacugguucuccagggagaacucauacuccggggucgagggcgaaggcuuacacaagcucggauacauccugcgggacaucucaaagaucccuggcggcgcuauguacgccgacgacaccgccggcugggacacccgaaucacggaggacgacuuacacaaugaggagaaaauuacccagcagauggacccggagcaccggcagcuagcgaaugccaucuucaaacuuaccuaccagaacaaggugguuaaggugcagcgacccacacccaagggcaccgugauggauaucaucagccggaaggaccagcgcgggagcgggcaggucgggacguacggauugaacaccuucaccaacauggaggcccaguuaaucaggcaaauggagggggaaggcgugcuguccaaggcggaccuggagaacccucaccuguuagagaagaagauaacccaguggcuagagacgaaaggaguggaacgccucaagagaauggccauaagcggggacgacugugucguuaagcccaucgaugaccgauucgcgaacgcccuccuugcccucaacgacaugggcaagguccggaaggauauaccgcaguggcagcccuccaaagguuggcaugacuggcagcagguucccuucugcagccaccacuuccacgagcugauuaugaaggauggucgcaagcuaguggugccauguaggccccaggacgaguugauagggcgggccagaaucucccagggugcaggcuggagccugaaggagacugcgugccugggcaaggccuacgcccagauguggagucuaauguacuuccaccggcgcgaccugcggcuggccagcaacgcgauaugcuccgcaguccccguccacugggugcccacaagccgcaccacgugguccauccaugcccaccaccaguggaugaccaccgaagacaugcugaccgucuggaaccggguguggaucgaagacaacccguggauggaggacaagacgcccgugacgaccugggaggacguccccuaucugggcaagagggaggaccaguggugcgggagccugaucggccucacuagccgggcgacgugggcccagaauauucugaccgcgauccagcagguccgcucgcugaucggggacgaagaguuccucgacuacaugcccaguaugaagcgguuccggaaggaagaggagagugaaggcgccaucugguga

SEQ ID NO: 26144 - RNA, 9873 nt, Artificial Sequence
  derived and/or modified CDS sequence (opt11) from DENV-3__KJ622191__SS-prME
acaucgcuuugccucaugaugaugcuaccggccacgcuugcauuccaccucaccucgagagauggggaaccgagaaugaucgucgggaaaaacgaacgugggaaaucccuacuauucaaaacagccagcggcauuaacaugugcacccuaauugcaauggaccuaggcgaaaugugcgaugacacagugacguacaaauguccccuaaucgccgaaguggaacccgaagauauugacuguuggugcaaccugacguccacguggguuacguacggaacaugcaaucaagccggagaacauagaagggacaaaagauccgucgcgcuagcaccgcacguagggaugggacuagacacuaggacccagacauggaugucagccgaaggggccuggaggcaagucgagaaaguugagacaugggcccuccgacaccccggauucacuaucuuagcacucuuccuugcccacuacaucgggacaagccuaacccaaaaaguaguuaucuucauccuccucaugcuuguaaccccaagcauggccaugcgaugcguaggcgucggaaaccgcgacuuuguugaaggacuaagcggcgccacauggguagacguuguacuagaacaugggggcugcgucaccacuauggccaaaaacaaacccacccuggacaucgaacuccagaaaaccgaggcaacccaacuagccacuuuacggaaauuaugcaucgagggaaaaaucacgaacaucaccacagacucacggugcccgacucaaggagaggcaauccuaccagaagaacaggaccagaacuacguaugcaaacauacuuacguagaccgggguuggggaaacggaugcgguuuguuuggcaaaggaagccugguaaccugcgcgaaauuucaaugccucgaaucgauagagggcaaagucgugcaacacgaaaaccucaaauacacggugacuauaacaguacacacaggcgaccaacaccaaguaggaaacgauacacagggagucacagcagagaucaccccacaagccagcacagucgaggcgauauuaccugaauacgggacgcuaggccuggaguguaguccccgcacaggacucgacuuuaacgaagucauucugcucaccaugaaaaacaaagccuggaugguacaccgucagugguucuuugacuugcccuuacccuggacguccggagccaucacagagacacccacauggaaccggaaagaacuacugguaaccuuuaaaaaugcccacgcgaagaaacaagaaguaguagugcuggggucgcaggaaggcgccaugcauaccgcucuuaccggcgccaccgagauccagaacagcggaggaaccagcauauuugcaggccaccuaaaaugccgacucaaaauggauaaauuggaauugaaaggcaugucauaugccaugugucugaacaccuucgugcuaaagaaagaggugagcgaaacccagcacgguaccauccucaucaaagucgaguacaaaggcgaggacgccccauguaaaauaccauucucaaccgaggacggacaaggaaaagcccacaacggacgacuuaucacggcgaauccgguugucacaaagaaagaggaaccagucaauauagaggccgaacccccauucggcgaaucgaacauagucauaggcaucggggacaaagcucuuaaaaucaacugguauaagaaggguaguucgauagggaaaauguucgaagcgacagcgagaggggcacgacgaauggccauccucggcgauaccgccugggacuucggcucagucgggggcgugcucaacucacuaggcaagauggugcaccagauauucggcagugcguacacagcacuguucggcggcguaucuuggauaaugaaaauagggauagggguucuauugacauggaucggccugaauaguaaaaacacguccaugucuuuuagcugcauagucauaggcaucauaacccuguaccuaggaacaguaguccaggccgacaugggcugugucaucaacuggaaagguaaagagcuuaaaugugguucagggauuuucguuacuaacgaaguccacaccuggaccgaacaguacaaauuccaagccgacagcccaaaacgacucgccacggcaauagcgggggcgugggaaaacggagugugcggaauaagaucuacaacgagaauggagaaccugcuguggaagcagauagcaaacgaacucaacuacauccuaugggagaacaauaucaagcucacaguggucguaggggacaucaucggaguguuagagcaaggcaaaaggacccuaacuccccaaccgauggagcugaaguacagcuggaaaacuuggggaaaggcaaaaauagugaccgcagagauccaaaacagcaguuucaucauagacggcccaaauaccccagaaugcccaagugcuucacgugcauggaacgucugggagguagaagacuacggguuuggaguuuucaccacgaacaucuggcuaaaacuccgagaagucuacacacagacgugcgaccaccggcucaugagcgccgcgauuaaagacgaacgcgcuguccacgcagacaugggauacuggaucgaaagucagaaaaacgguagcuggaagcucgaaaaggcauccuucaucgagguaaaaacuuguacauggccgaaaagccacacccucuggagcaacggggugcucgagagugacaugaucaucccgaagucgcuugcaggcccgauaagucagcacaaucaccgccccggcuaccauacccaaacggcgggcccauggcacuuagguaagcucgaauuggauuuuaauuacugcgagggaaccaccguuguaaucaccgaaaacugcggaaccagagggccaucacuccgcacgacuacagugucagggaaacuaauacacgaauggugcugccgaaguugcacgcuaccacccuugcgcuacaugggugaagauggcugcugguauggaauggagauucgaccaaucaacgagaaggaagagaacauggugaaauccuuaguuuccgcaggaagcgguaaaguagacaacuucaccaugggagugcuuugucuggcaauauuauucgaagaagugaugaggggaaaguucggcaagaaacauaugaucgccggaguucuacuuacguuuaugcuacuguuaucaggccaaauuacguggagagauauggcccacacccuaaucaugauaggaucuaacgccagugauagaaugggcaugggagucacauaccucgcccugaucgcuaccuuuaaaauccaaccauuccuagccuuggguuucuuccuuaggaaacucaccaguagagagaacuugcugcucggagugggucucgccauggcaacaacccuccaacuuccagaagauauugaacagauggcgaacgguauugcuuuagggcugauggcccuuaaacugaucacgcaguucgagacauaucaguuauggacagcacuugucuccuugacaugcagcaacacuauauucacacuuaccgucgcauggcgaacagccacacugauauuagcgggagugagccuauuacccgugugccaaaguagcagcaugcgcaaaacugacugguugccagucgcuguagcugcaaugggagugccaccccuaccacucuuuaucuucagccuaaaagacacucuaaaacguaggagcuggccccucaacgaaggggugauggccguggggcuugugagcauacuggccucaucgcuccuacgcaacgacguacccauggcggggccgcuggucgcggguggacugcuaauugccugcuacgugauuacaggaacaagcgcugacuugacugucgagaaggcggccgacgucacgugggaagaggaagccgagcaaacgggaguaucucacaacuuaaugaucaccguagaugacgauggaacgaugcgaauaaaggacgacgagaccgaaaacauucucacaguccugcucaaaacagcgcuccucaucgucucagggauauucccauacaguauacccgcgacccuuuugguguggcauacguggcaaaaacagacacagcguuccggcguccucugggacgugcccagcccgcccgaaacacaaaaagcggaauuagaggaaggcguguaccguaucaaacagcaaggaauauucgggaaaacccaagugggcguaggcgugcagaaagaaggcguuuuccauacaauguggcacguaacacggggagcaguauugacucacaacggaaaacggcucgaacccaacugggccuccguuaagaaagaccucauuagcuaugggggcggauggcgacugagugcacaguggcagaagggggaggaaguccaaguuaucgcgguggagcccggccgaaaccccaaaaacuuccaaacgaugccugggaucuuccagacgaccaugggagaaaucggcgcgauagcgcuugacuucaagcccgguaccucagguuccccaaucauuaaucgggaaggaaaaguaguggggcuguacggcaacggcgucguaaccaagaacggaggguacgucagcgggaucgcgcaagccaacgcggaaccagaugggccgacaccagaacuagaggaggaaauguuuaaaaagagaaaucugaccauuauggaucuacaccccggaagcggcaagacccgaaaguaucuaccagcaaucguccgagaagccauaaagcgcaggcuaagaacgcuaauacucgcaccgacaaggguggucgcggcggaaauggaagaggcgcuuaagggccucccgauuagauaccaaacuaccgcgacaaaguccgagcacaccggaagggagauaguagacuuaaugugccacgccacuuucaccaugcgucucuugagucccguacgcgugccgaauuacaauuugaucauaauggacgaagcacacuuuacggauccagcgucgauagcggcccgcgguuacaucagcacccgagucggaaugggcgaagcggcggcgauuuuuaugacggcaacgccaccagggacggcagaagcauuuccccaaagcaacgcccccauucaagacgaagaacgagauauuccggagcgcucuuggaacucggggaaugaguggauaacagacuucgugggaaaaacaguuugguucguacccucaauaaaagccgguaacgacauagccaacugccugcgcaaaaauggaaagaaagugauacagcucucaaggaaaacauucgacaccgaguaucagaagacgaaauuaaaugauugggacuucgucgucacuacagauaucucggaaaugggcgcaaacuucaaagcggaccgcgugaucgacccaagaaggugccuaaaacccguaauucucaccgacggacccgaaagagucauacuugccggaccuaugccagugaccgcagcaagugccgcccaacggaggggcagagucggaagaaacccccagaaagaaaacgaucaguauauauucaccggccaaccgcugaacaacgaugaggaccacgcgcauuggacagaagcaaagaugcuccucgacaacaucaacaccccagaaggaauaaucccggcccuauucgagccagaacgugagaaaagugcggccauugacggugaauaucggcuaaaaggggaaagccggaaaacuuucguagagcuaaugagaagaggcgaccuucccguauggcucgcacacaagguggccagcgaaggaauaaaauacacugacagaaaaugguguuuugacggagagcgaaauaaccagauacuagaagaaaauauggacguugagauauggacaaaagaaggagagcggaagaaauugcgaccacgauggcuagacgcacgaacauacagcgacccacuagcacuaaaagaauuuaaggacuucgccgcaggccguaaaucgauagcccuagaccucgugacagaaaucggccguguaccgucgcaucucgcccauagaacaagaaacgcacuugacaaccuagugaugcuccacacgucagaacacgggggcagagcauaccgacacgcggucgaagaacuuccagaaaccauggaaacccuccuucugcuaggacuaaugauccugcuaacaggaggcgccaugcuauucuuaaucucaggcaaagguauaggcaaaaccagcaucgggcuuauaugcgucauaguaaguagugguauguuauggauggccgaugucccgcuucaguggauagcgucggccauagucuuggaguucuucaugaugguccuacuaauccccgaaccagaaaagcagagaacgccacaagacaaccaacuagcuuacguuguaaucggaauccuaacucucgccgccauugucgccgcaaacgagauggggcuucuggagacaaccaaacgcgacuuaggaaugaguaaagagccuggcgugguuuccccuaccucguaccuugauguggaccuccaccccgccagcgcguggacgcuguacgccguagcaacgaccgucaucacgcccaugcuaagacauacaauagaaaacuccacagcgaacgugucacuagccgcaaucgcaaaucaagcggucguacuaaugggccuugacaaaggguggccuaucucaaagauggaccucggcgucccgcuauuagcacuagggugcuacucgcaagucaacccacuaacccuaacggcggccguucuccuucuagucacgcacuacgccaucauaggaccuggccugcaggccaaagcuacgcgugaagcgcagaaacggaccgcggcagguaucaugaaaaaccccacagucgacggcaucaugacaauagaccucgacccagucauuuaugacucgaaguucgagaaacagcuaggccaaguuaugcuccucguccucugugcaguccaacugcuccuaaugcgaacaagcugggcccuaugcgaggcccugacacuagcaacagggcccaucacuacacuuugggaaggcaguccgggcaaguuuuggaacacaacaauagcagugucuauggcgaacauuuuccgcggaagcuaccuggcgggugcagggcuagcauucagcauaaugaaauccguaggaaccggaaaacgagggaccggcagccagggcgagacccucggugagaaguggaagaagaaacugaaccagcucagcagacgagaauuugaacuguacaagaaaucaggaaucaccgaagucgacaggacagaagcaaaagaaggauugaaacgaggggagacaacccaccacgcggucagcagaggaagugcaaaacuccagugguucguagaaaggaacaugguaauccccgagggccgcguaaucgauuuagguuguggacgcggaggauggagcuacuacugcgcaggccugaagaaaguuacggaaguuagaggcuacaccaaaggagggcccggccacgaagaaccgguaccgaugucuacauauggauggaacaccgucaaacugauguccgguaaggacguauucuaccuaccacccgaaaaaugcgauacgcuauuaugugauauaggagagucuuccccgucgcccaccguagaagaaagccgcacgauacggguacugaaaauggucgaaccauggcucaagaacaaucaauucugcauaaaagugcuaaaccccuacaugccuacggucaucgaacaccuagaacggcuacagagaaagcacggcggcauguuaguacggaauccuuuaaguagaaauuccacacacgaaauguacuggauaaguaacggcacaggaaauauagucaguagcgugaauaugguuucgcgccuccuacucaaccgcuuuacaaugacacaccgacgaccgacaaucgaaaaagacguggaccucggugccggaacacgucacguaaaugcggagccagaaaccccaaacauggacguuauuggagagaggauuaaacgcauaaaggaagaacacucauccaccuggcauuacgaugaugagaaucccuacaagacaugggcguaccaugggucuuacgaggugaaagccacagguuccgcauccagcaugaucaacggagucgugaaacuacugaccaaacccugggacguggucccaauggucacgcagauggcaaugacagacaccacaccauucggacaacaacguguauucaaagagaagguagacacccggacuccucgccccaugccggggacucgaaagguaauggagauaaccgcagaauggcucuggagaacucugggaagaaacaaacggcccagacuauguacacgcgaggaguucacgaaaaagguuagaacaaaugcugccaugggggcggucuucaccgaagaaaaccagugggagagcgcgagggccgccguggaagacgaggaguucuggaagcuaguggggcgggagagagagcuccacaaacuaggaaagugcgggucaugcgucuauaacaugauggggaaacgcgagaagaaauuaggagaguucgguaaagcgaaagggucucgcgccauuugguacauguggcuaggcgcucgcuaccuagaguucgaagcacuaggguuucuaaacgaagaccacugguucagccgggagaacaguuacagcggaguagagggggagggauugcacaagcucggauacauauuaagagacaucuccaaaauacccggaggcgccauguacgccgacgacacagcaggaugggacacgaggaucacggaagaugauuuacacaaugaggagaagaucacccagcagauggaccccgaacaccggcagcuggccaacgccaucuucaagcucacguaucagaauaaaguagucaagguccaacgacccacuccgaaaggaacuguaauggacauaauauccagaaaagaccaacgaggaucagggcaagucggcacguacggacucaacacuuucaccaacauggaagcccagcuuauaaggcagauggaaggcgagggggugcuaucgaaagccgaccuggaaaauccacauuuacuggagaagaaaaucacccaguggcucgaaaccaagggcguagaacgauuaaaacgcauggcgaucaguggagaugacuguguuguaaaacccauagaugacagguuugcgaacgcacucuuagcguuaaaugauaugggcaaggugagaaaggacauaccgcaauggcaaccaucaaagggauggcacgauuggcaacaggucccguucugcagccaccacuuucacgaacucauuaugaaagacggcaggaagcugguggugcccuguaggccgcaggaugagcucauaggcagagccagaaucucccagggcgccggauggagccuaaaagaaacagcaugccuaggaaaggccuacgcacaaauguggagccuaauguacuuucaccgccgcgaucuccgccuugccagcaacgcuaucugcagugcggugccggugcacuggguaccgaccucccguacgacguggaguauucacgcgcaccaccaauggaugaccaccgaggacaugcugacuguguggaaccggguuuggauagaagauaacccguggauggaagauaagaccccagucacaacaugggaggacgucccuuaccuaggaaagcgcgaggaucaauggugcgguagcuuaaucggacugacaaguagagcaaccugggcccagaacauauuaacugcgauccaacaaguucggucauugaucggagacgaggaguuccucgacuacaugcccucuaugaagcgcuuccgcaaagaagaggagagugagggagcgauaugguaa

SEQ ID NO: 26145 - RNA, 9873 nt, Artificial Sequence
  derived and/or modified CDS sequence (opt11) from DENV-3__KJ622192__SS-prME
acaagccugugccugaugaugaugcugccagcaacgcuggcguuccaccuuaccucacgagacggugaaccuagaaugaucguagguaaaaacgaacgggguaaaucacuucuauucaaaaccgcgucaggcauaaacaugugcacucuuaucgccauggaccuaggcgaaaugugcgacgacacaguaacguacaaaugcccccugaucgcagaagucgaaccugaagacaucgauugcugguguaacuugacauccacauggguaacguacggcacaugcaaucaagcuggcgaacaucgccgggacaaaagaucaguggcgcucgcgccacaugucggcaugggcuuagacaccagaacacaaacauggaugagcgccgaaggggcauggaggcaagucgaaaaagucgaaaccugggcguugagacacccaggguucaccauucuugcccucuuccuugcacacuauauagguacaucacuaacucagaaaguuguaauauuuauucuccugaugcucguaacgcccuccauggcgaugcgauguguaggagucggaaacagagacuucgucgaaggccuuuccggggcaacguggguagauguaguucuggaacaugggggaugcguaacuacuauggccaaaaauaaaccuacccuagacauagaauuacagaaaacagaagcuacccaacuggcaacgcucaggaaacuaugcauagaagggaagaucaccaacaucacaaccgacagccgcugcccaacacaaggcgaagcaauacuacccgaagaacaagaccagaacuacgucugcaaacauacuuaugucgaccgaggaugggggaauggaugugggcuuuucggaaaagggagucuaguaacuugcgcgaaauuucaaugccuggaaucgauugagggaaaagucguccagcaugaaaauuugaaguacacaguaaccauaaccguccacacaggcgaccagcaccaggucgguaacgacacacagggagugacagccgaaaucacgccacaagcgagcacaguagaggcgauccuacccgaauaugggacccuaggccucgaauguagcccgagaacaggacucgacuuuaacgaaaugauccuacugacaaugaaaaacaaagcauggaugguacaucggcaaugguucuucgacuugccucucccguggaccaguggugcaaucacggagacaccgaccuggaacaggaaagaacuucuggucacauucaaaaacgcccacgcgaagaaacaagaaguagucguacucggcucucaagagggagcgaugcacacagcacuaacgggcgcgaccgaaauccagaacucaggagggacauccaucuucgccggccaccuaaaaugcagacucaaaauggacaaacucgaacucaaggggauguccuacgcaaugugccugaacacauucguccugaaaaaggaaguuucagaaacccagcacggaacaauccuaaucaaggucgaauacaagggggaggaugccccuugcaagauccccuucucaaccgaggacgggcaaggcaaggcccacaauggccgacuaauaacagccaauccgguaguaaccaagaaagaagaaccgguaaacaucgaagcggaacccccuuucggugagagcaacaucgugaucggcauaggggacaaggcacuaaaaaucaacugguacaagaaaggaaguuccaucgggaagauguucgaagcaacggcgagaggggcacggcggauggcaauccucggagacacugcgugggacuucgggagcgucggcgggguacugaacucacuaggaaaaaugguucaucaaaucuucggauccgcauacacagcacuauucgggggcgugagcuggauuaugaaaauagguauaggcguacuccucaccuggauaggccugaauagcaagaauaccuccaugaguuuuucaugcaucguuaucggcaucauaacacuguaucuaggcaccgucguacaagcagacaugggaugugucauaaacuggaaagggaaagagcuaaaaugugguagcggcauauucguuaccaacgaaguacacacauggacagagcaguauaaguuccaagccgacagccccaaaaggcucgccacagcgauugcaggggccugggaaaacgggguauguggcauacggucgacaacgcggauggaaaaccuccuuuggaaacagaucgccaaugaacugaacuauauauuaugggaaaacaacaucaaacucacggucgucguaggggacaucaucggcgugcuggagcaaggcaagcgaacgcugacuccgcaaccaauggaauuaaaguauuccuggaaaacuugggguaaagcaaagaucguuacggccgaaauacaaaacagcucauuuauaauagacggccccaacacacccgagugcccaucagccucgcgagcguggaacgucugggaagucgaagacuauggauuuggagucuuuaccacaaacauauggcuaaaacuucgagaggucuacacacaaacgugcgaccaucgacucaugagcgcagcuaucaaggacgaacgagccguacacgccgauaugggcuauuggaucgagagccagaaaaacggaucguggaaacucgaaaaggccucuuuuauugaagugaaaaccugcacauggccgaaaucccacacacuauggaguaauggcguacuggagagcgacaugauaauuccaaaaagucucgcaggcccaaucucacagcacaaucacaggccagguuaccacacccaaaccgccggaccauggcaccucgggaaacuagaguuggauuucaauuauugcgaaggcacaaccguagucaucacugaaaacugcgguaccagaggcccgucacugcggacaacgaccguaagcggcaaacuuauccacgagugguguugccgcucaugcacccuuccaccccuacgcuacaugggugaggacgggugcugguauggaauggagauaaggccuaucaacgaaaaagaagaaaacaugguaaagagccuagucagugcagguucaggcaaaguagauaacuuuaccaugggaguccugugccuggccauacucuucgaagaaguaaugcgaggcaaauucgguaagaagcauaugaucgcggggguacuccuuacauuuauguuacuacuauccggacagauuaccuggagagacauggcacacacacuuaucaugaucggcuccaacgcuucugaucgcauggggaugggcgugaccuaccuggcgcucauugcaaccuucaagauccaaccguuccuagcgcuuggguucuuucuacguaagcuaacaucgcgcgagaaccucuuacuaggagugggucucgcgauggcaacaacgcuccaacuacccgaagacauugagcaaauggcaaacggaauagcgcugggucucauggcgcucaaacuuauaacgcaauucgagacauaucagcucuggaccgcacuugucagucugaccugcagcaacacuauuuuuacgcuaacuguggccuggcgcacggcaacacugauccuagcaggggugucgcugcuacccguaugccaaucaagcagcaugagaaaaacugacuggcuuccagucgccguagccgccaugggcgucccaccacugccucuguuuauauucucacucaaagauacauuaaagcggaggucuuggccacugaacgaaggcgugauggcgguaggccuagugucaauccuagcuucaucccuacuuaggaacgacguucccauggcagguccauuagucgcgggaggauuacuuauagcuuguuaugugaucacgggaacgagcgcggaucugacaguagagaaagcagccgaugugacgugggaagaagaagccgagcagaccggagugucgcacaaccugaugauuacaguggacgacgaugguacuaugagaauaaaagacgaugaaacagaaaauauccuaaccgucuugcuaaagacagcacuccuaauuguaucuggcauuuucccguauaguauaccagcuacacuacuugucuggcacacguggcaaaagcaaacgcaaagaagcggcguguuaugggauguaccaagcccaccagaaacccagaaggcagagcuagaagaaggaguuuacagaauuaagcaacaaggcaucuucgguaagacgcaagucggaguuggcgugcaaaaagaggggguguuccauacaauguggcauguaacccggggagcaguccuaacgcacaaugguaaaaggcucgagccuaacugggccucggucaagaaagaccuaauaagcuacggaggaggcuggaggcuaagugcccaguggcagaaaggugaagaaguacaggucauagccguagaacccggcaggaacccgaaaaauuuccagacaaugcccggcauauuccagacaaccacaggggaaauaggcgcgaucgcccuggacuucaaaccagggacguccggaucacccauuaucaacagagagggcaaggucgucggacucuacgggaauggcguggucaccaagaacgggggcuacguaagcgggaucgcgcaagcgaacgccgagccggacggccccacgcccgagcuggaagaagagauguucaagaaacguaaccuuacgauaauggaucugcaccccggcucaggaaaaacaagaaaauaucugccagccaucguacgcgaagcgauuaaacgcaggcugcgaacuuuaauccuggcgccgacacggguaguggccgcugaaauggaggaagcacuaaaaggacuaccgauucguuaccagacgacagccacgaaaagcgaacacacuggcagggaaauuguugaccucaugugccacgcgacguucaccaugcgccuguugagcccaguaagagucccuaauuacaaccucaucauaauggacgaagcucacuucacagaccccgcaucuauagcugcgagggguuacauuuccacacggguaggcaugggagaggccgcggcaaucuucaugacagccacaccacccggcacagcggaagcauucccucaaucgaaugccccgauccaagacgaggagcgagacaucccagagagaaguuggaacucaggaaacgaauggaucacugauuucgucggcaaaacagucugguucguacccuccauaaaagcuggcaacgauauugccaacugccugaggaaaaacggcaagaagguuauucaacuaagccgaaagaccuuugacacugaauaccagaagacaaaacuaaacgacugggauuucguugucacaacggacaucuccgaaaugggagcaaauuucaaggcggaccgagucaucgaccccagaaggugccucaaacccgucauacugacagauggucccgaaagaguuauccuugcuggacccaugcccgucacagcagcaucggcagcccaacgcagagggagagugggucgcaacccacaaaaagaaaaugaccaauacaucuucaccgggcaaccccuaaacaacgacgaagaccacgcacacuggacagaggcaaaaauguuguuggacaacauaaacacgccggaaggcaucaucccagcucucuuugagccggaacgugagaaaagcgcugccaucgauggcgaguaccgccucaagggugagagcagaaaaaccuucguagagcuaaugagacgcggcgaucugccagucuggcucgcccacaagguugccagcgaaggcauaaaauacaccgaccggaaguggugcuucgacggcgagcgcaacaaccaaauucuagaggaaaauauggauguugaaauauggaccaaggaaggagagcgcaagaagcuacgucccaggugguuggacgccaggacauacucggacccccucgcgcucaaagaauuuaaggacuucgccgcaggcaggaaaagcauugcccucgaccuaguaaccgaaauaggacgaguaccuagccaccuggcccauagaacacggaacgcccucgacaacuuagucaugcugcacacaucagagcacggagggcgagcguaccgccaugcaguagaggaacuccccgaaaccauggagacccuauugcugcuagggcugaugauacuccuaaccggcggggcuaugcuauuccuaauaucgggaaaaggaauaggaaaaaccucaauagggcuaaucugcguuauaguaucauccgggaugcuauggauggcagaugucccccuacaguggaucgcuuccgcaauuguccuggaguucuucaugaugguacuucugauucccgagcccgagaagcaaaggaccccacaggauaaccaacucgcauacgucgucauugggauucugacgcuggcagcgauagucgcagcaaacgagaugggccucuuggaaaccaccaagagagaccugggaaugagcaaagagccugggguaguaagcccaacaucuuaccucgacguagaccuccauccugcaagcgcauggacacucuacgcgguggcgaccacggugaucacgcccaugcuacgacacacaaucgaaaacucaacagcgaacguaucacucgccgccauugcaaaucaggccguggugcucaugggacucgauaagggauggcccauuagcaaaauggacuuaggaguaccccuacuggcgcuaggaugcuauucacaagugaacccgcugacauuaacggcugcagugcuucuacuggucacacacuaugcaauaauagguccaggguugcaggcaaaagccacccgagaagcccagaagaggacagcagccggaauuaugaagaauccaacgguugaugggaucaugacgauagaccuggacccagugauauacgacucuaaauucgagaaacagcucggacagguaaugcuacucguccugugcgccguccaguugcuucucaugcgaacaagcugggcacucugugaagcacuaacacucgccacaggaccuaucacgaccuugugggaggguucacccggaaaauucuggaacacaaccaucgcaguaaguauggcuaauauauuccggggcagcuaccucgcaggcgccgggcuagcauucucaauuaugaaaagcguggggaccggcaaaaggggcacaggcucgcaaggggaaacccuuggcgaaaaauggaaaaagaaacuuaaccaacuaucaaggagggaguuugaacuauauaagaaaucaggaaucaccgaagucgaucguaccgaggcaaaagaaggccuaaaaagaggugaaacaacacaccacgccguaagccgagguuccgccaaacuccaaugguucguagagagaaacaugguaaucccagagggcaggguaaucgaccucggaugcggaagagggggauggucuuacuauugcgccggguugaagaagguaaccgaggugcgcggguacaccaaaggagggcccggucacgaggagcccguaccaaugaguacauacggcuggaacacugucaaauuaauguccggcaaagacguuuucuacuugccaccggaaaaaugcgacacccuccuuugugacauaggagaauccucgcccucacccacaguggaggaaagcaggacuaucagaguccugaagauggucgagccguggcucaaaaacaaucaguuuugcauaaagguacugaacccuuacaugccaacaguuaucgagcaccucgaacgccuucaacgaaaacacggugguaugcuugugcgcaauccccugaguagaaacucgacacacgaaauguauuggauaagcaacggaaccggaaacauaguauccagcguaaacauggucucucgucuucuucucaaccgguucaccaugacgcaccgaaggccaaccauagaaaaagacgucgaccuaggugccggaacacgacacguaaacgcggaacccgagacgcccaacauggaugucauaggcgagcgaauuaaacgaaucaaagaggaacacaguuccacauggcacuacgacgacgaaaacccauauaaaacaugggcguaucacggcucguaugaagucaaggcaacagggucggccagcagcaugauaaacgguguaguaaaacuccucaccaagccgugggacguaguaccgauggucacacagauggcaaugacggacaccacgccauuuggccaacaacguguauucaaagaaaagguagauacacgcacaccacgaccaaugccaggcaccagaaaggucauggagaucacagccgaaugguuauggcggaccuuagggaggaacaaacgaccucgauuauguaccagggaagaguucacgaagaaaguaagaacgaacgcagcuaugggagcuguauuuaccgaggagaaccagugggagagcgcaagagcggcaguggaggaugaagaguucuggaaacugguaggccgagaaagagagcuacacaagcuggggaagugcggcucauguguauacaacaugaugggcaaaagggagaagaaauugggcgaauuugggaaagcgaaaggaucaagagccauaugguacauguggcuaggcgccagguaccuagaguucgaggcgcuaggauuccuaaacgaagaccacugguuuagucgagaaaacuccuauagugguguggaaggggaaggacugcacaaauuaggcuauauacuacgcgacaucaguaaaauaccaggcggggcaauguacgcagacgacacagcaggcugggacacaagaauaacugaggacgacuugcauaacgaagagaagaucacacaacagauggauccggagcacagacaacuagccaacgccauauucaaacuaaccuaccagaacaaagucguaaaaguccaaagaccaacgccgaagggaacagucauggacaucauuucgaggaaagaucagcgaggaucugggcagguaggaacuuacggacugaacacguucaccaacauggaggcccagcuaauucgacaaauggagggggaggguguacugucuaaagcagaucuagaaaauccacaccuauuggaaaagaaaauuacccaauggcuggagaccaaaggaguugagcgacuaaaaagaauggcuaucucgggagaugauugcguaguuaaaccaauagacgaucgguuugccaacgcauuguuagcauuaaacgacauggggaagguaaggaaagauauaccacaauggcaaccuaguaagggguggcacgacuggcaacaaguaccuuucugcucacaccacuuucacgaacucauaaugaaggacgggcgaaagcuagugguaccaugccggccgcaagacgaacucauaggaagggcucggauaagccagggagcgggauggucacucaaggaaacggcaugccuaggaaaggccuacgcacaaauguggagucucauguacuuccaccgacgcgaccuacgcuuagcaucaaacgccauuugcucagcuguccccguacauugggucccaacaagucggacgacguggagcauccacgcgcaccaccaguggaugacgaccgaagauaugcuaacaguauggaaucgagucuggauagaagacaauccuuggauggaagacaagacccccgucaccacaugggaggacgucccauaccucggcaaaagggaggaccaaugguguggcucacuaaucgggcuuacaagccgggccaccugggcacagaacauacuaaccgcgauccaacaaguaagaucccucaucggcgacgaagaguuccuagauuauaugcccagcaugaagcgcuucaggaaggaggaagaguccgaaggagcuauaugguag

SEQ ID NO: 26146 - RNA, 9873 nt, Artificial Sequence
  derived and/or modified CDS sequence (opt11) from DENV-3__KJ622193__SS-prME
accagccugugucugaugaugaugcugccagcgacccuggcguuccaucugacuagucgggacggcgagccccggaugauagugggcaagaacgagcggggcaagagcuugcuguucaagacugcgucuggcauuaauaugugcaccuuaaucgccauggaccugggcgagaugugugacgacacgguuacuuacaagugcccccugaucgccgagguggaacccgaagacaucgacugcuggugcaaccucaccagcacaugggugacauacgggacgugcaaccaggccggcgagcaccggcgcgauaagcggucaguggcccuggcgccgcacgugggcaugggauuggacacgcgcacucagaccuggaugagcgccgagggcgccuggaggcaggucgaaaagguggagacgugggcucuuaggcacccaggguuuaccauccucgcacuuuuucucgcccacuacauaggcacuucccugacgcagaaaguggugaucuucauccucuugaugcugguuacgcccagcauggccaugcggugugugggggugggcaaccgcgacuuugucgagggccuguccggggcuaccuggguggacgugguacucgagcauggggggugcgugaccaccauggccaagaacaagcccacgcuugacauugagcugcagaagaccgaagccacccagcucgccacccugcggaagcugugcaucgaaggcaagaucacgaacauuacgacugacagccgcugccccacccagggcgaggccauucuccccgaagagcaagaccagaacuacgugugcaagcauacguacgucgauagggguuggggcaacgggugcggccuguucggaaagggcagccuggugaccugcgccaaguuccaaugucuggagagcauagagggcaaaguggugcagcacgagaaccugaaguacaccgugacaaucaccgugcacaccggugaccagcaccagguuggcaaugacacccaagggguuaccgccgaaaucacaccccaggcgucgaccgucgaggccauccugcccgaauacggcacacucgguuuggagugcagcccucgcaccgggcuggacuuuaacgagaugauccuccugaccaugaagaacaaggcauggauggugcaucggcagugguucuucgacuuaccgcugcccuggacgucgggcgccauuaccgagacgcccaccuggaacaggaaggagcugcuggugaccuucaaaaacgcucacgcgaagaaacagggggugguggugcucggcagccaggagggggccaugcauaccgccuugaccggggccaccgagauucagaauuccgguggaacgucuauuuuugccggccaccugaagugccggcucaagauggacaagcuggaacugaaagggauguccuacgcuaugugccucaacacguucguccugaagaaggaggugagcgagacucagcacggaacaaucuugaucaaaguggaguacaagggggaggacgcccccuguaaaauccccuucagcacugaggacgggcagggcaaggcacauaacgggcgccugaucaccgcuaaccccguugugacuaagaaggaagagcccgugaacaucgaggcggagccgccauucggcgagagcaacaucgugauugggauuggggauaaagcccucaagaucaacugguauaagaaggggagcucgauaggcaagauguucgaggccaccgcucggggugcccgacggauggcgauacugggggacaccgccugggacuucggcagcguaggcggggugcugaacucccuugggaagaugguccaccagauauucggauccgcguacaccgcccuguuuggcggggucucauggaucaugaagaucgggaucggggugcugcucaccuggaucggacugaacagcaagaacaccuccaugagcuucucgugcauagucauagggaucauaacucuguaccucggcaccgucguccaggcggacaugggcuguguaaucaacuggaaggggaaggagcuaaagugcgguagcgggaucuucgugacaaacgagguacacacguggacggagcaguacaaguuccaggccgacucgccuaagcgccuggccacagcaaucgccggcgcuugggaaaacgggguuugcggcauccgcagcaccacccggauggagaacuugcuauggaagcagaucgcgaacgagcugaacuacauauuaugggagaacaacaucaaauugacagugguagucggcgacauaauugggguccuggagcaaggcaagcgaacccucacgccccaacccauggaguugaaguauuccuggaagaccuggggcaaagccaagaucgugaccgcugagauucagaacagcaguuuuaucaucgacgggccgaacaccccugaaugccccucugccagccgggcguggaaugucugggagguagaagacuacggcuucggcguguucacaaccaacaucuggcugaagcuacgcgaggucuauacgcagaccugcgaccaccgccucaugucggcugccaucaaggacgagcgcgccguccacgccgacaugggauacuggaucgagagccagaaaaaugggagcuggaaacuggagaaggcgagcuucaucgagguaaagacgugcacguggcccaagucccacacccucuggagcaauggggucuuagaguccgacaugauuauccccaagagccuggccggacccaucucucagcauaaccacagacccggguaccacacgcaaaccgccggaccguggcaucuggggaaguuggaacuugacuuuaacuacugugaaggcaccaccgugguaaucacggagaacugugggacccgcggccccagccuccggaccaccaccguauccgggaagcugauccacgaguggugcugccguucuuguaccuugccuccccugcgguacaugggagaggacggaugcugguacgggauggagauccgcccgauuaacgaaaaggaggagaacaugguaaaguccuuggugagcgccggcucagggaagguugacaacuucaccaugggcguccuuugccucgccaucuuauucgaggaggucaugcggggcaaguucggcaagaagcacaugaucgcgggcguccugcucaccuucauguugcuucucucggggcagaucacguggcgugauauggcccacacccugauaaugaucgguuccaaugccagcgaccggauggggaugggcgugacauaccuggcccucaucgccacguucaaaauccagccguuccuggcgcugggcuucuuccuccgcaagcugacgucccgggagaaccugcuccuggggguuggccuggcuauggccaccacccuccaacugcccgaggacauagagcaaauggcaaauggaauagcgcugggccugauggcuuugaagcugauuacacaguucgagacuuaccagcucuggaccgcucuggucagccugacgugcucuaacaccaucuucacguugaccguggccuggcgaaccgccacccugauccuggcgggggugucccuccugcccgucugccagucguccagcaugcggaaaacggauuggcugccgguggccgucgcugcaaugggcgugccuccauuaccccuguuuaucuuuucauuaaaggacacccuaaagcgccgcucguggccgcugaacgagggggugauggccgucgggcuagugucaauccucgcaagcucccugcuucggaacgauguuccuauggcaggcccccucgucgccggaggccugcugauagccuguuacgucaucaccgguaccagcgccgaccucacgguggagaaggcggcggacgucaccugggaggaagaggcggagcagacaggcguaucccacaaccugaugaucaccguagacgacgacggcacgaugcgcaucaaggacgacgaaaccgagaacauucuuacaguccuccugaagaccgcccugcucauagugagcgguaucuucccguacuccaucccggccacacuccuagucuggcacacguggcagaagcagacccaacguagcggcguacucugggacgugccgagcccgcccgagacccagaaggcggagcuggaggaggggguuuaucguaucaagcagcagggcaucuuugggaaaacccaagucggcgugggcgugcagaaagaaggggucuuccauacgauguggcaugugacccgcggcgccgugcugacccacaacgguaagcgccuagagccgaacugggccagcgucaagaaagaccugauauccuacggcggcgguuggcgguuaagcgcucaguggcagaagggagaagagguccaggugauugcggucgagcccgggcgcaaccccaagaacuuccagaccaugccuggcaucuuccagacgaccaccggggagaucggcgccaucgcccuggacuuuaaaccgggcaccagcgggagcccgauaaucaaccgcgaggguaagguggucgggcucuacggcaauggggucgugacgaagaacggcggcuacguaucggggaucgcgcaggcuaacgcggagccggacggcccuacacccgagcuggaggaggagauguucaagaagcgcaacuuaaccaucauggaccuccaccccggguccggcaagacccguaaguaccugcccgccaucgugcgcgaagccaucaagcggcgccugcggacucugauacuggcuccgacccgcgugguggccgcggagauggaagaggcacuaaaggggcuccccaucagguaccagacgaccgccaccaagagugagcacaccggcagagagaucgucgaccugaugugccacgccaccuucaccaugcgauugcucucccccguucgcgugcccaauuacaaccugaucaucauggacgaagcacacuucacggacccggcgagcaucgccgcacguggcuacauaagcacacgcgucgggaugggcgaagccgcggcuaucuucaugaccgcgacgccgcccggaacggccgaggccuucccccagagcaacgcacccauacaggacgaggagcgcgacaucccugagcggucuuggaacagcggcaacgaguggauuaccgacuucguugggaagaccgugugguuugugcccaguaucaaggccgguaaugacaucgccaacugccugcgcaagaacgguaaaaagguuauccagcucagccguaaaaccuuugacacagaguaccaaaagaccaagcugaacgacugggacuucgucgucaccaccgauaucuccgagaugggggccaacuucaaggccgaccgcgugauagauccccggcgcugccugaaaccgguuauccucacggaugggcccgaacgggucauccuggcggggcccaugcccgugaccgccgccagcgccgcgcaacgccggggccgagugggucggaauccgcagaaggagaacgaccaauacaucuucacuggccagccucuaaacaacgacgaagaccacgcccacuggacagaggcaaaaaugcuguuagauaacaucaauacgcccgaaggcauuauucccgccuuguuugagccagagcgcgaaaaauccgccgcuaucgacggggaguaucggcucaagggcgaaucucgcaagaccuuugucgaacugaugcggcgcggggaccugccaguguggcucgcccacaagguagccuccgagggcaucaaguacaccgaccggaaguggugcuucgacggagaacgcaauaaccaaauccuggaggagaacauggacgucgaaaucuggaccaaggagggugagcggaaaaagcugcgcccccgcuggcucgacgcucggaccuacucugacccgcuggccuuaaaggaguucaaggacuuugccgccggcagaaaguccauagcccuggaucuggugacggagaucgggcgggucccgagucaccuggcccaucggacacggaacgccuuagauaaccucgugaugcugcacaccuccgagcauggugggcgcgcguaccggcacgccguggaggaacuucccgagaccauggagacguugcugcucuugggacugaugauccuccucaccgguggugcaaugcuguuccuaaucagcggcaagggaaucggcaagaccagcaucgggcugauuugcguaaucgucuccucaggcaugcuguggauggccgacgugccccugcaguggaucgcguccgcgauaguccucgaguucuucaugaugguacuacucaucccggagccggagaagcagcgcacgccacaggacaaccagcuagccuauguggucaucggcauccugacgcucgcggcgauaguggccgccaacgagauggggcuguuagagacuacuaagcgggaccucggcaugucuaaggagccuggggucgucucccccacgagcuaccuggacguggaccugcaucccgccuccgcguggacgcucuacgcuguagcgaccaccguuaucacgccuaugcugcgucauacgaucgagaacucuaccgccaacgugucccuggccgcuaucgcaaaucaggcgguuguccucaugggccuggacaaagguuggcccauuagcaaaauggaucugggagugccacuccuggcccugggcugcuacucccaggucaacccccucacccugaccgcggccguccuucuucuggugacacauuaugccauaaucgggcccgggcuccaagcgaaggccacccgggaggcccaaaagcgcaccgcagccgggaucaugaagaacccaaccgucgacggcaucaugacgaucgaccucgacccggucaucuacgacagcaaguuugaaaagcagcugggccaggugaugcugcucgugcucugugcgguccaguuauugcugaugcggacguccugggcccugugcgaggcgcucacccuggccaccgggcccauuacgacccugugggagggcagcccugggaaguucuggaacaccaccauugcagucuccauggccaauauuuucagaggcagcuaccuggccggcgccggcuuggccuuuuccaucaugaagucugugggaacggggaagcguggcaccgggucccagggcgagacguugggggaaaaguggaagaagaagcucaaccagcucucaagaagagaauucgagcuguacaagaagucaggcauuaccgaagucgaccgcacggaggcgaaggagggccucaagcgcggggagacaacccaccacgccgugucccgcggcagcgcgaagcugcaaugguucgucgagcggaacauggugauucccgagggucgcgugauagaccuuggcugcggucgcggcggcugguccuacuacugcgccggacucaagaaggugaccgagguccggggcuacaccaagggcggcccggggcacgaagagccagugcccaugagcacguacggcuggaacaccgugaagcugaugucagguaaggacgucuucuaucugcccccggaaaagugugacacccugcuaugcgauaucggggagagcucaccuagccccacgguggaggagucuagaacgauacgggugcugaaaauggucgagcccuggcugaaaaauaaccaauucugcaucaagguguugaauccuuacaugcccaccgugauugagcaccuggagcgcuugcaacguaagcacggcgggauguugguccgcaacccccuaagccggaacuccacccacgagauguacuggaucagcaauggcacgggcaacauuguaucuucugugaauaugguaagucgccuucuccucaaccgcuuuacgaugacccaucgcaggcccacaauugagaaggauguggaccuuggggccggcacccgccacgucaacgcggagccggagacgcccaacauggacgugaucggggagcgaaucaaacgcaucaaggaggagcacagcuccacuuggcacuacgaugacgagaacccauacaagaccugggccuaccacggcagcuacgagguuaaggcaaccgggucugcaagcagcaugauaaacggggucgugaaacuccugacgaagccgugggacguggucccuauggugacgcagauggccaugaccgacaccacgcccuucggccagcaacggguauucaaagaaaaagucgacacccgcacgccccggccaaugcccgguacccgcaagguaauggagaucaccgccgaaugguuauggcggacacuagggcgcaacaagcgcccccggcuaugcacccgcgaagaauucaccaagaaggugcguacgaacgccgccaugggggccgucuucacggaggagaaucagugggaguccgcgcgcgcagcuguagaggacgaggaauuuuggaaacuggugggccgagagcgcgagcuccacaaguuagggaagugcggcagcugcgucuacaauaugaugggcaagcgggaaaagaaacuaggcgaguucggcaaggccaaggggucgcgugccaucugguacaugugguuaggcgcgcgguaccuggaguucgaggcccugggguuccucaaugaagaccacugguucucacgcgagaacuccuacagcggcguggaaggugaggggcugcacaagcugggguacauccuccgggauauauccaagauccccgggggugccauguacgccgacgacaccgccggaugggacacccgcaucacagaggacgaccugcacaaugaggagaagaucacccagcagauggacccggagcaccggcaguuggcgaacgccaucuucaagcucaccuaccaaaacaagguuguuaaaguucagcggcccaccccaaaggggaccguuauggacaucaucagccgcaaagaccagcgcggcuccgggcaagucggcaccuacggguugaauaccuuuaccaacauggaggcccagcugauccgucaaauggagggagaaggcgugcucagcaaggccgaccuggagaacccccaucuucucgagaagaaaaucacccaguggcuagaaacuaaagggguugagcgauuaaaacggauggccaucuccggugacgacugcgucgugaagccgaucgacgaccguuucgcgaacgcccugcuagcccugaaugauauggggaaagugcgaaaggauauaccccaauggcagcccagcaagggcuggcacgauuggcagcaggugcccuucugcucacaucacuuucacgagcugaucaugaaagacgggcgcaaacuaguggugcccugccgcccccaggacgaacugaucggacgggcacgaaucucccagggcgccggguggucccucaaggagacugcaugucugggcaaagccuacgcccagauguggagccugauguacuuccaucgucgcgaccuccggcuggccuccaaugcgaucugcagcgcaguccccgugcacugggugccgaccucccgcaccacguggagcauccaugcccaccaccaguggaugacgaccgaggacaugcugaccgucuggaacagaguguggaucgaagacaaccccuggauggaggacaaaacgcccgugaccaccugggaggacguaccguaccucgggaagcgcgaggaccaguggugcgggagccugauagggcugaccucccgggccacaugggcccagaacauacucacagcgauccagcagguccgcagccugauuggcgacgaagaguuucuugacuacaugcccuccaugaagcguuuccguaaggaggaggagagcgagggugccaucugguga

SEQ ID NO: 26147 - RNA, 9873 nt, Artificial Sequence
  derived and/or modified CDS sequence (opt11) from DENV-3__KJ622194__SS-prME
acuucacuaugcuugaugaugaugcuacccgcuacccuugcauuucaucugacaagccgagacggcgaacccagaaugauuguuggcaaaaacgaaagagggaaaagucugcuguuuaaaacagccagugggauaaauaugugcacacuaauugcaauggaucuuggcgaaaugugcgaugacacgguaacauauaaauguccauugauagcagaaguagaaccggaggacaucgacugcugguguaaucugacgagcaccugggugacguauggcacaugcaaucaagcuggcgagcaccgacgagacaaacgguccguugcccuagcaccgcacgucggcaugggccucgacaccaggacgcaaaccuggaugucggcagagggagcguggagacagguugaaaaagucgagacaugggcccuccggcacccaggguuuacaauucucgcauuguuucuagcacacuacaucgggacaagccucacgcagaaaguagugaucuucauacuguugaugcuagucacgcccucaauggcuaugcgcugcguuggaguaggcaaccgcgacuucgucgaaggucuuucuggcgcaaccuggguagacgucguucuggaacaugguggcugcgugacgaccauggccaaaaauaaaccgacucuggacaucgaacuccagaaaacugaggcgacccaguuagcaacccuaaggaaacuaugcaucgagggaaaaauuacuaauaucacaaccgacucacggugccccacgcaaggcgaggcaauauuacccgaagaacaggaucaaaauuacgugugcaaacauaccuauguggaccgcggcuggggcaacgguugugggcuguucgguaaaggaagccugguaaccugcgcgaaauuccaaugccucgagagcaucgaagggaaagugguacagcacgaaaaccucaaguauacagugaccaucacgguccacaccggugaccagcaccaaguagggaacgacacccagggcguaaccgccgagaucacgccgcaagcaaguacaguagaggcgauccuaccggaguauggaacucucggccuagaaugcucaccgagaacaggacucgauuucaacgagaugauucuccuaaccaugaagaacaaggccuggaugguccaccgccagugguucuucgaucuuccacucccuuggacuucaggcgcaaucacugagacaccuaccuggaaucggaaagaacugcuagugacuuucaaaaacgcccacgccaagaagcaggaaguaguuguccucgguucccaagagggagcgaugcacaccgcgcucaccggcgcgaccgagauucaaaauagcggugguaccucgauuuucgcugggcaccugaagugccgacuaaaaauggacaaauuggagcugaagggcaugagcuacgccaugugucucaauacauucgugcuaaagaaagaagugucugaaacacaacacggcacaauccucauaaaagucgaguacaagggcgaagacgcacccuguaagauuccuuucaguaccgaggacggacagggaaaagcccacaacggaagacugauaacugccaaccccgucgugacaaagaaggaggagcccguaaacauagaagcagaaccaccuuucggcgagagcaacauaguaauagguaucggggacaaagcguuaaagauuaacugguacaagaaaggcaguagcaucggcaagauguucgaagccacggcgcggggcgcacggagaauggccaucuuaggagacaccgcgugggauuuuggauccgucgguggcguauuaaacagccuagggaaaaugguacaucagauauucgggucggcguauacugcuuuguucggcgguguaagcuggauaaugaaaaucgguauaggcguccuacuaacguggauaggguuaaacucgaaaaacacauccaugucuuucagcugcauagucauagggaucaucacauuauaccucgggacaguuguccaggcggauaugggcugcgucauaaacuggaaagguaaagaacucaaaugcgggagcgguauuuucguaaccaacgaagugcauacguggaccgagcaguacaaauuccaggcggauagcccaaaaaggcuagcaacagccaucgccggagcaugggagaauggcgugugcgggauacggagcacuacccgaauggaaaaucuacuguggaagcagauugcuaacgaacucaacuacauccugugggagaacaacaucaaacucacagucgucguaggcgacaucaucgggguccucgagcaggguaaaagaacacucacaccacaaccaauggaauugaaguauuccuggaagacauggggaaaagcaaaaaucgugaccgcugagauccaaaacuccuccuucaucaucgacggaccaaauacacccgagugcccgucagcaucgagggccuggaacgugugggaaguagaggauuacggauucggaguguuuacaaccaacauauggcucaagcucagagaaguauacacgcaaaccugcgaccacagacucaugucggcggcgaucaaagacgagagagcaguacacgcagacaugggcuacuggaucgaaucacagaagaacgggagcuggaaacuggaaaaagccuccuuuaucgaagugaaaacgugcacguggccaaaaucacacacgcuguggagcaacggcguccucgaguccgacaugaucaucccaaaaucccuggcggggcccauaucgcaacauaaucaucgcccuggcuaccacacacagacagcugggccuuggcacuuaggcaagcucgagcuagacuuuaauuacugugaaggaacaacagucgucaucaccgaaaauugugggacgaggggacccucacuacgaaccaccacggucagcggcaagcugauacacgaauggugcugcaggaguugcacuuuacccccgcuacguuauaugggcgaagacgguuguugguacggaauggaaauaagaccaauuaacgagaaggaggagaacauggugaaguccuuaguaucagcugggagcggaaagguggacaacuuuacgaugggcgugcucugucuggcuauacuguuugaagaagugaugcgaggcaaauucggaaagaaacacaugauagccgguguccugcuuacauucaugcugcuccucagcggacagauaacuuggagggacauggcccacacacucaucaugaucggguccaacgccucugacagaaugggaaugggcguaacguaccuagcccucauagcgacguucaagauacaaccuuuccucgcacucggcuucuuccuccgaaaacuuaccagcagagagaaccuacuccucggaguaggacuggcaauggccacaacacugcagcuucccgaggacaucgaacagauggcuaacggaaucgcacuaggccugauggcccugaagcuaaucacacaauucgaaacauaucaacuguggacagcccuaguaucccugacaugcucaaauaccaucuuuacccucacgguugcguggagaacagcgacacuaauauuggccggcgucucacuacucccgguaugccagaguucuucgaugcgaaagacggacuggcuccccguagccguugccgccaugggaguaccaccucucccacuguucaucuucucacucaaagacacacuuaaacggcggucuuggcccuugaacgagggagucauggcgguagggcuagugagcauccuggccucaucccuucuccgcaacgacguaccaauggccggcccgcuaguagcaggaggacuccugauagcgugcuacguaauaaccgguaccuccgcagaccuaacaguggaaaaagccgcagaugucacaugggaggaggaggccgaacagacaggcgucucccacaaucucaugauuaccguggacgacgacgggacgaugcgaauuaaggacgacgagacagagaauauacuaaccguacuauugaaaacagcucugcuuaucguauccggaaucuucccguacagcauaccggcaacccuccucguauggcacacauggcaaaagcaaacacaaagaagcgggguacucugggauguacccucaccuccagagacccaaaaagccgagcucgaggaagguguauacaggaucaaacaacagggaauuuuuggcaaaacacagguugggguggggguccaaaaagaaggcgucuuucacacuauguggcacgucacccgcggggcgguccugacgcacagcggcaagcgucuugagcccaacugggcaucaguuaaaaaggaucuaauaucauacggcggaggguggcgccuauccgcacaguggcaaaagggcgaggagguacaggugauagcaguagagccaggccgcaauccgaaaaacuuccagacgaugccaggcaucuuucagacgaccacaggcgaaauaggagccaucgcacucgauuucaaaccggggaccagcggcucaccuauuauaaaucgggaagggaaggucgucggccucuaugggaauggcguuguaaccaagaacgguggguacgugagcgggauagcccaagcaaacgccgaaccugacggaccuacaccagagcuagaagaagaaauguuuaagaaacgaaaccuuacgauuauggacuuacacccaggcagcggcaaaacccggaaguaccugccggccaucgucagagaagcaauuaaacggcgccucaggacccucauacuagcccccacaagaguaguggcggcugaaauggaagaagcgcugaagggccugcccauuagguaucaaaccacggccacaaagucagaacacaccgguagggagauaguugaccuuaugugccacgcaaccuucaccaugagacuacuuaguccaguccgagugcccaacuacaaccugaucauaauggaugaagcacauuucaccgaccccgcaucgauagcagcaagaggguacaucagcacccgaguuggaaugggggaagccgcggccauauuuaugacagccaccccacccggcacggccgaggccuucccgcaauccaacgcacccauucaagacgaagaaagagacaucccugaacguaguuggaacuccggaaacgaauggaucacugacuuugucggaaaaaccgugugguuugugcccagcauuaaagcgggaaacgauauugccaacugccuaaggaaaaauggaaagaaggugauucaguuaagccgaaaaaccuuugauacugaguaccagaaaaccaaauugaacgauugggacuuuguagucaccacggacauuucggagaugggagcaaacuuuaaagcggauagagugaucgacccaagacguugccuaaaaccgguuauccucaccgacgggccagagagaguaauccucgcaggacccaugccaguaacagcggccuccgcggcucaaaggagggggagagugggccggaauccccagaaggaaaacgaccaauacauauucacaggccaaccacugaacaacgacgaagaccacgcacacuggacagaagcaaagaugcuucuugauaacaucaauacaccggaagggauuauaccggcccucuucgaacccgagcgggaaaaauccgccgccaucgacggggaauaccggcugaagggcgaaagccggaagacauuuguugagcuaaugagacgaggcgaccugccugucugguuagcucauaagguggccagcgagggcaucaaguauaccgaccgaaaguggugcuuugauggcgagagaaacaaccagauacuagaggagaacauggacguagaaauauggacaaaagagggggaacguaagaaacucagaccgcgguggcuggacgcacgaacauacuccgacccacuagcacuaaaggaguucaaggacuucgcagccggaaggaagucgaucgcuuuggaccuugucacagagaucgggagaguuccgagucaccucgcgcauaggacgcgcaaugcccuggacaaucuaguaauguuacacaccagcgagcacgguggcagggcauaccgacacgcaguggaagaacucccagagacaauggagacacugcuacuccucggcuuaaugauacuucuaacaggcggugcaauguuguuccucauaucaggcaagggaaucgggaagaccuccauagggcuaaucugcguaauagucagcucgggaaugcuuuggauggcagacgucccguuacaauggauagcuagugcuauaguccucgaauuuuucaugaugguacuauuaauuccagaacccgaaaaacagaggaccccacaggacaaccagcuagcguacguugucauaggcauucugacgcuagcagcuauaguugccgcgaacgaaaugggacuguuggaaacaacuaaacgggaucuuggcaugagcaaggaaccaggggugguaucaccgacaucauacuuggacguggacuugcacccggccagcgccuggacauuauacgcaguggccaccacagugaucacuccaaugcuccgacacaccauagaaaauucaacggcaaacguaucgcuugcggcgaucgcuaaucaggcuguugugcuaaugggacuagauaagggguggcccauaucgaaaauggacuuaggcguuccccuucuugcacugggaugcuacucccaagugaaucccuugacgcuaaccgccgccguacuccugcuaguuacacauuacgcaauaauaggacccgggcuucaagcgaaagcaacucgggaggcacaaaaacgaacugcagccggaaucaugaagaacccaacgguagauggaaucaugaccauagaccuugacccuguuaucuacgacucgaaguucgagaaacagcugggccaaguuaugcugcuuguacuuugugcgguacaacuacugcucaugcgcacaucaugggcacugugcgaggcacuaacacuugcgacaggcccaauuaccacgcugugggaggggagcccggggaaguucuggaacgcaacgaucgccguaagcauggccaauauuuucaggggaaguuaccuggcaggagccgggcucgcuuucagcauaaugaaaagcguaggcaccgggaaacguggcaccggcagccagggagaaacacucggcgagaaauggaagaagaaauuaaaucaacugucccgcagggaauuugaauuguauaaaaaguccggaaucacugaagucgacaggacagaggcaaaggaaggacucaagagaggcgaaacaacccaccacgcgguaagccguggaagugccaagcuccaaugguuugucgaaagaaacaugguuauaccggaaggccgggucauugaccuagggugcgggcgcggugguuggucauacuacugcgccggacugaagaaagucacagaggugaggggcuauaccaaaggaggacccggucaugaagaaccuguaccaaugagcacguauggauggaacaccgugaagcucaugagcgggaaggauguauuuuaccugccaccggagaaaugcgacaccuuacuaugcgacauaggagaaucaucaccuaguccaacgguggaagaaucacgaacgaucagaguucugaaaaugguggaacccugguugaagaacaaccaguucuguauaaaaguacuaaaucccuacaugccaacagucaucgaacaccucgaacgccugcagcgcaaacacggaggaauguugguacgaaacccccugagcagaaacaguacacaugaaauguacuggauuuccaaugggaccggcaauauagucagcagcgucaacauggucucaagacugcuccuuaacagauuuacaaugacgcacagaaggccuacaauagagaaagacguagaucugggggcagguacccgacacguaaacgccgagccggaaacgcccaacauggacgucauaggagagagaauaaaaagaauuaaagaagaacauaguaguaccuggcacuacgacgacgaaaauccguauaaaacaugggcguaccauggcucauacgagguaaaggcgacgggaucagcaucaucaaugaucaauggcgugguaaaauuacuaacgaagccgugggacgucgugcccauggucacucaaauggccaugacagacacgacgccguucggacaacaacgcgucuucaaggagaaaguagacacgcguacaccccgaccaaugccaggaaccagaaaagugauggagauaacagccgagugguuauggcguacguuaggccgaaacaagcggccccgacucuguacacgagaagaguucacgaagaaagugagaacaaacgccgcaaugggugccguguucacugaggaaaaccaaugggagagcgcucgcgcagcggucgaagacgaggaauuuuggaagcucgucggacgugaacgcgagcuacauaaauuaggcaaaugcggaagcugcgucuauaacaugaugggaaagagagaaaagaaacucggagaguucggaaaggcgaaaggcuccagggcaauaugguacaugugguuaggcgccagauaucucgaguucgaagcgcugggauuccuaaacgaggaccacugguucagcagggaaaacuccuauagcggaguagagggagagggccugcacaaacuaggguacauauuacgcgacauuagcaaaauaccuggaggggcgauguaugccgacgauacggcgggaugggacacccgcauaacagaggacgaucugcauaaugaggaaaagauaacgcagcagauggacccugagcaccggcaauuagccaacgcuaucuucaaacuaacguaccaaaauaagguaguaaaagugcagcgacccacgccaaaagggacaguaauggauaucaucagcaggaaggaccaacggggcucaggucaagucggaacuuacggacucaauaccuucacaaauauggaagcccaacucauccgacaaauggaaggcgagggcgugcucagcaaggccgaccucgaaaauccucaccuacucgagaagaaaauuacccaaugguuggagaccaaaggggucgaaagacugaaacggauggcgauaagcggugacgauugcgucguaaagccuauagacgaccgcuucgccaaugcucuacuugcgcucaacgauaugggcaaggugagaaaagacaucccacaauggcaaccauccaaaggcuggcacgauuggcaacaggugccguuuuguagccaccacuuccacgaacucauuaugaaggauggcaggaagcucguagucccgugccggccucaggacgaacuaaucgggcgagcccgaauaagucagggcgccggcuggagccucaaggaaacggcaugccucggaaaggcuuaugcgcagauguggucacuaauguacuuucaucgacgagauuuaaggcuagccaguaacgcgauaugcucagccgugcccguacacugggugccuacgucgaggacaaccuggagcauacacgcgcaccaccaauggaugacgaccgaagauaugcuuacuguuuggaacagggucuggauagaggauaaucccuggauggaggacaaaaccccgguaacaaccugggaggacguaccuuaccuaggcaagcgcgaagaccaauggugcggcucauuaaucggguugaccucaagggcgacgugggcacaaaacauccuaacagcaauacaacagguucggagccucauaggagacgaagaguuccuagacuacaugcccucgaugaaacgguuuaggaaagaggaggaaucggagggcgcuauuugguga

SEQ ID NO: 26148 - RNA, 9873 nt, Artificial Sequence
  derived and/or modified CDS sequence (opt11) from DENV-3__KJ622195__SS-prME
accagccuuugccugaugaugaugcugccagccacccuggccuuccaucuaacgucccgggacggcgaaccccggaugaucgucgguaagaaugagcgugguaagucacugcuguucaagaccgcgagcgguauaaacauguguacccuuaucgcuauggaucugggcgagaugugugaugacacugugacauacaaguguccucuaaucgccgagguugagcccgaagauaucgacuguuggugcaaucuaaccagcaccugggugaccuacgggacauguaaccaggccggggaacaccgcagagacaagcgcuccguggccuuggcuccgcacgugggcaugggguuagauacgaggacucaaacuuggaugucugccgaaggugccuggcgccaggucgaaaaggucgaaacgugggcccuccgccauccaggguucaccauccuggcucuuuuccucgcccauuauauuggcaccucgcugacucaaaaggugguaauuuucauccuccuaaugcuuguuacacccaguauggccaugcggugcguugggguagggaaucgggacuuugucgagggccugucgggggcaacuuggguggacgugguucucgagcacggcgggugcguaaccacgauggccaagaacaagcccacgcuggacaucgagcugcaaaagacagaggcaacacagcuagccacccugcggaaacuguguaucgagggcaaaaucacgaauauuacgacggacagccggugccccacccagggggaggccauacuacccgaagaacaggaccagaacuacguaugcaaacauacguacgucgaccgugggugggguaaugggugcggccuauucgguaagggcagucuugugaccugcgccaaguuccaguguuuagagagcaucgaggguaagguuguccagcacgagaaccugaaauacacagugaccauuacugugcacacuggggaccagcaccagguuggcaacgacacucagggggugaccgccgagauuacgccccaagcgucuaccguggaggcuauccugccagaguaugggacccucggguuagaaugcaguccgcggacaggccuugacuucaaugagaugauucuccugacaaugaagaacaaggccuggaugguacaccggcagugguucuucgaccuaccgcucccguggacgucgggugccauaaccgagaccccuaccuggaaccgcaaggagcugcuagucacguuuaaaaacgcccacgccaagaagcaggaagucguaguccucgggucacaggagggggccaugcauaccgcccugaccggggccacggagauccaaaacuccggcgggaccucaauuuucgcaggucaccugaaaugucggcuuaaaauggacaaacucgaacugaagggaauguccuacgcuaugugucucaacaccuucgucuugaaaaaggagguaagcgagacucagcauggcacaauccugaucaaaguagaguacaaaggcgaggacgccccgugcaaaaucccguucucgacagaggacgggcagggcaaagcgcacaacggcaggcugaucaccgccaaccccgucgugacaaaaaaggaggagcccgugaacaucgaggcugaacccccguucggggagucgaauaucgucaucgggaucggcgauaaagcccugaagauaaacugguacaagaagggaucguccauugggaaaauguucgaggcuacagccaggggcgcgcgccguauggccauccugggugacacggcaugggacuuugguagcguaggagggguucugaacucccucggcaagaugguacaccagaucuucggaagcgcguacacggcacuguucggagguguauccuggaucaugaagaucgggauuggaguucugcuaacguggaucggccuaaauuccaagaacaccuccaugagcuucagcuguaucgugaucggcaucaucacccuguacuuagggaccguuguucaagccgacaugggaugcgugauuaacuggaaagguaaggagcugaagugcgguagcggcauauuugugaccaacgagguucacaccuggacggagcaguacaaguuucaggcggacuccccuaagagacuggccaccgccaucgccggggccugggagaacggcgugugcgggauccgcucuaccacccggauggagaaccuccuauggaagcaaaucgccaaugaguugaacuauauucucugggagaacaauauaaaacugacaguggucguuggcgacaucaucggagugcuggagcaggggaagcgcacccucaccccccagccaauggagcugaaguacaguuggaagaccuggggcaaggccaagaucgugacugccgagauucagaacagcuccuucaucaucgacgggccgaauaccccagaaugccccagugcaucacgggccuggaacgucugggaggucgaggacuauggcuucggcgucuucaccaccaacauauggcugaaacuucgcgaggucuacacgcaaaccugcgaucaucggcucaugucugcagcgauaaaggacgagcgugcugugcacgccgacaugggcuacuggaucgagagccaaaagaacggguccuggaaacuggagaaggcgaguuucaucgaggugaagaccugcacguggccuaagucccacacccuuuggucgaacggcguccuggaguccgauaugauaauccccaagagccuggccggcccuaucucacaacacaaucaucguccuggguaccacacgcagacagcuggcccauggcacuugggcaagcuugagcuggacuuuaacuacugcgaaggaaccacuguggucaucaccgaaaacuguggcacccgggggcccagccuccgaaccaccacgguaucuggaaagcuaauacacgaguggugcugccgcucgugcacccuaccgcccuugagauauaugggggaagauggguguugguacgggauggagaucagaccgaucaacgaaaaggaagagaacaugguuaagagccuggucagcgcgggaaguggaaagguagacaauuucacaauggguguccugugccucgcaaucuuguucgaggaagugaugcggggcaaguucggcaagaagcacaugaucgcgggcguccuguugaccuucaugcuguuauuaagcgggcaaauaacauggcgcgacauggcgcacacccuuauaaugaucgguagcaacgccagugaccggauggguaugggagugacguaucuggcccucaucgccaccuucaagauacagcccuuccucgcuuuggguuucuuccuccgcaagcucacgucccgagagaaucuccuccugggcguaggucuggcaauggccaccacccuccagcuccccgaggacaucgagcaaauggccaacggaaucgcgcucgggcugauggcccuaaaacugaucacacaauucgagacuuaccagcucuggaccgcccucgucucccugacauguucaaacaccauauucacccucaccguagccuggcgcaccgccacccugauccuggcaggcgugucgcuccugcccgucugccaguccagcagcaugcgaaagacagacuggcugccgguagcaguggccgcaaugggggugccgccgcuaccccuguuuaucuuuucccuaaaggacacccuuaagagacgcagcuggccucugaacgagggcgugauggccgucggucugguauccauucucgcgaguucccugcugcggaaugacgugcccauggccgggccccuaguggccggcggguuacuaauugcuugcuacgucaucaccgguaccagcgcggacuugacgguggagaaggcggccgacguuacuugggaggaggaagcagagcagacuggugucucgcacaaucugaugaucaccguggacgaugacggcaccaugcgcaucaaggaugacgagaccgagaauaucuuaacuguccuacugaagaccgccuuguuaaucgucagcgggaucuuccccuauuccauaccugccacguugcuaguguggcacacguggcaaaagcagacgcaacggagcgggguccucugggacgugcccagcccucccgaaacacagaaagcugagcuggaagagggcguguaccgcaucaagcagcaggggauauucggcaagacucaggucggcgugggaguacagaaggagggcgucuuccauacgauguggcacgugacccgcggcgcgguccucacccauaacggcaaacgccucgaaccaaauugggcauccgucaagaaagaccugaucaguuacggaggcggcuggcggcugagcgcacaguggcagaagggcgaggagguccaagugaucgcggucgagcccggccggaaccccaagaacuuucagaccaugcccgggaucuuccaaacgaccacaggcgaaaucggggcuaucgcccuggacuuuaagccggggacgaguggcagcccaauuauugaccgggaggggaaggugguuggucucuacgggaacgguguugugacuaagaacgggggguauguaagcggcaucgcucaagccaaugcggagcccgacgguccgacucccgagcuggaggaggagauguucaagaaacgcaauuugaccaucauggaucuacaccccgguaguggcaagacacguaaguaccuacccgccauuguacgagaggccaucaagcggcgauugaggacauuaauccuggccccuacucgcguagucgcggcggaaauggaggaggcacuuaagggccuccccauacgauaccagacuacagccaccaaguccgaacauaccggccgcgagaucguugaccucaugugccacgccacuuuuaccaugagacugcucagcccgguucggguuccaaauuauaaccugauuauaauggacgaggcucacuucacggacccggccagcauugcagcaaggggcuacaucaguacccgcgucggcaugggggaggcggcugccaucuucaugacagccaccccgccaggaaccgcggaggcguuuccccaaucuaacgcgccgauccaggacgaggaaagagauauccccgaacggucauggaacagcggaaacgaauggaucaccgauuucgugggcaagaccgucugguucguacccagcauuaaggcgggcaacgauaucgccaauugucucagaaagaacgguaagaaggugauccagcuuagucggaagacauucgauaccgaguaccaaaagacaaagcuuaacgacugggacuucguggucacaaccgacaucuccgaaaugggcgccaauuucaaggcggaucgggugaucgacccccgacgcugucugaagccagugauccucacggacggccccgaaagagucaucuuagcgggucccaugcccgugacagcugcgagcgccgcccagcgccgggggcguguaggcaggaacccgcagaaagagaaugaucaauacaucuuuaccggucaaccccugaauaacgacgaagaccaugcucauuggacggaggccaagaugcuacucgacaauaucaacacucccgaagguaucauccccgcguuguucgagccggaacgagagaagagcgcugcgaucgauggcgaguaccggcucaaaggggagagccguaagacuuucgucgagcugaugcgucgcggcgaccuaccgguguggcuggcccacaagguagccuccgaagguaucaaguacaccgaccggaaguggugcuucgacggcgagcgcaacaaccaaauacuggaggagaacauggauguggaaaucuggacuaaagagggcgaaaggaagaagcugcggcccagguggcucgacgcccggaccuacucaaauccccuggccuugaaggaguuuaaggacuucgcggccggacguaagucgaucgcgcucgaccuagugacggagauuggccggguaccaucccaucuggcgcacagaacccgcaacgccuuagacaaccuagucaugcugcacaccuccgaacacggggggcgcgcguaucggcacgccguggaggaacucccugagaccauggagacgcugcugcuccugggacugaugauuuuacuuaccggcggcgcgaugcuguucuuaaucucugggaagggcaucgggaagaccagcauuggccugaucugcgucauugucucuagcggaaugcuuuggauggccgacgugccacuccaguggauagcaucagccauaguacuggaguuuuucaugauggugcuacucaucccugagccggagaagcagcgcacuccccaggacaaccagcuggcuuauguggucaucgggauacugacgcucgccgcgaucgucgcugccaaugagaugggccuccuggagacaaccaagcgcgaccuagguaugucaaaggagcccggcgugguguccccuacaagcuaucucgauguagaccuacaccccgccagcgcguggacguuauacgccguggcgaccacagucaucacccccaugcuacgccacacaauugagaacucgacggcgaacgugaguuuagccgccaucgcuaaucaggcgguggucuugauggggcuggacaagggguggccuauuuccaagauggaccugggggugccguuacuggcccuaggcuguuacucccaagugaaccccuuaacccugaccgccgcuguccugcuccuggugacccacuaugcuaucaucggcccaggucugcaggcaaaggccacccgagaggcucagaagcgcacugccgcgggaaucaugaagaacccaacuguugacgggauaaugacgaucgaucucgacccggugaucuacgacagcaaguucgagaagcagcugggccaagugaugcugcucgugcugugcgcgguccagcuccuuuugaugcggaccucuugggcccugugcgaagcccucacccuggccaccggccccaucacgacacugugggagggcuccccaggcaaguuuuggaacaccaccaucgcagucuccauggccaacaucuuccgcggaagcuaccucgccggggccggguuggccuucuccaucaugaagaguguuggcacgggcaagcgagggaccgggucucagggugaaacucugggcgaaaaguggaagaagaagcugaaccaguuaucacgcagggaguucgagcuguacaagaagagugggauaacggaggucgaccgcacggaggcgaaagaagggcucaagcgaggggagacgacgcaccacgcaguauccagagggagcgccaaacugcaaugguucguagagcggaauaugguuauccccgaaggccgcguaaucgaucuggguugcggccgggggggcugguccuacuacugcgccggucuaaagaagguaaccgaaguccggggguacaccaagggcgggccgggucacgaggagccugugcccaugagcaccuacggguggaacacagucaagcucaugucgggcaaagaugucuucuaucugcccccagaaaaaugcgacacacugcugugcgacauaggcgaaagcucccccucuccuacaguugaggagucccggacgauacggguauuaaaaauggucgagcccuggcugaagaauaaccaguucugcauaaagguacugaacccuuauaugcccaccgugaucgaacaucuggagagacuccagcggaagcacggcgggauguuagucagaaauccucuuaguagaaacucaacgcacgagauguauuggaucagcaacggcaccggaaauauaguguccuccgugaauaugguaagccgccuguugcuuaaucgguucacgaugacccaccgccgcccaacaaucgaaaaagacguggaccugggagccgggacccgacaugugaacgcggaaccggaaaccccgaacauggacguuauaggggagaggauuaagcguaucaaagaggaacacucgucgaccuggcacuaugaugacgaaaaucccuauaagacgugggccuaccacggaucauacgaggugaaagcaacaggcagugcuagcuccaugaucaacggcgucgugaagcuccugacuaagccaugggacguuguaccuaugguaacacagauggccaugacugacacuacgccuuucgggcagcaacggguguuuaaagagaaagucgacacucguacgccucggccgaugccaggcacccggaaggugauggagauuaccgcggaaugguuguggcggacacuggggcgcaacaagcgaccucggcugugcacccgagaggaguucaccaagaaagugaggacgaaugccgccaugggagccguuuuuaccgaggagaaucagugggaguccgcccgcgccgcgguugaagacgaggaauuuuggaagcugguggggcgggagcgcgagcuccacaagcugggcaagugugggucaugcgucuacaacaugaugggcaagcgggagaagaaauugggcgaguucgguaaggcaaagggcucucgugccaucugguacauguggcucggugcucgguaccuggaguucgaggcccuuggcuucuugaacgaagaucacugguucagcagagagaacagcuacucaggcguggaaggcgagggcuugcacaagcugggguacauucugcgggauaucuccaagauaccugggggggccauguacgccgacgacacugcuggcugggauaccagaauuaccgaggacgaccuccacaacgaggagaagauaacgcaacaaauggaccccgagcaccggcaacuggcgaacgcuaucuuuaaauugaccuaccagaacaagguggugaaggugcaacgacccacacccaagggcacggucauggacauaauuagucgaaaggaucagcgcgggucgggacaagucgggaccuacggccuaaacaccuucacgaacauggaggcccagcugauccgccaaauggaaggggaaggaguauuaagcaaggcugacuuggaaaacccccaucuccucgaaaagaaaauuacucaauggcuggagacgaagggcguagagcgccugaagcggauggccauuuccggcgaugauugcgucgugaagccgaucgaugaccgcuucgccaacgcccucuuggcccucaaugacaugggcaaggugaggaaagacaucccgcaguggcagcccucaaaggguuggcacgauuggcagcagguccccuucuguagccaucacuuucaugagcuuaucaugaaagacggccgcaagcugguugugcccugccguccccaggaugagcugaucggccgcgcccguaucucgcagggagccgguugguccuugaaggagaccgcguguuugggaaaggcguacgcccaaauguggagucucauguacuuccaccgccgcgaucugcggcuggcguccaacgcgaucugcagcgccgugcccguucauugggugccaacgucccgaaccaccuggagcauccacgcacaccaucaguggaugaccaccgaggacaugcugaccguuuggaaccgcguuuggaucgaagacaauccauggauggaggacaaaacgccuguaaccaccugggaagacguacccuaccugggcaagcgugaagaccaguggugcgguagcuuaaucggucugaccucccgggccacgugggcccagaacaucuugaccgcgauccagcaaguacgcagucuuaucggagacgaggaguuccucgacuacaugccgucuaugaagcgauuucgcaaggaggaggagucggaaggagcuaucugguga

SEQ ID NO: 26149 - RNA, 9873 nt, Artificial Sequence
  derived and/or modified CDS sequence (opt11) from DENV-3__KJ622196__SS-prME
acgucuuugugcuugaugaugaugcuccccgccacccuggcguuucaccuaaccagccgugauggggaaccccggaugauagucgguaagaacgaacggggcaagagccugcuguucaagaccgcgagcggcauuaauaugugcacccucaucgcaauggacuugggcgaaaugugcgacgacaccgugaccuacaagugcccccugauugccgaaguggagccggaagauaucgauugcuggugcaacuugaccuccaccuggguaaccuacgggacaugcaaccaggccggcgagcacaggcgcgacaagagauccguugcgcuugcgccgcacgugggcauggggcuggacacccggacccagaccuggaugucagccgagggugccuggagacagguggagaagguugaaacgugggcacuccgucaccccggguucaccauauuagcacuguuccuggcccacuacaucgguaccucccuuacccagaaggugguaaucuucauacuccucaugcugguuacgccgagcauggccaugcggugcgugggcguggguaaccgcgauuucgucgaggggcuguccggcgccaccuggguggacguggugcucgagcacgggggcugcgugaccacgauggcgaagaacaagccgacgcuagacaucgaacuccagaaaacagaggcuacacagcucgccacccugcggaagcugugcaucgagggcaaaauaacgaacaucacaaccgacagcagaugucccacucagggcgaagccauccugccggaggagcaagaccagaauuacgugugcaagcauacguacgucgaccguggguggggcaacgggugcggccuuuucgggaaggguucccuugugaccugcgcaaaguuccagugccucgagagcaucgaggggaaggugguccagcaugaaaaccugaaauacaccgugaccaucacgguacacaccggugaccagcaccagguuggcaacgacacccaaggggugaccgcggaaaucacgccucaggcguccaccguggaggcuauccugccggaguacgguacccuggggcuggagugcagcccccgaacuggccuggacuuuaacgagaugauccuccugaccaugaagaauaaagccuggauggugcaucggcaaugguuuuucgaucugccccuuccguggacgucaggcgccauaaccgagacgcccacguggaaucgcaaagaacuguuggugacuuucaagaaugcgcaugcgaagaagcaggagguggucgugcucgguagccaggagggcgccaugcauacugccuuaaccggggccaccgagauacaaaauuccggagggaccucuauauucgccgggcaccuuaaaugccggcucaagauggacaagcuagaacugaaaggcaugucauacgcgaugugccucaauaccuuuguccugaagaaagaaguuucggagacccagcacgggaccauucugaucaaaguggaauacaagggggaggacgccccaugcaagaucccguuuagcacggaggacgggcagggcaaagcccacaacggcaggcugaucaccgccaaccccgucgugacgaagaaggaggagcccgugaauaucgaagcggagcccccauucggggagaguaauaucgucaucgggaucggagauaaggccuugaagaucaacugguacaaaaaggguucuuccauugggaagauguucgaagcgaccgcccguggcgcgagacgcauggcgauccugggcgacacagcaugggauuucgggagcguuggcggugugcugaacucccucgggaagaugguucaucagaucuuugggucagccuacacagcccuguuuggcggcgucuccuggaucaugaagaucgggaucggcguacugcuuaccuggaucggguuaaauaguaagaacaccuccaugagcuuuagcugcauugugauuggcaucaucacgcuguaccucgggaccgugguucaggccgauaugggcugcgucauaaacuggaagggcaaagagcuaaaaugugguagcggaauuuucgugaccaacgaagugcacaccuggacggagcaguacaaguuccaggcggacucccccaagaggcuggccaccgccaucgcuggggcgugggaaaacggugucugcgggauacguagcaccacccggauggaaaaccuccuguggaagcagaucgcuaacgagcugaacuacauucucugggagaacaauauuaagcugacuguaguggucggcgacaucaucggcgugcuugagcaggggaagcgcacuuugacgccacagcccauggaguugaaauacuccuggaagaccuggggcaaggcgaaaaucgugaccgcagagauucagaacagcuccuucaucaucgaugggccgaacacccccgaaugucccuccgcaucccgcgcuuggaaugucugggagguggaggacuacggauucggcguuuucacgacaaacaucuggcuaaaacuaagagagguguacacgcagaccugugaucaccggcugaugagcgcugcuaucaaagaugaacgcgccgugcacgccgacaugggguacuggauagagagccagaagaauggguccuggaagcuggagaaggcgagcuuuauugaggugaagaccuguaccuggcccaagagccacacccucuggagcaacggggucuuagaguccgauaugauuauccccaagagccuggccggccccaucucacagcacaaccaucgucccggguaccacacccagaccgcgggcccauggcacuuaggcaagcuggagcuggauuucaacuacugugaagggacgacgguggugaucacggaaaacuguggcacccgggggccuucacuacggaccaccacagucuccggcaagcugauacaugaauggugcugucgaagcugcacccugcccccgcuacgguauaugggugaggacggcugcugguacggcauggagauucgaccaaucaacgagaaggaggagaacauggugaagucccuggucucggcaggguccggcaaggucgauaauuucacgaugggcgugcugugccucgccauccuauucgaggaggugaugcggggcaaauuugggaagaagcauaugaucgcggggguauuacucaccuucaugcuuuuacuaagcggccagauaacguggcgcgauauggcgcacaccuuaauaaugauagggagcaacgccagcgaccggaugggcaugggggugaccuaccuggcucucauagccaccuuuaagauccaacccuuucuagcgcugggauucuucuuaaggaagcugacgucccgggaaaaccugcuccuggguguugggcuagcuauggccacaaccuuacaguugccugaggacaucgaacagauggccaacggcaucgcuuuaggguuaauggcccugaagcugauuacccaguuugagacguaccaacuauggaccgcgcuagucucccugacaugcagcaacacgauuuucacucuaaccguagccuggcgcacggccacgcuuaucuuggcgggaguuucccuccuacccgucugucagagcaguaguaugcggaagacggacuggcuaccaguggcaguggccgcgaugggggugccgccccucccccuguucaucuucuccuugaaggacacccucaaacgcagaucuuggccgcugaacgaaggcgugauggcugucggauuaguuucgauccucgcgagcucacugcugcggaacgacgucccuauggcgggcccguuggucgccggcgggcuccugauagccuguuacguuaucaccgggacaagugcugaucucacuguugagaaggcggccgacgugacuugggaggaggaggccgagcagacaggggugucccauaaucugaugauaaccguagacgacgacgguacgaugcgcauaaaagacgacgagacggagaauauccugacuguccuucugaagaccgcccuccucaucgugagugggauuuucccuuauuccaucccagccacacuucuggucuggcacacuuggcagaagcaaacccaacggucugggguccucugggauguacccagcccgccagaaacccagaaggcagaacuggaggaggguguguaccggauuaagcagcaagggauuuucggcaagacccaagucgggguaggcgugcaaaaggagggugucuuccauacgauguggcacgucacgcgcggggccgugcuaacccauaacggcaagcgccuggagcccaacugggccuccgucaaaaaggaccugaucaguuacgggggcggcuggcggcugagugcccaguggcaaaagggagaggagguccagguaaucgcggucgagccaggccgcaacccgaagaauuuucagaccaugcccggaaucuuccagacgaccaccggcgaaaucggggcuaucgcccuggacuuuaagccggggaccucgggcagccccaucaucaaucgggaggggaaaguggucggccucuacgggaacggcguggugacgaagaacggaggguacgugagcggcauagcccaggccaaugcggaacccgacggaccuaccccagagcuggaggaggagauguucaagaagaggaaccuuaccaucauggauuugcaccccggcaguggaaaaacccggaaguaccugcccgccauuguccgugaagccauuaagaggcgucugcggacauugauccuagcccccacaagagucguugccgcugagauggaggaggcccugaagggccucccaauccgauaucagaccacugcgaccaagucugagcacaccggucgcgagauagucgauuuaaugugucaugccaccuuuaccaugcgguuacucagccccgugcgcgugcccaacuacaaucugaucaucauggaugaagcucauuuuacggauccagcuucaauagccgccagaggguacauuucgacucgcguggggaugggggaggccgcugccaucuucaugaccgcaacuccucccggcacggccgaggccuucccacaguccaacgcgccgauccaggaugaggaacgcgacauccccgaacggaguuggaacagcgggaacgaguggaucaccgacuucgugggcaaaacggugugguuugugccuucaauuaaggccgggaacgauaucgcaaacugccugcgcaagaacggcaagaaggucauacagcuuagccguaaaaccuucgacacggaguaucagaagaccaagcugaacgacugggacuucguggugacaaccgauauuuccgagaugggcgcgaauuucaaagccgaccgcgugauugacccccggcgcugccugaaaccggugauacucacggacgggcccgagcgggucauucuggcaggccccaugcccgucaccgccgccagcgccgcgcaacgcagaggccgagugggccggaacccgcagaaggaaaacgaccaguauauuuucaccggccagccccugaacaacgaugaggaccacgcgcacuggaccgaggccaagaugcucuuggacaauauaaacacaccugaaggcauaaucccggcacuguucgagccggagagggagaaauccgcagcgauugacggcgaguauaggcuuaagggggagucucgcaaaacguucgucgagcuuaugcggcgcggcgacuuaccuguguggcucgcccauaagguagccucagaggggauuaaguacaccgaucggaaguggugcuucgacggugagcgcaauaaccaaauccuggaggagaacauggacguggagaucuggacgaaagaaggagagcgcaagaaacuucgcccccgcuggcucgaugcccggaccuacucuaacccccuggcacuuaaagaguuuaaggauuucgcggccgggagaaaaagcaucgcccucgaccuggucacggagaucggacgggucccuagccaucuagcucaccgcacucgcaacgcucucgacaaccuggugauguugcauacuuccgagcacgguggaagggcguauaggcacgccguggaggagcuccccgagaccauggaaacucuucugcuccuuggacugaugauacuccuaaccggcggggccaugcuuuuucugaucuccgggaagggcauagguaaaaccuccaucggccugauauguguaaucguguccucagguaugcuguggauggccgacgugccccuccaguggaucgccagcgcgaucguccuugaguucuucaugauggugcuccugauuccggagcccgagaagcagcgcacuccucaggacaaccagcucgccuacguggugaucggcauccugacgcucgcggccaucguggccgcgaaugagaugggucuacuggagaccaccaagcgugaccucggcaugagcaaggagccgggcgucgucucaccgaccagcuaccuggauguggaucugcaucccgccuccgcauggacucucuacgcuguugcuaccacagucauaacccccaugcugcgccacacgaucgaaaacagcaccgccaaugucagccuagcagcgauugccaaccaggcggugguccucauggggcuggacaagggcuggcccauaagcaagauggaccugggugugccgcuccuggcccuggguugcuacucccaggucaacccccucacccugaccgccgccgugcugcuacucguuacacacuacgcgauaaucggccccggacugcaggcgaaggcaacccgggaagcccaaaagcgcaccgcagccggcaucaugaaaaacccgacuguugaugggauaaugacgaucgacuuagauccggugaucuacgauagcaaguucgagaaacaacuaggccaagugaugcugcuaguccuuugcgcgguacagcuucuccugaugcggacgucgugggcccugugcgaagcccugacgcuggcgacgggcccuaucacaacgcugugggaggggagcccaggcaaguucuggaacaccaccauugcgguguccauggcaaauauauucagaggguccuaucucgccggugcugggcuggcauuuuccaucaugaaguccguaggcacgggcaagcggggcaccggcucccagggggagacucuuggcgagaaguggaaaaagaagcuaaaccagcugagccgccgggaguucgagcucuacaaaaagucugggauaaccgagguagauagaacagaggcgaaggaaggucucaagcggggcgagacaacccaucaugccgugucccgggggagcgccaaguuacagugguucguggagcggaacauggucauccccgaaggccgcgugaucgaucuugggugcggccgcgggggcuggucguauuacugcgccggccucaagaaggugaccgagguccggggguauaccaaaggagggccuggccacgaggagcccguccccaugucgacguacggauggaauacgguuaagcugauguccggcaaggacguauucuaccucccgcccgagaagugugacaccuuacucugugacauaggggagagcucccccuccccuacaguugaagagucccguacgauccggguucucaagauggucgagcccuggcucaaaaacaaccaguucugcaucaaggugcucaacccguacaugccgaccgugauugaacaccucgagaggcuccagcguaagcacgggggcaugcuggugcggaacccgcuaagccguaauucuacucaugagauguacuggaucagcaaugggaccgggaauaucgugucaagcgugaauauggugagccgccugcucuugaacagguucaccaugacccaccgccgacccaccaucgagaaggacguggaccugggugcugggacccgccacgucaaugcugagccggaaacccccaacauggacgugauaggugagcggauaaagcgcaucaaggaagaacacagcuccaccuggcacuacgacgacgaaaacccauauaaaaccugggccuaccacgguagcuaugaagugaaggccacuggcuccgccagcagcaugauaaauggcgucgugaagcuauugacaaagccgugggacguggucccgauggucacccacauggcaaugaccgacaccacgcccuucggccagcagcggguguucaaagaaaaagucgacacccgcacgccacgaccgaugcccgguacccgcaagguaauggagaucaccgcggaauggcuguggcggacguuaggcagaaacaagcgcccccggcuguguaccagagaagaguucaccaagaagguccggacgaacgcugccaugggcgcaguauuuaccgaggagaaccagugggaaucugcgcgcgccgccguggaagacgaggaguucuggaagcuggugggacgggaacgcgaguuacacaagcuggguaagugcgggagcugcgucuacaacaugaugggcaaacgggaaaagaaguuaggcgaguucggcaaggccaaggguucccgcgccauaugguacauguggcucggggcgcgguaucuagaguucgaggcccugggcuuccucaacgaagaccauugguucagccgcgagaacuccuauagcgguguggaaggcgagggccugcacaagcugggguacauccuacgagacaucaguaagauccccggcggggcaauguacgccgaugauaccgcuggcugggacacacggaucacggaggacgaccugcacaaugaagagaagauuacacagcagauggacccggagcaccgucaacuggcgaacgccauauucaaacuuacauaccagaacaaggugguuaaggugcagcgccccacgcccaagggcacggugauggacauuauuagccggaaggaccagagggggagcggucaagucgggaccuacgggcugaacacuuucaccaacauggaggcucaguuaaucaggcagauggagggcgagggggugcucagcaaggcagaccuugaaaacccccaccuccucgagaagaagaucacccaauggcuggagacgaagggcguagagcgccugaaaaggauggccauaaguggggacgacugugucgucaagccaaucgaugaucgcuucgcgaacgcucuccuggcccuuaacgacaugggcaaggugcggaaagacaucccacaguggcagcccagcaagggguggcacgacuggcagcaaguacccuucuguucgcaucacuuccacgaacucauuaugaaagacgggcgcaaguuagugguaccaugccgcccccaggacgagcugaucgggcgugcccgcaucucccagggcgccggcuggucccucaaggagaccgccugccuggggaaggccuaugcccagauguggucgcuuauguacuuccaccggcgcgaucucaggcuggcguccaacgccauuugcagcgccgucccaguacacugggugcccaccuccaggaccaccuggagcauccacgcucaccaucaguggaugacgaccgaggauaugcugaccgucuggaacaggguguggauugaagauaauccguggauggaggacaagacgccaguuaccaccugggaggaugugcccuaccuagggaagagagaggaccaauggugcgguagucugaucggguugacgucgcgggccacgugggcccagaacauccucaccgcgauccaacagguucgcagcuugaucggcgacgaggaguuccuggacuacaugcccucgaugaagcgguucaggaaggaggaagaauccgagggagccaucugguag

SEQ ID NO: 26150 - RNA, 9873 nt, Artificial Sequence
  derived and/or modified CDS sequence (opt11) from DENV-3__KJ830751__SS-prME
accagccugugccucaugaugauccugcccgccgcccucgcguuccaccucaccagccgggacggagagccgcguaugaucguggggaagaacgaacggggcaagagccuguuauuuaagacggccagcgggauuaacauguguacccucaucgccauggaucugggcgagaugugcgacgacaccgugacuuacaagugcccacacaucacggagguggaacccgaagacaucgacuguuggugcaaccuuaccagcaccugggugacuuacgggacgugcaaccaggcgggcgagcaccggcgcgacaaacgguccgucgcacuugcgccccacgugggaaugggguuggacacgcgcacccagaccuggauguccgccgagggcgcguggcgccagguggagaaggucgagacgugggcccugcgccacccgggguucaccauuuuggcgcuguuccuggcccacuacaucggcaccucccucacccagaaggugguuaucuucauccugcugaugcuugucacgccaagcaugaccaugcggugcguaggggucgggaaccgcgacuucgucgagggccuguccggggcaaccuggguggacguggugcuggagcacggcgggugugucaccacgauggccaagaacaagcccacccucgacaucgagcugcaaaagaccgaggccacccagcuggcgacgcuccgcaagcugugcaucgaagggaagaucaccaacaucacuaccgacagccgcugccccacgcagggagaggccguucucccggaagagcaggaccagaacuacgucugcaagcacaccuacguggaccgcggguggggcaaugggugcggauuguuugggaagggcucccuggugacuugugccaaauuucagugccuggagcccauagagggcaaggucgugcaguacgagaaccucaaguauacugugaucaucaccguccacacuggggaccagcaccagguggggaacgagacccagggggucaccgcggagaucacgccccaggccagcaccaccgaggccauucugccugaguacggcaccuuagggcucgagugcuccccgcggacgggcuuagacuucaacgagaugauccugcucacgaugaagaacaaggccuggauggugcaccggcagugguucuucgaccugccccugcccugggccaguggcgccacuaccgagacgcccacuuggaaucgcaaagagcuccuggugaccuuuaaaaacgcccacgcgaagaagcaagaagucgucguuuuggggucccaggagggcgccaugcacaccgcccuaacuggggccacggaaauccagaacucaggcgggaccuccaucuuugcgggccaccugaaaugccggcugaagauggacaagcucgagcugaagggcaugagcuaugcgaugugcaccaacaccuucguccugaagaaggaggugagcgagacgcagcacgggaccauccugaucaagguggaguauaaaggggaggaugccccgugcaagauccccuucagcaccgaggacggacagggaaaagcccacaacggccgccugaucacugccaaccccgucgugacgaagaaagaagagcccgugaacaucgaggcggaaccgcccuucggagagucuaauaucgucaucggcaucggggacaacgcccugaagauaaacugguacaagaagggcuccagcaucgggaagauguuugaggccacagccagaggagcccgccggauggcuauccuaggugacaccgccugggacuuuggguccgugggcggggugcugaacagccugggcaagaugguacaucaaaucuucggguccgcuuacaccgcccuguuuagcggcguuaguugggugaugaagaucggcaucgguguccuccucacauggaucggccugaauagcaagaacacauccaugagcuucuccugcaucgcgaucgggaucaucacccucuaccucggcgcuguggugcaggccgacauggggugcgucaucaacuggaaagguaaggagcugaagugcgguucagggaucuucgucaccaacgaggugcacacguggaccgagcaguacaaguuccaggccgauucgccgaagcgccucgcuaccgcgaucgcgggagcuugggagaauggggucugcggcauccguagcacuacgaggauggagaaucugcuguggaagcagauugccaacgagcucaacuauauccugugggagaacaauaucaaacucaccgugguagucggggacacuauaggcgugcuggagcagggcaagcgcacccugacgccccagccaauggagcugaaguacuccuggaagaccugggggaaagccaagauugugaccgcagagacccaaaacagcaguuucaucaucgacggccccaauacgccggagugucccagcgcguccagagcuuggaacgucugggagguggaggacuacggguucggcguguucaccacaaacaucuggcucaagcugcgggaggucuacacccagcugugcgaucaccggcugaugagcgccgcggugaaggaugagcgcgcggugcacgccgacaugggcuauuggaucgaaucucagaagaacggguccuggaagcuggagaaggccucacugauugaggucaagaccuguacguggccaaagucccacacccucuggucaaauggugugcuggagagugacaugaucaucccaaagagccuggccgggcccaucucacagcacaacuaccggccgggcuaccacacgcagaccgccggccccuggcaucucgggaagcuggagcucgacuuuaacuacugcgaaggcacgaccguggucauaaccgagagcugcgggacccgcggccccucccuccggaccaccaccguguccgggaaguugauccacgaguggugcugccgguccugcacccugcccccucucagguacaugggcgaagacgggugcugguacggaauggaaauacgcccaauaagcgaaaaagaggagaauauggugaagucccuggugagcgcaggcuccgguaagguggacaauuucacgaugggcgugcugugccucgccauucuguaugaagaggucaugcgagggaaguuuggcaagaaacacaugaucgccggcgucuucuucaccuucguccugcucuugagcggccagaucacguggaggaacauggcacacacccugaucaugauaggcucaaacgccagcgaccggauggggaugggugucacauaucucgcgcugaucgcgacguucaagauucagcccuuccuggcccucggguuuuuccugcgcaagcugaccagccgggagaaccuccugcugggcgugggcuuagccauggcgaccacucugcaacugcccgacgacaucgaacaaauggccaaugggaucgcccucggcuugauggcccugaagcucaucacccaguucgagaccuaucagcucuggacugcccuggugucccucacgugcagcaacacaauguucacccugacuguagcuuggagaacggccacccugauccuugccggggugucccuacugccggugugccagagcuccagcaugcggaaaacugauuggcuccccauggcaguugccgcgaugggugugccgccccugccgcuguucaucuucaaccucaaggauacccugaagcgccgcuccuggccccugaacgaaggggucauggccgucggccucguguccauccuggcauccagccugcuccgcaaugacguuccaauggccggaccguuaguggccggaggccugcucaucgcgugcuacgugauaacgggcaccuccgcggaucuuaccguggagaaggccgccgauguuacuugggaggaagaggccgagcagacgggugugucgcacaaccuaaugaucaccgucgacgaugaugggaccaugcgcauaaaggacgacgagaucgagaacauccucaccguccuacugaagaccgcgcuguugaucgugucugguaucuucccauacagcauccccgccacucugcuugucuggcacaccuggcagaagcagacccaacgguccggcgugcugugggacgugcccagcccgccagaaacucagaaggccgaacuggaggagggugucuaccgcaucaaacagcagggcaucuucgggaagacccaggugggcguggggguucagaaggagggcguguuccacacuauguggcacgugacacggggcgccguccucacccacaacgggaagcgccucgagcccaacugggcguccgugaaaaaggaccugauaagcuacggcgggggauggcggcucuccgcgcaguggcagaagggggaggaggugcaggucaucgccguugagcccggcaagaaccccaagaauuuccagacgaugcccggcaccuuccagacgacaacgggagagaucggagcgaucgcucuggacuucaagcccgggaccagcggcagccccaucaucaaccgcgaagggaaaguggucgggcuguauggcaacggggugguuaccaagaacggcggcuauguauccggcaucgcgcaaaccaacgccgagccagacggcccuacgccagagcuggaggaagagauguucaagaagcggaaccucacgauuauggacuugcacccgggcagcggcaaaacccgcaaguaccugccagccaucguacgggaggccaucaagcgucggcuccgcacccugauccuggcccccacgcguguugucgcggccgagauggaggaggcgcuaaaggguuugcccaucagauaccagaccaccgccaccaaguccgagcacacgggcagggagaucgucgaucugaugugccacgccaccuucacaaugcgccuccugucucccguccgggucccgaauuacaaccugauaaucauggaugaggcgcacuucaccgaucccgccuccauagccgcccggggguacaucucuacgcgggugggcaugggggaagcagcugccaucuucaugaccgccacgccgccagggaccgccgaugcguuuccgcagucaaacgcccccauccaggacgaagagcgcgacauccccgagcguagcuggaacuccggcaacgaauggaucacagacuuugccgggaagacggucugguucguccccucgaucaaggccggcaacgacauagccaacugccuccggaagaacgggaagaaggugauccagcuuagccgcaagacauucgacaccgaauaccagaagacgaaacugaacgacugggacuucguggucaccacggacauuagcgagaugggcgcgaacuucaaagccgaucggguuaucgacccgcgccggugccucaagcccguaaucuugaccgacggucccgagcgcgucauccuggcugggccuaugccgguuacggccgccucagcggcccagcggcgcggccggguagggaggaacccccagaaggagaacgaccaguacaucuucaccggccagccccuaaacaacgacgaggaccaugcgcacuggaccgaagcaaagaugcuguuggauaacauaaacacucccgagggaauccugccggcgcuauucgagcccgagcgugagaaguccgccgcuaucgacggcgaguaccgccugaagggcgagucccggaagaccuucgucgagcuaaugcgcagaggggaucugcccgucuggcuggcccacaaagucgcuagcgagggcaucaaauacacagaccgcaaauggugcuucgacgggcagcggaauaaccagaucuuggaggagaacauggacguggagauauggacaaaggagggcgagaagaagaagcuucgcccccgguggcuggacgcgaggaccuacucugacccguuagcucuuaaagaauuuaaagacuucgcggccggccgcaagagcaucgcgcuggaccucguaaccgagaucgggcgagucccaucccaucuggcucaccgcacgaggaacgcccuggacaaucucgugaugcugcacaccagcgaacacggcgggcgggccuaccggcacgccguggaggagcugccugagaccauggagacucuguuguuacucggccugaugauccugcucaccggcggggccaugcuguuccugaucucuggcaaggggaucggcaagaccuccaucggacuuaucugcgucaucgcgagcuccggcaugcuguggauggcagaggugccgcugcaauggaucgccagcgcgaucgugcucgaauucuucaugaugguccugcugauccccgagcccgaaaagcagcgaacgccccaggacaaccagcuagccuacguggugaucgggaucuugacccuggccgcgaucaucgccgcaaacgaaaugggccuuuuagagacgacgaagcgggaccugggcauguccaaggagcccggcgucgugagccccaccuccuaccucgacguggaccugcaccccgcgagcgccuggacccuguacgccguugccacuacggugauuacccccaugcuccgccacaccauagaaaacuccacagccaacgugagccuagcggccaucgccaaccaggcagucgugcuuaugggccucgacaagggguggccgaucuccaagauggaccugggcgugccccuguuggcccugggaugcuacagccaagucaacccacugacccucacggcggccguguugcugcucaucacccacuacgcuauaaucggcccugggcugcaggccaaggccacgcgcgaggcucagaagcgcaccgccgcugggaucaugaagaacccgacaguggacggcaucaugaccaucgaccuggaccccguaaucuacgauuccaaguucgaaaagcaacucggccagguuaugcugcuggugcucugcgccguccagcugcugcucaugcggacgagcugggcgcugugcgaggcccugacccucgcaaccggccccaucaccacgcucugggagggcucccccgggaaguucuggaacaccaccauugccgugucgauggccaauaucuucagaggcuccuaccucgcgggggccggccucgccuucucaaucaugaaguccguggggaccggcaagcggggcacggggagccagggcgaaacacuuggggagaaauggaagaagaagcugaaucagcucucucgcaaggaguucgaccuguacaagaaguccggcauaaccgagguugaucggaccgaagccaaggaagggcugaagcgcggcgagaccacgcaucaugccgugagccggggcagcgcgaaacuccaaugguucguggagaggaacauggucguuccggaagggcgggucaucgaccugggcugcgggcgcggaggguggagcuacuacugugccggccucaaaaaggugacagaagugcggggcuacacuaaaggagggcccgggcacgaggagcccgugcccaugucuaccuacggcuggaacaucgucaaguugaugagcgggaaggacguguucuaccugccgcccgagaagugcgacacgcugcugugcgacaucggcgaguccucgcccuccccaaccguagaggagagccgcaccauccgcguucucaaaaugguggagccguggcugaagaacaaccaguucugcaucaagguucugaacccguacaugcccaccgucauugaacaucucgagcggcugcaacgcaagcacggcgggaugcuggugagaaacccccuuucccgcaacagcacccacgaaauguacuggauuucuaacggcaccgggaacauuguaagcuccgucaacauggugucacggcugcugcucaaccgcuucacuaugacccaccggcggccgacgaucgaaaaggacguggaccugggcgccggcacccgacacguaaacgccgagcccgagacccccaacauggacgugaucggggagcgcaucaaaaggaucaaagaggagcauaacuccaccuggcacuacgacgacgagaacccauacaaaacgugggccuaucacggcagcuaugaggucaaggcuaccggauccgccagcaguaugaucaacggcguggugaagcuguugaccaagcccugggacgucgugcccauggucacccagauggccaugacggacaccacaccauucgggcaacagcgcguguucaaggagaagguggacacccggacgccccgccccaugcccggcacccggaaggugauggagauaaccgccgaauggcuguggagaacccugggccggaacaagcgaccccggcucugcacccgcgaggaguucaccaagaagguccgcaccaacgcggccaugggagccguguucaccgaggagaaccagugggacuccgccaaggccgcaguggaagacgaggaguuuuggaagcuggucgaccgggagcgcgagcugcacaaguuaggcaaaugcggcagcuguguuuauaacaugaugggcaagcgggagaagaagcugggugaauucggcaaggccaagggcucccgcgccaucugguauauguggcucggggcccgguaccucgaguuugaggcccugggcuuccucaacgaggaccacugguuuagccgcgagaacuccuacagcgggguggagggcgaggggcuccacaagcugggguacauucugcgggacaucucgaagaucccuggcggggcgauguacgccgacgauacggccggcugggacacccgcaucaccgaggaugaccuccacaaugaggagaagaucauccaacagauggaucccgagcaccgccagcucgcaaacgcgaucuucaagcuaaccuaccagaacaaggucguaaagguucagcgccccacgcccaccgggacaguaauggacaucaucagccggaaggaccagcgcggcuccggccaagucggaaccuacggccucaacacuuucacgaacauggaggcgcagcugguucggcagauggagggggagggcguccugaccaaagccgaccucgagaacagccaccuccccgagaagaagaucacucaguggcuggagaccaaggggguggagaggcugaagcggauggcaaucuccggggaugacuguguggucaagcccaucgacgaccgcuucgccaacgcccugguagcgcugaacgacaugggaaaggugcgaaaggacaucccccaguggcagcccagccgcggguggcacgauuggcagcaggucccguucugcucccaccacuuccacgagcucaucaugaaggacggccggaagcugguggucccgugccggccccaggacgagcugaucgggcgggccaggaucagccaaggcgccggguggucccuccgcgagacggccugccugggcaaggccuacgcccagauguggagccugauguacuuucaccggcgcgaccuccgucuggcuucaaaugccaucugcagcgccguccccgugcacugggugccgaccucuagaaccaccuggucuauccacgcccaccaccaguggaugacgaccgaagacauguuaaccgucuggaaccggguguggaucgaggagaacccguggauggaggacaaaacccccgugacgacuugggagaacguacccuaccucggcaagcgcgaggaccaguggugcgggagccugaucggccugaccagcagggccaccugggcgcagaauaucccgacagccauccagcagguccgcagccucaucgggaacgaggaauuccuggacuacaugccuucuaugaaacgguuccgcaaagaggaggaguccgagggugccauaugguga

SEQ ID NO: 26151 - RNA, 9873 nt, Artificial Sequence
  derived and/or modified CDS sequence (opt11) from DENV-3__KC762681__SS-prME
acaucgcugugcuuaaugaugaugcugcccgcaacccucgccuuccaucucaccucccgcgacggcgaaccccggaugaucguggggaaaaacgagcgcggcaaauccuuacuguucaaaaccgcguccgggaucaacauguguacucucauagccauggaccugggcgaaaugugugacgacacugugacauacaagugcccccuaaucacugagguggagccugaggacaucgacugcuggugcaaccucaccagcaccugggugaccuacgggacguguaaccaggcaggggaacaccggcgcgauaagcggaguguggcccuggcgccccacguugggauggggcuggacacccgcacccagacauggaugagcgcggaaggcgcuuggcggcaagucgaaaaagucgagaccugggccuuucgccaccccggguuuacuauccucgcccuguuccuugcucauuacaucggcaccucccucacgcagaaaguugugauuuuuauccuauugauguuggucacacccucgaugacgaugagaugcgugggggugggcaaucgcgacuucguggagggcuuaucaggggccaccuggguggacguagugcuggagcacggcggcugcguaacgaccauggcgaagaacaagcccacccucgacaucgagcugcaaaagacggaagccacacagcuggcgacccuccgaaagcugugcauagagggcaaaaucaccaacgugaccacggacagccgcugccccacccagggcgaggcgauuuuaccugaagaacaggaccagaacuacgucugcaagcauaccuacgucgacagaggcuggggcaacggauguggccuuuucgggaagggcucccuggugaccugcgccaaguuccagugccuugaguuuauugagggcaaaguaguacagcacgagaaccucaaguauacggugaucaucaccguccacacgggggaccagcaccaggugggcaacgagacccagggggucacggcggaaaucacgccgcaagccagcaccguggaggccauccuuccggaguauggcacccuggggcucgagugcagcccccgcaccggccuggacuucaacgagaugauccuccucacgaugaagaauaaggcguggauggugcaccggcaaugguucuucgaucugccguuacccuggacaagcggcgcaacaaccgagacacccaccuggaacaagaaggagcuccucguuaccuucaagaacgcccacgccaagaaacaggaggucgucguccuggguagccaggagggagcgaugcacacagcgcuuacgggggccaccgagauucagaccagcggcgggacgucgaucuuugccggccaucugaagugccgccugaaaauggacaagcucgagcugaaaggcaugucuuacgcgaugugccugaacgccuucguacucaagaaagagguguccgagacgcagcacgggacuauucugaucaaggucgaauacaagggcgaggacgccccgugcaaaaucccguucuccaccgaggaugggcagggcaaagcccacaacggccgguugauuaccgcgaacccaguugugacgaagaaggaagaacccgucaacauagaggcagagcccccguucggggaaagcaacauagugauaggcaucggggacaaggcacugaagaucaacugguacaagaaagguuccuccaucgggaagauguuugaggccaccgcccgcggagcccgucgcauggccauccucggugacacagcgugggauuucggcuccgugggcgguguccugaacagccugggcaagaugguucaccaaaucuucgguuccgccuacaccgcucucuucagcgguguguccuggauuaugaaaaucgggauagggguccugcugacguggaucggcuugaacagcaagaacaccucuaugagcuuuuccuguaucgugaucgggaucaucaccuuauaucugggcgcagugguccaggcggacauggggugcgugaucaacuggaaaggcaaggagcucaagugcggcagcgggaucuucguaaccaaugagguccacacguggaccgagcaauacaaguuccaagcggauuccccuaagcggcuggcuaccgcgaucgccggcgccugggagaacggggugugcggcauacgcucaacgacucguauggagaaccugcucuggaagcagaucgcgaacgagcugaacuacaucuuaugggagaacaacaucaaguuaaccguggucgugggcgauauaaucggcgugcuggagcagggcaagcgcacccugacgccccagccuauggaccucaaguauuccuggaagacaugggggaaagcaaagaucgucaccgccgaaacccagaacagcuccuucauaaucgacgguccgaacacacccgagugccccagcgccuccagggcguggaauguuugggagguggaggacuacggguucggcgucuucacgacuaacaucuggcugaaacugcgggagauguacacccaacucugcgaucaccgacugaugagcgcugccgugaaggacgagcgggccgugcacgcagauaugggcuauuggaucgagagccagaagaacgggucguggaaguuagaaaaggcgucucucauagaagucaagacuuguacguggcccaagucccacacguugugguccaacggcguacuagaguccgacaugauaauccccaagucgcucgcaggacccguuucccagcauaacuaccggcccggauaucacacgcagaccgccgggccguggcacuuagggaagcucgagcucgacuucaacuauugcgagggcaccacgguggugaucaccgagaacugcgggacccgggggccuagccugcgaaccacgaccguuuccgggaaacuuauacacgaguggugcugcaggagcugcacccugccgccccuccgcuacaugggggaagacgggugcugguacggcauggagauccggccgaucaacgagaaggaggagaacauggucaagucccuggugagcgcgggcucaggaaagguugacaacuucacuauggguguccucugccuggcaauccuguucgaggagguaaugcgcgggaaguucggcaagaagcacaugaucgcggggguccuguuuacguucguccuguuacucuccggacagaucacguggcgggacauggcccgcacccugaucaugaucggcucgaacgcaagcgaccguauggguaugggcgugaccuaccucgcccuaauugcaacguucaaaauccaacccuuccuggcgcuaggguuuuuccuccguaagcugaccucccgggagaaccuccuccugggcgugggccuggcaauggcuaccacacugcagcuacccgaagacaucgagcagauggccaacgggaucgcgcuuggacucauggcccugaagcuaauaacccaauucgagacauaccagcuuuggaccgcguuagucagccugaugugcagcaacaccauguucacacugaccguggccuggcgcaccgcuacacugauccuggccgggaucucguuacugcccgucugccagagcuccagcaugcgcaagacggacuggcugccggugaccguagcugccaugggcgugccgccccucccgcuguucaucuucucccugaaggauacccucaagaggcguagcuggccgcugaacgagggcguuauggccguaggccuggucucaauccuagccagcagccuccugcggaaugacgugcccauggcggggccccucguggccggugggcugcuuauagccugcuacgucaucaccgggacuagcgccgaccucaccguggagaaggccgcggacgugaucugggaggaggaggccgaacagaccggugucucacacaaccugaugaucaccguggacgacgacgggacgaugcggaucaaggacgaugagacagaaaacauuuugaccgugcuccugaaaaccgcccugcucaucguaucuggcaucuuccccuacuccaucccggccacacugcugguguggcacacguggcagaagcagacccagcggagcggcgugcucugggacguccccagcccgccugagacccagaaagccgagcuggaggaggggguguaccgcauuaagcagcagggcaucuucgggaagacccaaguggguguagggguccagaaggagggcguguuucacacuauguggcacgucacccggggcgcuguacugacccacaacgggaagcgccucgagccgaauugggccagcgucaaaaaggaucugaucucauaugggggcggguggcgccugucggcccaguggcaaaagggggaggagguucaagugaucgccguggaacccggcaaaaacccgaaaaacuuccagaccaugccgggcaucuuccagacuaccaccggggagauuggcgcgaucgccuuagacuucaagccaggcaccuccggcagucccaucaucaaccgggagggcaaggugguggggcuuuacggcaacggggucgucaccaaaaacggaggguacgucagcgguaucgcucagacuaaugccgaaccggacggcccgacaccagagcuagaggaggagauguuuaagaagcggaaccugaccaucauggaccuccaccccggguccggcaagacgcgcaaguaccugcccgccauaguccgggaggcgaucaaacgccggcugcgcacccuuaucuuggccccgacgcgcgucguggccgcggagauggaggaggcccugaaggggcucccuauccgcuaccagaccaccgcgaccaaaagcgcgcacacuggcaaagagaucguagaccugaugugccacgccaccuuuacaaugcgacugcucucucccguccgcgugcccaacuacaaccugaucaucauggacgaggcccauuucaccgauccggccagcaucgcggccaggggguacaucuccacccgcgugggcaugggggaagcggcugcgaucuuuaugaccgccacgccgcccgggaccgccgacgccuucccccaaucgaacgcccccauucaggaugaggagcgggacaucccggagcgcuccuggaacagcggcaacgaguggaucaccgacuucgcggggaaaaccguaugguuugugccauccauuaaggccggcaacgacaucgccaauugccugcgcaaaaacgggaagaaggugauucagcuaagccgaaagacguucgacaccgaguaccagaagacuaagcugaacgacugggacuuugucgugacuacggacaucucugaaaugggcgcaaacuucaaaaccgaucgcgugauagauccccggcgcugcuuaaagccgguaauccucaccgacggcccggagcgcgugauucuggcugggcccaugccuguuaccguagcguccgccgcacagcgucggggccgcguggggcggaacccgcagaaggagaacgaccaguacaucuucacgggccaaccccugaacaacgaugaggaccaugcccacuggaccgaggccaagaugcuccuggacaacaucaauacccccgaagguaucauaccggcguuauucgagccagagcgggagaagucugccgcuaucgacggugaguaccggcuaaagggcgagucgcguaagaccuucguugagcucaugcgccgcggggaccugccgguauggcucgcccacaagguggcgagcgagggcaucaaguauacagaccggaaguggugcuucgacggggaacgcaacaaccagauacuggaggagaauauggacgucgaaaucuggacgaaggagggagagaagaagaagcugcggccgcgcuggcucgacgccagaaccuacagcgacccccuggcccugaaggaguucaaggacuuugcugccggucgcaagaguauugcccuugaccuggugaccgagaucgggagggugcccucacaucucgcgcaccggacccgcaaugcccuggauaaccuggucaugcuucacacguccgagcacggagggcgggccuaccgccacgccguggaggagcugcccgagaccauggagacccuucugcuccugggccugaugauccuccugacagggggcgcgaugcuguuccucaucagcggcaaggggaucggcaagacgaguaucgggcugaucugugugguugccaguucagggauguuauggauggccgaugucccccuccaauggaucgccagugccauaguuuuagaguucuucaugauggucuugcucauaccagaaccugaaaagcagcggacgccgcaggacaaucagcuggcguacguggugaucgggauccugacccuugccgcgaucguugccgccaacgagaugggccuucucgagaccacaaagcgcgaccucggcaugucuaaggagccgggggugguguccccgaccagcuaccuggacgucgaccugcaccccgcguccgcuuggacacucuaugccgucgcaaccacgguaaucaccccgaugcugaggcacacgaucgagaacuccaccgcgaacgucucccucgccgccaucgcgaaucaggccgucgugcucaugggauuagacaagggauggcccaucucgaaaauggaccugggaguuccgcucuuagcguuggggugcuacucccaggugaauccacucacuuuaacugccgcgguguuacuccuggucacccacuaugcuauaaucggccccggccugcaggccaaggcgacccgcgaggcacagaagcgaacugccgccgggaucaugaagaaccccaccguggacggcauuaugaccaucgaucucgacccagugaucuacgacagcaaguuugagaagcaacuggggcaagucaugcugcucgugcugugcgcagugcagcuacuccucaugcgcaccagcugggcguucugcgaagcccugacgcucgccaccggccccaucaccacauugugggaaggcagccccgggaaguucuggaacacgaccaucgccgucucuauggcgaacaucuuccgggguagcuacuuagccggggcaggccucgccuucuccaucaugaagaguguggggaccggcaagaggggcaccgggagucaaggcgagacccugggcgagaaguggaagaagaaacugaaccagcucagccggaaggaguucgaccucuacaagaaauccggcaucaccgagguggaucgcaccgaggccaaggaaggguuaaagcggggcgagauuacccaccacgcggugucacgcggcagcgcuaagcuccaaugguucguggagcggaacaugguuauccccgagggccgcgucaucgaccugggcugcgggcgcggcggaugguccuacuacugcgccggccugaagaaggugacggaggugcggggcuauacgaagggaggaccggggcacgaggagccgguacccaugucuacguacggcuggaacaucgugaagcucauguccgggaaggacguguucuaccuucccccggagaaaugcgacacccugcugugcgauaucggcgagaguucccccucucccacgguagaggaguccaggacgauccgcgugcucaaaaugguggagcccuggcugaaaaauaaccaguucugcaucaagguccucaacccguacaugcccaccgugaucgagcaccuggagcgccugcaacgaaaacacggcgguaugcuggugaggaacccccugagccggaacuccacccacgagauguacuggaucagcaauggcaccggcaacaucgucuccucuguuaacaugguuucccgccugcuacugaaucgguuuacgaugacgcaccgccggcccaccaucgagaaggacguugaccugggcgccggcacgcgccacgucaacgcagaaccggagacgccgaacauggacgucaucggugaacggaucagacggaucaaggaggaacacucuuccacuuggcacuacgaugaggaaaaccccuacaagaccugggcguaccacggaucauacgagguuaaggccaccgggagcgccagcagcaugaucaacggcgugguuaagcuguuaacgaagccaugggacguugugcccaccgucacccagauggcuaugaccgacacgacccccuuugggcagcaacgcguguucaaagagaaaguggacacccggacgccccggccaaugcccggcacccggaaggcuauggagaucaccgcggaauggcuguggcgcaccuuggggaggaacaagcgaccacggcucugcacccgggaggaguuuacuaagaagguccgcacaaacgccgccaugggggcuguguuuacugaggagaaucagugggauuccgcuagggccgcuguggaagacgaggaguucuggaagcuggucgaccgcgaacgggagcuucauaagcuaggaaagugcggguccugcguguauaacaugaugggcaagcgcgagaagaagcugggggaguucggcaaggccaagggcagccgggccaucugguauauguggcugggugcgcgcuaccuggaguucgaagcccugggguuccugaaugaagaccacugguucagccgggagaacaguuucucugggguggagggcgaggggcugcacaagcugggauacauccugcgcgacaucucgaagauccccggcggggccauguacgcggacgauaccgccggcugggacacucgaaucacagaggacgaccuccacaacgaggagaagaucacccagcaaauggacccggagcaccgccaacucgcgaacgccauuuuuaaguugacauaucaaaauaagguugugaaggugcaacgccccacgccuaaggggaccguuauggauaucauaagccgcaaggaccagcggggcucaggucaggugggaacuuacgggcucaacaccuucaccaacauggagguccaguugauccgucagauggagggggagggcguccugagcaaggccgaccucgagaacccacaccuucucgagaaggagaucacgcaguggcucgagaccaagggggucgagcgguugaaacgcauggcuauuuccggcgacgacugcguuguaaagccuaucgacgaccgguucgccgacgcacugcucgcccugaacgacaugggcaaggugcgcaaagacaucccccaguggcaaccaagcaagggguggcaugauuggcaacaggucccguucugcucccaccacuuccacgaacugauuaugaaggacggccggaaguuagucgugccuugucgcccccaagacgagcugaucgggcgggcucgcauuucucagggcgccgguuggucccugaaggagacggccugccucggcaaggcguacgcucagaugugggcgcugauguacuuccaccgccgggaccugcgcuuagccagcaacgcgaucugcuccgccguacccguccacugggugccgaccagccggacgaccugguccauccacgcccaccaccaauggaugaccaccgaggauaugcugacgguguggaaucgcguuuggauagaggauaacccuuggauggaggacaagacaccggugaccacaugggaggacgucccauaccuuggcaaacgggaggaccaguggugcgggagccucaucggauuagccagccgcgccacgugggcgcaaaacauccugaccgcuauccagcaaguccggucccucauugggaacgaggaguuccuggacuacaugccaagcaugaaacgcuuccggaaagaggaggaauccgagggggccauuugguga

SEQ ID NO: 26152 - RNA, 9873 nt, Artificial Sequence
  derived and/or modified CDS sequence (opt11) from DENV-3__KC762684__SS-prME
acuucccugugucucaugaugauguuaccggcgacccuagcauuucaccugaccucacgugacggugaaccccgaaugauagucgggaaaaacgaaagaggaaaaagccuacucuucaaaacggcauccggcaucaauaugugcacucucauagcaauggaccuuggugaaaugugcgacgauaccgugacguacaaaugcccauugaucaccgaagucgaaccggaagauauagacugcuggugcaaucugacuucgacguggguuacauacggcacaugcaaucaagcaggagaacauaggcgugacaaacguagcgucgcccuagcgccucacgucggaaugggacuggacacgcgcgcacagacauggaugagcgccgaaggggcuuggcgccagguggaaaagguggaaacgugggcguucaggcaucccgguuucaccauacuugcccuauuucuagcacauuauauaggcaccagccuaacacaaaagguagugauauucauacuauuaauguuagugacaccgucaaugacuaugagguguguggguguaggcaaccgagacuuuguagaaggguuguccggcgcuacgugggucgacguuguacuggaacacggagggugcguaaccacgauggccaaaaacaagccaacacuggauauugaauuacagaagaccgaggccacacaacuagcgacgcugcguaaacuaugcaucgaaggaaagauuaccaacguaacaacggauaguaggugcccaacgcaaggcgaagcaauacuaccugaagaacaggaccaaaacuaugucugcaagcacaccuaugucgacagaggcugggggaacggcugcggccuguucgggaaaggaucccuagugaccugugcgaaauuccagugcuuagaacucaucgaagggaaaguaguacaacacgagaaccuaaaguacaccgucucaauaacaguccacacaggggaccagcaccaagugggcaacgagacgcaaggggugaccgcggagaucacgccacaggcaagcaccguggaagccauacugcccgaauacgggacacucggacuagagugcagccccaggacaggauuggauuuuaaugaaaugauacuacuaacaaugaaaaacaaggcauggaugguacauagacaaugguuuuucgaccuuccauugcccuggaccucaggcgccacaaccgagaccccaacauggaacaagaaagaauugcuaguaacauucaagaacgcgcacgccaagaaacaggagguugugguccugggcucacaagaaggcgcgaugcacaccgcacucaccggugccacagagauacagacgagcgguggcacuucaaucuucgccggccacuuaaagugccggcuaaagauggacaaacuugaacucaaggggaugagcuacgcaauguguagcaaugccuucguacucaagaaagaggucagcgagacacaacaugggacgauccuaaucaaggucgaauacaaaggcgaagacgcgcccugcaaaauaccguuuagcacggaagauggccaaggaaaggcucacaauggacggcuaauaacagcaaacccugugguaacgaaaaaggaagaaccggucaacaucgaagcggaaccaccuuucggggaauccaacauaaucauagguauuggcgacaaggcacucaaaaucaacugguacaagaaagggucgaguaucggcaagauguucgaggcgaccgcacgcggggcgagaagaauggccauacucggggauacagcaugggauuuugggagcguugggggcgugcugaacucauuaggaaaaaugguacaccaaauauucggaagcgccuacaccgcauuauucagcggaguuagcuggaucaugaagauagggauaggagugcuacucaccuggauaggacucaacucgaagaauacgagcaugagcuucuccugcaucgugauaggaauaauaacuuuguaccuuggcgcggucguucaagcggauaugggaugcgucaucaacuggaagggaaaagaacuaaaguguggcucagggaucuucguuaccaaugaaguacacacuuggacugagcaguacaaauuccaggccgacucccccaagcgucuugccacagcgauagcaggcgcuugggaaaacggcgucugcgggauaaggagcacgacacgcauggagaaccuacucuggaaacaaauugcaaaugaacugaacuacauccugugggagaauaacauuaaacugacagugguagugggcgauauaaucggaauccuggaacagggcaaacggacccucaccccacagccaauggagcugaaauacaguuggaaaacauggggcaaagccaagaucgugaccgcagaaaugcaaaacuccucguucaucauagacggccccaauacaccagagugcccgaacgccagucgcgcauggaacguaugggaagucgaggacuauggguuuggcguauuuaccacaaauaucuggcugaagcuccgggaaauguacacacagcuaugcgaccaccgacuaaugagcgcagcuauaaaagacgaacgagcagugcacgcggauaugggguacuggaucgaaucucaaaagaacgguagcuggaaauuagagaaagcaucccucaucgaagugaaaacaugcacguggccuaagucccacacacuuuggucaaauggggugcuugaaagcgauaugauuauaccaaaaucccucgccggaccaauaagucaacacaauuacaggccaggauaucacacccaaacagcaggacccuggcaccucggaaaacuagaacuagacuuuaacuacugcgaggggacuaccgucgucauaaccgaaaauugcggcacgagaggccccucacugcgaaccacgacggucuccggcaaacucauccaugaguggugcugcagaucguguacccuacccccucuaagauacaugggcgaagacggcugcugguacggcauggaaauacggccuauaaacgaaagagaagagaacauggugaaaagccucgugagugcuggaucgggaaaaguggacaacuuuaccaugggaguccuuugccuagcgaucuuauucgaggaggucaugcguggaaaauuuggcaaaaagcacaugaucgccgguguguucuucacguucguacuucuacucaguggccaaauaaccuggcgcgacauggccaggacauuaauaaugauuggaagcaaugcaucugaucgaauggguaugggcgugaccuaccuagcgcucaucgcuacuuucaaaauccaaccauuucucgcacuaggguucuuucuuaggaaacuuacuucccgagagaaucugcugcucggaguggggcuagcaauggcuaccacccugcaacucccggaagacaucgaacaaauggcaaacggaauagcguuaggacuaauggcccugaagcugguaacacaauucgaaacauaccaguuauggaccgcccucgucagccuaaugugcuccaauacuaucuucacacucaccguagcauggcggaccgccacacuaauacuagcaggaauuagucuucuaccauuaugucaaaguucggggaugagaaagaccgacugguuaccaaugacuguggccgccauggggguaccaccccuaccgcuauuuaucuucucguuaaaagacacacuaaagaggcgcucauggcccuuaaacgaaggcguuauggcgguagggcucgucuccauacucgcgaguagccugcuccgcaacgacguaccaauggcgggcccccuaguagcagggggccuccuuauagccuguuauguaaucaccgggacuagcgcugaccucaccguugagaaggcagcugacgucacgugggaggaggaggcagagcagacggggguaagccauaaccugaugauaacaguggaugacgacgggacuaugagaauaaaagaugacgaaacugaaaauauucucacggugcuucuaaagaccgcacuauugauaguaagcggaaucuuccccuauagcaucccagccacauuguuaguauggcacacauggcaaaaacagacacaacggucagggguccuaugggacgucccauccccuccugaaacacagaaagcggaauuagaggagggcgucuauaggauaaaacagcaagggauauucggaaaaacacaagugggcguaggagugcaaaaggaggggguauuucauacgauguggcaugugacgaggggagcagugcucacuuauaacggaaaacggcuggagcccaacugggccagcguaaagaaagaccugauuaguuacggggguggguggagacugucugcgcaguggcaaaaaggcgaagagguccaggucaucgcgguugagccagggaaaaaucccaaaaauuuccaaaccaugccaggcaucuuucagacuaccacaggcgaaauaggggccaucgcgcuggacuucaagccagggacuucgggcuccccaaucauuaacagagaaggaaaaguagucggguuauacgggaauggcgucgucaccaaaaacggaggcuacguauccggcaucgcccagacgagugccgaaccggauggcccgacgccagagcuagaagaggaaauguucaagaaacgcaaucucaccaucauggacuuacacccaggaucgggaaaaacucguaaauaccuucccgcuaucgugcgcgaagcaaucaaacgccgccugcguacgcuaauccuagccccuacccggguaguugcggccgagauggaagaagcacuaaaaggauuaccaauacgcuaccaaaccaccgcuaccaaaagcgagcacaccggaaaggagauagucgaccuaaugugccacgcaaccuuuaccaugcgacugcucucgccaguaagagugcccaauuacaaccuaaucauaauggacgaagcccacuucaccgauccggccucaaucgcggcaagaggcuacaucagcaccagagugggcaugggagaggcagcagcgaucuuuaugacugcuacaccacccgguaccgcagacgccuucccgcagucgaaugccccgauacaggacgaggaaagagacauaccagaacgcuccuggaacucggggaacgauuggaucaccgacuuugcuggcaagacagucugguuugucccaagcauuaaggcgggcaacgacaucgcaaauugcuugcgaaagaacgggaagaaaguaauacaacuaucacgaaaaacguucgacacggaauaccagaaaacaaaacuaaaugacugggauuucgugguuacaacagacaucucagagaugggagcgaacuucaaagcggaccgggucauagacccgagaagaugccuaaaaccagugauccuaacagacgggccggaacguguaauccuagcgggcccgaugccugucacuguggccucagccgcacaacgacgcggaagggucggccgcaacccccaaaaagaaaacgaccaauauauauucacaggacaaccccuaaacaacgacgaagaccacgcucauuggacagaagccaaaaugcugcuugacaacaucaacacgccagagggcaucauccccgcucucuucgagcccgagcgagagaaaucggcagccaucgacggcgaauaccgccugaagggugagucccgcaaaacauucguugagcucaugagaagaggcgaucugccugucuggcucgcgcacaaaguagcauccgagggcaucaaguacacagaccggaaauggugcuuugauggugaaaggaacaaucaaauucucgaagagaacauggacguagaaaucuggacuaaggaaggagagaagaagaaacugaggccgcgauggcuggacgcucggaccuacagcgacccacuagccuugaaagaguucaaagauuucgcggcaggacgcaaaucaauagcguuagaccuaguuacggagauaggucgcgugccuucacacuuggcccacagaacacgaaacgccuuagacaacuugguaaugcugcacacaucagaacauggagggcgggcguaccggcaugcggucgaggaacuaccagagacgauggagacgcugcuauuguuaggccuaaugaucuuacucaccggcggagucaugcuuuuccuaaucagcgggaaggggguugggaaaacaucaaucggguuaaucugcgucguagccagcaguagcaugcuguggauggcagacauuccgcugcaauggauagccucagcaaucguccuagaauuuuucaugaugguccuucuaauuccagaaccggagaagcaaagaacaccccaggauaaccaacucgcauacguagugaucggaauccucacacuagcggccaucgucgcugccaacgaaauggggcuguuagagacaaccaaaagagaccucggaaugucaaaagaaccgggagugguguccccaaccucguaucucgacgucgaccuacaucccgccuccgccuggacccucuacgcaguggcaacaacuguaaucacccccauguugcgacacacgauugaaaauucuacagcaaauguaagccuagcggccaucgcgaaccaagccgugguccuaaugggauuggacaaaggcuggccuauaucaaaaauggaucugggcgucccucuccuagcacucggcuguuacucccaagucaacccacuaacacuaacugccgcaguacuccugcuaguaacacacuacgccaucauaggaccgggacuacaggccaaagcaacaagagaggcccaaaaacgcacggcagcagggaucaugaagaacccaaccgucgacggcauaaugacaauugaucuagauccggucauuuaugauuccaaguucgagaaacaacuaggacaagucaugcugcuaguguugugcgcgguacagcuccuacuaaugagaaccagcugggcauucugcgaggcccugacgcucgcgacagggcccauaaccacacuuugggaaggaucaccgggcaaguucuggaacacaaccauagcggugucgauggcaaacaucuuccggggcucguaccuggcuggugcaggacuggcuuucagcaucaugaaaagcgugggcacuggcaagcggggaaccggaucacaaggagagacguugggggaaaaguggaaaaagaaacuaaaccagcuuucccguaaggaauuugaucuguacaagaagucagggauuacugaggucgaccgaacggaagcaaaggaaggacuaaagagaggggaaaucacccaccaugccgucuccagaggcucugccaaacuucaaugguuugucgaacgaaacauggugauacccgaggggagggucauugaucugggcugcggacgcggcggauggucguacuacugcgcgggacucaaaaagguaacggagguaagaggauacacgaaaggcgggccgggucacgaggagccugucccgauguccaccuacgguuggaauauuguaaaacucaugagcgguaaagacgucuuuuaucugccuccggaaaagugcgacacacuccuaugcgauauaggggaaagcagucccucccccaccguagaggaaucacgaacaauaaggguccucaaaauggucgaaccguggcuaaagaauaaccaguucugcauaaaggugcucaaccccuacaugccggcgguuaucgagcaccucgagcgccuccaaagaaaacacgggggcauguuagucagaaacccgcuaucgcggaacagcacacacgaaauguacuggaucagcaacgggaccggaaacaucgucucgucugucaacaugguaucccgccuucuacuaaaucgcuuuacaaugacauacaggcgcccaacaauagagaaggacgucgaccucggugcgggcacgagacacguuaaugcagaaccggagacgcccaacauggacguaaucggggagcgaauuaggcgaaucaaagaagaacauagcucaacauggcauuacgacgaugagaaccccuacaagacuugggcauaccaugggagcuaugaagucaaggcaacugggagcgcuaguuccaugaucaacggggucgugaaacuauugaccaagcccugggacguaguuccaacaguaacccagauggccaugacagacacaacuccuuucggacaacaacgcguguuuaaagaaaagguggauacacguacaccaaaaccaaugccaggcacaagaaaaguaauggaaauuacugcagaauggcucuggcgcacauuagggcgcaacaaaagaccucgccuaugcacccgugaggaguucaccaagaaaguacgaacgaacgccgcgaugggugccgucuucacagaagaaaaccagugggauagugcgagagcugccguagaagacgaggaauuuuggaaacucgucgacagagaaagggaguuacacaaguuaggcaagugcgggucaugcguuuacaacaugauggggaaacgagaaaagaaguugggugaguucgggaaagccaaaggaucgcgugcgauaugguacauguggcuuggagcccgauacuuggaauuugaagcacucggauuccuaaaugaggaucacugguuuagccgggaaaacagcuacuccgggguggagggcgaagggcuacauaagcuggguuauauccucagagacaucagcaagauccccggaggugcaauguacgcggaugacacagcaggaugggauacacgaaucaccgaagacgaccuacauaacgaagaaaagauaacacagcaaauggacccggagcaucggcagcuggcuaacgcaauauucaaacucacauaccagaacaagguuguaaagguccaacggccaacucccaaaggcacggugauggacaucaucucacgaaaggaccaacgaggaagcggacaaguaggcacauacggccuaaauaccuucaccaacauggaggcccagcuaauaagacaaauggagggugaagguguucuuucaaagaccgaccucgaaaauccccaucugcuagagaagaagaucacacaguggcuggaaacgaaagguguugaacguuuaaaaaggauggcaauuagcggggacgacugcgucgucaaaccgaucgacgacagauucgcaaacgccuugcuagccuugaacgacaugggcaaaguacgcaaagauaucccgcaauggcaaccgagcaagggguggcacgacuggcagcaaguccccuuuugcagccaccacuuccacgagcuaaucaugaaagacgguaggaagcuaguagucccgugccgaccgcaggaugagcuuaucggacgagcacgcauaagucagggagcgggcuggucacucaaggaaacagcaugccuaggaaaagcauacgcgcaaaugugggcacuaauguauuuucauaggagggaccuacgacuagcaaguaacgccaucugcucggcagucccaguacauuggguaccaaccucccgcacgaccuggagcauucacgcucaccaucaguggaugacaaccgaagauaugcugacuguauggaacagggucuggauugaagacaaucccuggauggaggacaaaaccccggucaccaccugggaagacgugcccuaccucgguaaaagagaagaccaguggugcggcaguuuaaucgggcugacgucuagagcaacaugggcacaaaacauacuuacagcaauucagcaaguaagaagccugauaggaaaugaagaguuccuggacuauaugccgagcaugaagcgauucagaaaggaagaggaaagugagggagcaauuugguaa

SEQ ID NO: 26153 - RNA, 9873 nt, Artificial Sequence
  derived and/or modified CDS sequence (opt11) from DENV-3__KC762686__SS-prME
accucccugugccucaugaugaugcuccccgcaacacuggcuuuccaccucaccucucgcgauggcgagccacggaugaucgugggcaagaacgagcgcgguaaaucccugcuguuuaagaccgcaucugggaucaacauguguacacucaucgccauggaucugggggagaugugcgacgacaccgugacguauaagugcccccuaauaaccgagguggagccggaagacauugacugcuggugcaaccucacuucaacauggguaacguacgguacgugcaaucaggccggcgagcaccgccgcgauaagcgguccguggcccuggcuccucaugugggcaugggauuggacacccgcgcccagacauggaugagcgccgaaggcgccuggcgccaaguagaaaagguggagacuugggcauuccgccaucccggguucaccauucucgccuuguuccuagcccacuacaucggcaccucccucacccagaagguggugauauucauacugcuuaugcucguuacacccagcaugacuaugcgcugcgugggggucggcaaucgagauuuugucgagggccuguccggggcgaccuggguggacgugguucuggagcauggggguugcguuaccacgauggcuaagaauaagccuacccucgacaucgagcugcaaaagaccgaggccacccaacucgcaacauugcggaaacugugcauagagggcaagaucaccaaugucacgaccgacucccgcugcccuacucagggugaggccauacucccggaggagcaagaccagaacuacgucugcaagcauacauacguggaucgcggguggggcaacggguguggucucuucgggaagggcagucuggugaccugcgccaaguuucagugccuggaguucaucgagggcaaggucgugcagcacgagaaccugaaguacaccguaauuaucacgguccacacgggugaucagcaucaggugggcaacgagacccagggagugaccgccgagaucacgccccaagccucgaccguggaagcgauacuucccgaguacgguacccucggacuggaguguagcccccgaaccggccuggacuucaaugagaugaucuugcucaccaugaagaacaaggccuggauggugcaucggcaaugguucuucgaccugccucugcccuggacuagcggagccaccacggagacccccacguggaacaagaaggagcuccucguuaccuuuaaaaacgcgcaugccaaaaagcaggagguggugguccucgggucucaggagggggcgaugcacaccgcccucaccggcgccacggagauccagaccagcggcggaaccagcaucuucgccggccaccugaagugccgucugaaaauggacaaacucgaacugaagggaaugagcuaugccaugugccugaacgcguucguccucaaaaaggaggucuccgaaacccagcacgggaccauccuaaucaaggucgaauauaagggcgaggacgcacccuguaagaucccguucuccacugaggauggacagggcaaagcccacaacggacggcugaucacagcgaaccccguggugaccaagaaagaagaaccuaucaacauugaggcugagccuccguucggggagaguaacauugucaucggcaucggggacaaggcucugaagaucaacugguacaagaagggauccagcaucgggaaaauguuugaggcaacggcucgcggagcgcgacggauggcgauucucggcgacacugcaugggacuucggauccgugggcgggguguugaacagcuugggcaagaugguccaccagaucuucggguccgccuacacugcccucuucagcgguguauccuggaucaugaaaaucgguaucggggugcucuugacauggaucggccucaauagcaagaacacguccaugagcuuuuccugcaucguuauagggauaauaacccuguaccuuggagccguggugcaggccgauauggggugcgucaucaacuggaagggcaaggagcucaagugcggcagcgguauuuucgucacuaacgaggugcauacuuggacggaacaguauaaguuccaggcggacagccccaaacggcuggcaaccacuaucgcgggcgccugggaaaacggggucugcgggauccgcucaaccacccgcauggagaaccuuuuauggaagcaaaucgcgaaugagcugaacuacauacugugggagaacaacauuaagcucacaguaguggugggagacaucaucggcgugcuggagcaaggcaagcggacccugacgccccagcccauggagcucaaguacuccuggaagacgugggggaaagcuaagauugucaccgcggagacucagaacucaucuuucauuaucgacgggccgaacacucccgaguguccuagcgcgagucgcgcguggaacgucugggagguugaggacuacggguucgguguguucacaaccaauauaugguuaaagcuaagagaaauguacacucaacuuugugaccaucgccugaugagcgcagcuguuaaggacgagcgggccguacacgcugauauggguuacuggauagagagucagaagaacgguaguuggaagcucgagaaggcaagccuuaucgaggugaagaccugcaccuggcccaagucccacacgcuuuggagcaacggugucuuagagucggauaugaucauccccaagucgcucgccggaccaguaucgcagcacaaucaucgccccggcuaccacacccaaaccgcaggcccguggcaucugggcaagcuggagcucgacuucaacuauugcgaggggaccacgguugugaucaccgaaaacugcgggacccgcggaccaagccugcguacuacgacagucuccgggaaacugauccaugaguggugcugcagaagcugcaccuugccgccccuccgcuacaugggggaggacgggugcugguacgggauggagauccggccgaucaacgaaaaggaggagaauauggugaagagucuggucagcgccggaucugggaaggucgacaacuucacgaugggcguauugugccuugccauccuguucgaggaggugaugcgcgggaaguucggcaagaagcacaugaucgcggggguucuguucacauuugugcugcuucucucagggcagaucaccuggcgggacauggcccgcacacugaucaugaucggcuccaacgccagugaccggauggggaugggcgucacuuaccuggcacucaucgcgaccuucaagauccagccauuccuggcgcuugguuucuuccuccgcaaauugaccuccagagagaaccuguuacucggcgugggccuggccauggccacuacucuccaacugcccgaggacaucgagcagauggccaacggcaucgcccuggggcucauggccuuaaagcugauuacgcaguucgagaccuaucaacucuggacagccuuagucagccugaugugcagcaacaccauauuuacgcucaccguggccuggcgcaccgcaacccuuaucuuggcggggaucucguuacugccugucugccagucuuccucaaugcggaagacggauugguugcccgucacaguggccgccaugggagugccaccauugcccuuauucauauucucccugaaagauacccuuaagagacgaagcuggccgcugaacgaaggggucauggccguaggucuggugaguauucucgcuagcucccuguuaaggaacgacgucccuauggcggggccccucguagccggaggccuacugauagccugcuacgugauaaccggaacgucugccgauuugaccguggagaaggccgcugacgugaucugggaggaagaggccgagcagaccggagugagucauaacuuaaugaucacggucgaugaugacgggacgaugcgcauuaaggacgacgagaccgagaauauccugacagugcuccucaagaccgcgcuccucaucgucucaggcaucuuuccuuacuccaucccggcuacccuccuggucuggcacacuuggcagaagcagacgcagcggagcgggguguuaugggacgugccuucgcccccugagacccagaaggccgagcuggaggaggggguguacaggauuaagcagcaaggcaucuucgggaagacacaagugggugugggcgugcaaaaggagggcguguuucacacaauguggcacgugaccagaggggcgguccugacucacaacgggaagcgccucgagccaaacugggccucuguuaagaaggaccugauaaguuacggugggggcuggcggcuaagcgcccaguggcagaaaggggaagaggugcaagucaucgcgguugagcccgggaaaaauccaaagaacuuccaaaccaugcccggcaucuuccagacgacgacuggcgaaauuggcgcgaucgcccuugacuucaaaccaggcaccuccggcucaccuauaauuaaccgcgagggcaagguuguugggcuuuacggcaacgguguggugacaaagaacggcggguacgucagcggcauugcccagaccaacgccgaaccugauggcccuacucccgagcuggaagaggagauguucaagaaaaggaaccuaacuaucauggaccuucaucccgggagcggcaagacccgcaaguaucuccccgccauuguccgggaggcgaucaaacggaggcugcgcacccucauccuggccccgacucggguagucgccgccgagauggaggaggccuuaaagggauuacccauccguuaucagaccacggcgacuaagagcgcucacacaggcaaagagaucguagaccuuaugugucacgccaccuucaccaugcggcuucucuccccagugcgcguucccaauuacaaucugauuaucauggacgaagcccauuucaccgacccggccaguaucgcggcacguggcuacauuuccacccgcgugggcaugggcgaggccgcugccauauucaugacagccacaccgccagggaccgcggacgccuuuccccagaguaacgcuccgauccaagacgaggagagagacauccccgaacgcuccuggaacagcggcaacgaguggauuaccgacuucgcaggcaagaccgugugguucguaccgagcaucaaggccggcaaugacaucgccaacugccuacgcaagaacgggaagaaaguuauucaauuaucacguaagacguucgauacggaauaccagaaaacuaagcugaacgacugggacuucguugucaccacagacaucuccgagaugggcgcaaacuucaaggcggaccgcgugauugacccccggagaugccugaagccggugauacuuacugauggcccggagcgugucaucuuggcggggcccaugccuguuaccguggccagcgcugcccagagacgaggccgcgucggacgcaacccccaaaaggagaacgaucaauacaucuucaccggucagccguugaacaacgaugaggaucacgcucauuggacggaggcgaagaugcuauuagacaacaucaacacacccgaggggaucauccccgcccuauucgagcccgagcgcgagaaauccgcugccaucgacggggaguaccggcugaagggcgagagccgcaagacguucguggaacugaugcggcgcggagacuuacccgucuggcucgcgcacaagguggccucagagggcauuaaguacaccgaccggaagugguguuucgauggggaaaggaacaaccagauccuagaggagaauauggacguagaaaucuggaccaaggagggcgagaagaagaaguuaaggccacguuggcucgacgcccggacguacucugacccacuggcccuaaaagaguucaaggauuucgccgcgggccgaaaaaguaucgcccucgaccugguuaccgagaucgggcgcgugccgagccaccuggcgcaccggacuagaaaugcacucgacaaucuggugaugcuacacaccuccgagcacggagggcgggccuaccgccacgcugucgaggagcucccggagacgauggagacccugcugcuacuaggauuaaugauccuccugaccgguggggcaaugcuguuccucaucucugggaaggguaucggcaagaccucgaucggacugauuugcgugguggcuuccagcggcaugcuguggauggccgacguaccccuccaguggauagcuagcgcgaucgugcuggaguucuuuaugaugguacugcucauacccgaacccgagaagcagcguacgccgcaggacaaccagcuggcguacguggugauaggaauccugacccucgccgcuaucguggccgcgaacgagaugggccuguuagagaccaccaagagagaccugggcaugagcaaggagcccgggguugugucuccuacgucuuaucuggauguggaccuucacccagcuuccgcuuggacccucuaugccgucgcaaccaccgugaucacuccgaugcugcgccauacgaucgagaacucaaccgcuaacgugucccuggccgccaucgccaaccaggccgucguauuaaugggcuuagacaagggauggccaaucagcaaaauggaccugggagugccacuccuggcguugggguguuacagccaggucaauccgcugacccuuacggccgccgugcuucuccuggugacccacuacgccaucaucggcccgggccugcaggcgaaggccacccgcgaggcccaaaaacggaccgcugccgggaucaugaagaacccaacugucgacggcaucaugacgaucgaccuugacccggucaucuacgacagcaaguucgagaagcaacucggccaagugaugcugcucguccuaugcgcggugcagcugcucuugaugcgcaccuccugggccuuuugcgaggcccuaacccucgccacgggcccgaucaccacccugugggagggguccccugggaaguucuggaauacaacgauugcggucuccauggccaacaucuuccggggcagcuaucuggcaggggccggccucgccuucuccaucaugaagucagucgguacgggcaagcggggcaccgggucucagggcgagacccuuggagagaaguggaagaagaaauuaaaucagcucagccggaaagaguuugacuuauauaaaaaguccggcauaacggaaguggaccgcaccgaggcuaaggaggggcugaagcggggcgagaucacccaccacgcggugaguagagggucagccaagcuccagugguucgucgagcgaaacauggugauacccgaggggagagugauagaccuaggaugugggcggggcgguuggucguacuacugugccggucugaagaaggucaccgagguucgcggcuacaccaagggcgggccgggacacgaagaacccguacccaugaguacuuacggcuggaacauuguaaaguugauguccgggaaggacguauucuaucugccaccggagaaaugcgacacgcugcugugcgacaucggggaaaguucccccucgcccaccguggaggaaucccgcaccauccgcguauugaagauggucgagcccuggcugaagaauaaccaguuuugcaucaagguguuaaacccauauaugcccacggucaucgagcaccucgagcgcuuacagcggaagcauggugggaugcuggugcgcaauccccucagcagaaacuccacccacgaaauguauuggauaagcaaugguacugggaacaucguguccagcgucaacauggugucacgacuacugcucaaucgguuuaccaugacgcaccgucggcccaccaucgagaaggaugucgaccugggcgccggcacccgccacgugaacgcggagccagagaccccgaacauggaugugauaggggagcggauccgccggauaaaggaagaacauagcuccacguggcauuacgacgaggagaacccauacaaaaccugggccuaccacggcagcuacgaggucaaggccaccggguccgccagcaguaugauaaauggcguggugaagcuguuaaccaagcccugggacguagugcccacagugacccagauggccaugaccgacaccacgccuuucgggcaacagcgggucuucaaggagaaaguagauacccgaacgccccggccgaugcccggcacucggaaggccauggagaucaccgccgaaugguuguggcgcacccugggccggaacaagcgcccccggcucugcacccgagaggaauuuacuaagaaaguccgcacaaacgcugccaugggggcgguuuucacggaggagaaccaaugggacuccgcccgggcagcuguggaggacgaggaguucuggaagcugguggaucgcgagcgggagcuccacaagcugggcaaaugcgggagcugcgucuacaacaugauggggaaacgcgagaagaaguuaggagaguucggcaaggccaagggcucccgggcgaucugguacauguggcugggcgccagauaccuagaguucgaagccuuaggcuuccuuaacgaggaccacugguucuccagagaaaacucauucagcggcgucgagggugaggggcuccacaagcuaggcuacauccugcgugacauuuccaagaucccgggcggggccauguacgccgaugauacugcgggcugggacacgcggauuacggaggacgaccuccacaacgaggagaagaucacacagcagauggagccggagcaccgucaacucgccaaugcgaucuucaagcugaccuaccagaacaagguggucaagguccaacggcccacaccuaaggggacgguaauggacauuauaagccgcaaagaccaacggggcucgggccagguagggaccuaugguuuaaacaccuucaccaauauggaggugcaacugauccgccagauggagggggagggcguguuaagcaaagccgaccuugagaacccccaccuccuggagaaggagaucacgcaauggcucgaaacgaaaggugucgagcggcugaagcgcauggccauuaguggcgacgacugcgugguuaagcccaucgaugauagauucgcugacgcccuacucgccuuaaacgacauggguaagguccgaaaagacauuccgcaguggcagcccagcaaagguuggcacgacuggcagcagguccccuucugcucccaucacuuccaugaauugauuaugaaggacggccggaagcucguagucccaugcagaccccaagacgagcugauaggacgggcgcgcauaagccagggcgccggguggucucuuaaggagaccgcaugccucgggaaggccuaugcgcagaugugggcccuaauguacuuucaccgccgggaccugcgccuagcgagcaaugccaucugcagugccgugccagugcauuggguccccacaucucggaccacgugguccauccacgcccaccaccaguggaugaccaccgaggacaugcuaaccguuuggaaccgcguauggaucgaggacaacccauggauggaggacaagacuccugucaccaccugggaagacguacccuacuuaggcaaacgggaggaccaguggugcggaucgcucaucgggcuggcuagccgcgccaccugggcccagaauaucuuaacggccauccagcagguucggucccucauagggaacgaggaguuccuggauuacaugccuuccaugaaacgcuuccguaaggaggaggaaucggaaggagccaucugguga

SEQ ID NO: 26154 - RNA, 9873 nt, Artificial Sequence
  derived and/or modified CDS sequence (opt11) from DENV-3__KC762685__SS-prME
acgagccugugccucaugaugaugcugccagcuaccuuagccuuccacuugaccucccgggacggcgagcccagaaugaucgucgggaagaacgagaggggcaagagccugcuguucaagaccgccuccgggaucaacaugugcacgcucaucgccauggaccugggcgagaugugcgacgacaccgugacguauaagugcccccugaucaccgaaguggagccagaagauaucgauugcuggugcaauuuaacaucuaccugggugacuuacggcaccugcaaccaggccggcgagcaccgucgcgacaagcgguccguagcccuggcuccucaugucggcauggggcuggacacccgcgcgcagaccuggaugagcgcggagggcgccuggcggcaggucgagaaagucgagacaugggccuuccgccaccccggguucaccauccucgcguuauuucuggcacacuacauuggcaccagccucacccaaaagguggugaucuucauccugcugaugcucgucacgcccagcaugaccaugcgcugcguggguguuggcaaccgcgacuucgucgagggccuaucgggggccacgugggucgacguggucuuggaacacggaggcugcgugaccacaauggccaaaaacaagcccacccuggacaucgagcuccagaagaccgaagccacccagcuggcgacgcucaggaagcugugcaucgagggcaaaaucaccaacgugaccaccgacagccgcugccccacgcagggcgaggccaucuuaccugaagagcaggaccaaaacuacguuugcaagcauaccuacgucgaccguggguggggcaauggguguggccucuucgggaagggcucccugguaaccugcaccaaauuccagugccuggaguucaucgagggcaagguggugcagcacgaaaaccucaaauacacggugauaaucaccguccacaccggggaucagcaucaagugggcaacgagacccagggggucacggccgagaucacaccccaagccaguaccguggaggccauccuucccgaguacggaacccuggggcucgagugcagcccccgcaccggccuggauuuuaacgagaugauccugcuuacaaugaagaacaaagcguggaugguucaccggcagugguucuucgaccugccgcugcccuggaccagcggcgcaaccacggagacgccaaccuggaacaagaaggaacuccuggucaccuucaagaacgcccacgccaagaagcaggagguggugguccuagggucgcaggagggcgccaugcacacagcacucacgggggccaccgagauccaaaccucuggcgggaccuccauauuugccggacaccugaagugccgacugaagauggauaaacucgaacuaaaggggaugagcuacgcaaugugucugaacgccuucgugcucaagaaggaggucucggagacucagcaugggaccauccuaaucaaggucgaauacaagggcgaggacgcgcccuguaagaucccguuuagcaccgaggacggccaaggcaaggcgcacaacggccgccugaucacggccaauccgguggugacgaagaaggaggagcccgucaacaucgaggccgagcccccguucggggagagcaacaucgugaucggcaucggggacaaggcccugaagaucaacugguacaagaaaggcuccucaauuggcaagauguuugaagccacugcaaggggagcccggcgcauggccauccucggcgacaccgcgugggacuucgggucugugggcggaguucugaacagccuggggaagaugguacaccaaauauucggguccgcuuacacggcccucuuuucuggagucuccuggaucaugaaaauagggaucgguguccugcugacuuggaucggacuaaacagcaaaaacaccuccauguccuucuccugcaucgugaucgggaucaucacccuguaccucggagccgugguacaggccgacauggggugugugaucaauuggaagggcaaggagcucaagugcggcagcgggaucuucgugaccaacgagguccacacauggacggagcaauacaaauuccaagcggacuccccaaagcgacuggccacggcaaucgccggcgccugggaaaacggugugugcggcauccgcagcaccacgcgcauggagaacuugcucuggaagcagaucgccaaugaauugaacuauauuuugugggagaauaacaucaagcucaccgucguagugggggacaucaucggcguacuggaacagggcaagcgcacccugacgccccaaccuauggaguugaaguacuccuggaagacgugggggaaagcgaagaucgucaccgccgagacacagaacagcuccuuuaucaucgacggcccgaacacgcccgaaugccccuccgccucccgcgcguggaacgugugggaaguggaggacuacggauucggcguuuuuaccaccaacaucugguugaagcugcgggagauguacacccaacucugcgaccauaggcuuaugagcgccgccgugaaagacgagcgggcgguucacgcugacaugggcuacuggaucgaaagucagaagaacgggucuuggaaguuggagaaggcgagccucauugagguaaagacuugcaccuggcccaagucucacacgcuguggagcaacggugugcuggaguccgacaugaucauccccaaaucccucgccgggcccguuucccagcacaauuaccgccccgguuaccauacccagaccgccggcccguggcaccuagggaaacuagagcucgauuucaacuacugcgagggcacaaccguugugauaaccgagaacuguggcacacggggccccagcuugcgcaccaccaccguguccgggaagcuaauccacgaauggugcugccggagcugcacccugccuccucuccgcuacaugggcgaggacgggugcugguacggcauggagauccggccgauuaaugaaaaggaggagaacauggucaagucucuggucucugccggcuccgggaagguggacaacuucaccauggguguccucugccuggccauccuguucgaagaggugaugcgcgguaaguucggcaaaaagcacaugaucgcgggggugcuguuuacguucguucugcuacucagcggccagaucaccuggcgggacauggcccgcacacugaucaugaucggcagcaacgccucggaucgaauggggaugggcguaaccuaccuggcccucaucgcgaccuuuaagauccagcccuucuuagcgcucggguucuuccuccgcaaguuaaccuccagggagaaccugcuauugggcgugggucuagcgauggcgacuacucuccagcugccggaggacaucgagcagauggcaaauggcauagcgcugggccucauggcccugaagcugaucacgcaguucgagaccuaccaacucuggaccgcccucgucagccugaugugcagcaacaccaucuucacucucaccgucgcauggcgcaccgccacccugauccuggcaggcaucucccuccucccagucugccagagcuccagcaugcggaagacggauuggcuuccggugacgguggccgccaugggugugccaccccucccccuguucaucuucagccucaaggacacccucaagagacgcucauggccgcugaacgagggggugauggcggugggcuuggucucaauccucgccagcuccuugcugcggaacgacgugcccauggcgggcccgcuuguagcagggggucugcugaucgccugcuacgugaucaccggaacuagcgcggaccucaccguggagaaggcagccgacgugaucugggaagaggaggccgagcagacgggcgucucccacaaccugaugaucacgguggacgacgacgggaccaugcgcaucaaagacgacgagaccgagaacauccugaccgucuuacuuaagaccgcccugcucaucgucuccggcauauuuccauacuccaucccugccacucugcugguguggcauacauggcaaaaacaaacccagcggagcggcguccucugggacgucccguccccgccugagacccagaaagccgagcucgaagaaggaguguaccgcauuaagcagcagggcaucuucggaaagacccaggugggcguuggggugcagaaagagggcgucuuccacacaauguggcacgucacccggggcgccguacugacccacaacgggaagagacuggaaccgaacugggcgagcgugaagaaggaucuaaucuccuacggcggcgguuggcggcugucagcccaguggcagaagggagaagagguccaggugaucgccguggagcccggcaagaauccgaagaacuuccagacgaugcccggcaucuuccagacuaccaccggggagauaggcgcaaucgcccuggacuucaaaccgggcaccuccggcagcccuauaaucaaccgcgagggaaaggucgucgggcucuacgguaacggcguugucacaaagaacgggggcuacgucagcggaauugcccagaccaaugccgagcccgauggcccgacccccgaacuagaagaagagauguuuaaaaagcggaaccugaccaucauggaccuucaccccgggaguggcaagacgcgcaaguaccugcccgccaucgugcgggaggcgaucaagcgccggcugcguacucucauucuagccccaacccggguaguggccgcggagauggaggaggcauuaaaggggcuccccauccgcuaccagaccacggcgacgaagagcgcccacaccggcaaagagaucguggaccuaaugugccacgccaccuucacgaugcggcugcucucccccguccgcguacccaacuacaaccugaucaucauggacgaggcccacuucaccgacccggccuccauugcggcccggggguacaucucuacucgcguggguaugggagaggcugcugcgaucuucaugaccgccacgccgcccgggaccgcugacgccuucccccagagcaaugccccgauccaggacgaagagcgggacauuccagaacgauccuggaacucgggcaacgaguggaucaccgacuucgcgggaaagaccgucugguucgugcccuccaucaaggccggcaaugacaucgccaacugucugcgcaaaaauggaaagaaagucauacagcucagccggaaaacguucgacaccgaguaccagaagaccaagcuuaacgacugggacuucgucgugaccaccgauaucucagagaugggcgcgaacuucaaggccgaccgcgugauugauccccgucgcugccugaagccggucauacucacagacggccccgagcgcgugauccuggcugggcccaugcccgugacagucgccagcgccgcccaacgccggggccgcguggggaggaacccgcagaaggagaacgaccaguauaucuuuacaggccaaccucucaacaacgaugaggaccacgcccacuggacagaggcgaagaugcuccuggacaacaucaacacccccgaagggaucauccccgccuuauucgagccggagcgggagaaguccgccgccaucgacggcgaguauaggcugaagggcgagagcagaaagaccuucguugagcugaugcgaagaggugaccugcccguguggcuagcucacaaaguagccuccgagggcaucaaauacaccgaucggaaguggugcuuugacggcgaacgcaacaaccagaucuuagaggagaacauggacguagagaucuggacuaaggagggcgagaagaagaaguuacggccccgcuggcuggacgcgcggacuuacucggacccgcuggcgcugaaagaauucaaggacuuugccgcgggucgcaaguccaucgcucucgaccugguaacugagaucgguagagucccuucccaccuggcacaccggacacgcaaugcccuggauaaccuggugaugcuccacaccuccgagcacggggggagggccuaccgccacgcaguugaagagcuccccgaaaccauggagacucugcugcuucuaggccugaugauccuccugaccgggggcgccaugcuguuccucaucagcggcaaagggaucggaaagaccucuaucgggcuuauuugcguggucgccucuagcggcaugcuguggauggccgacgugccgcuccaguggauugcguccgcaaucgugcuggaguucuucaugaugguccugcucaucccggagccagagaaacagcggacgccccaggauaaccagcuggccuacguggugaucgggauucugacccucgcggccaucguagcagcaaacgagaugggccugcuugagaccaccaagcgcgaccucggcaugagcaaggagcccggggucgugucuccgacgucauaccuggacgucgaccugcacccggccagugccuggacccucuacgccguggcuaccaccgucaucacucccaugcugcggcacaccauagagaacagcaccgccaaugucucccuggccgccauagccaaccaagcggugguacucaugggccuggacaagggauggcccaucagcaagauggaccugggcgucccgcuacuggcacuggggugcuacucacaggugaaccccuugacccuuacggcggccgugcugcuccuggucacacacuacgccaucaucggccccggccugcaagcgaaggcgacgcgggaggcccagaagcggaccgccgccgggaucaugaagaacccgacuguggauggcaucaugaccaucgaccuugacccagugauuuacgacagcaaguucgaaaagcaguugggucagguaaugcuccucguccugugugcggugcagcuguugcuaaugaggaccuccugggcuuuuugcgaggcauugacccuagcuacgggcccgaucaccacccuuugggaaggcagcccugggaaguuuuggaacacaacgaucgcggugagcauggccaauaucuuccggggcagcuaccuggcaggcgccggccucgccuucuccaucaugaaauccguggggaccggcaagcgcggcacggggagccaaggggagacccugggcgagaaguggaagaaaaagcuaaaccagcucagccggaaggaguucgaucuguacaagaaguccggcaucacggaagucgaccguaccgaagcaaaggaggggcugaagcgaggcgagaucacccaccaugcagucucaagaggcuccgccaagcuacagugguucguggagcggaacauggugauacccgaggggcgcgucaucgacuuggguugcggacggggggggugguccuacuacugcgccggccugaagaaggugaccgagguacgcggcuauacuaagggggggccggggcacgaggaacccguccccaugagcaccuacggguggaacaucgugaagcucaugagcggaaaggacguguucuaccugcccccggagaaaugcgauacccugcugugcgauaucggcgagagcucucccucccccacaguugaggagucccggaccauccgcgugcucaagaugguggagcccuggcugaaaaacaaccaguucugcaucaaaguccuuaaucccuacaugccgacggugauagagcaccucgagcgccugcagcguaagcacggcgguaugcuggugcgcaacccucucagccggaacuccacucacgaaauguacuggaucagcaacgggaccgggaauaucgucucuagcgugaacauggugagucgccuccuccucaacagguuuacaaugacacaccgccggcccacaaucgagaaggacguugaucugggugcagggacacgccacguuaacgcggagccggaaacccccaacauggacgugaucggugagcggauccgccggaucaaggaagagcauagcucaacauggcacuacgacgaggagaaccccuacaagaccugggccuaccacggcucguacgaggugaaggccaccggguccgccucuagcaugaucaacggggugguaaagcuccucaccaaaccgugggacguggugccuacggucacccagauggccaugacugacaccacuccauucgggcaacagcgcguguucaaagaaaaaguggacacccggacgccacgcccgaugccaggcaccagaaaggcgauggagauuaccgccgaguggcuguggcgcaccuugggccggaacaagcgccccagguuguguacccgcgaggaguucacaaaaaaggugcgcacgaacgccgcaaugggggcgguguucaccgaggagaaccagugggacuccgcccgggccgcaguagaggaugaggaguucuggaagcuggucgaccgcgagagggagcugcacaagcucggcaagugcggcaguuguguguacaacaugaugggcaagcgcgaaaaaaaauugggggaguucggcaaggccaagggcagccgcgcgaucugguacaugugguuaggagcccgcuaccucgaguucgaggcacugggcuuccugaacgaggaucacugguucagccgugagaacuccuuuucuggcgucgaaggcgaagggcuccacaagcugggcuacauucugcgcgacaucuccaagaucccaggcggggccauguacgccgaugacaccgcgggcugggauacccggaucacggaggacgaccuccacaacgaggaaaaaaucacccaacagauggagccggagcaccgccagcucgccaacgcuaucuucaagcugaccuaucagaacaaggucguaaaagugcagcgucccacccccaaagggacugucauggacaucauuagccgaaaggaccaaaggggcagcggccaggugggcaccuauggccuaaacacuuucaccaacauggaagugcaacugaucaggcagauggagggggagggcguccugagcaaggcugaccucgagaacccccauuuacuggagaaggagauaacccaguggcucgagacgaaagggguggagcggcugaagcgcauggccaucuccggagacgacugcgugguuaagcccaucgacgaccgguucgcggaugcccugcucgcccugaacgacaugggcaaggugcgcaaagacauaccccaguggcagcccagcaaggguuggcaugacuggcagcagguccccuucuguucccaccacuuccacgaacuuauuaugaaggacggccguaaguugguugugccgugccguccccaggacgagcugauagggagagccagaaucagccagggggccggguggucccugaaagagaccgcgugccucggaaaggccuacgcccagaugugggcucugauguacuuccaccgucgggaccugcggcuggcgagcaacgcaaucuguuccgccguccccguccacugggugccgaccagccggaccaccugguccauccacgcccaccaccaauggaugaccacggaggacaugcugacgguuuggaaucgcgucuggaucgaggauaaccccuggauggaggacaagacgcccgugaccaccugggaggacgugcccuaccugggcaagcgggaggaccaauggugcgggucacucauuggccuugcaagccgcgcgacgugggcccaaaauauccugacggccauccagcaagugcgcucccucaucgggaaugaggaguuccuggauuacaugccaaguaugaagcgcuuccgaaaggaggaggagucugagggugccaucugguag

SEQ ID NO: 26155 - RNA, 9873 nt, Artificial Sequence
  derived and/or modified CDS sequence (opt11) from DENV-3__KC762687__SS-prME
accucacugugcuuaaugaugauguugccugcaacacuggcauuccaucuuacaucucgagacggggaaccccgaaugaucgucgguaaaaaugaacgagggaaaagccuauuauucaaaaccgcaagcggcaucaauaugugcacacuaauagccauggaccugggggaaaugugugacgacacagugaccuacaaaugcccacuaaucaccgaaguagaaccagaagauaucgacugcuggugcaaccugacuagcacaugggucacauacggcacguguaaucaagcgggugaacacaggagggauaagcgaagcguagcucuggccccacauguugggaugggcuuagacacacgcgcccaaaccuggaugagcgcggaaggcgcauggagacaaguugaaaaagucgagacgugggcauuccggcauccggguuucacaauacuagcauuauuccucgcacauuauauaggaacaucacugacccaaaaaguggugauauuuauauuacuaaugcuggucaccccuucuaugacaaugcgauguguggggguaggcaauagggacuuugucgaaggacucagcggagcaacuuggguugauguagugcuagagcacggagggugcgugaccacaauggccaaaaauaaaccaacacucgacaucgagcuccagaaaaccgaagcgacgcaacuggcgacgcucaggaaguuaugcaucgagggcaaaaucacgaacgugaccaccgacagccgaugcccaacacaaggagaggcgauacuccccgaggagcaggaucagaacuacgucugcaagcauaccuacguggaccgagguugggggaacgguugcgguuuguucgguaagggcagccucgugaccugcgccaaguuccaaugcuuagaguucaucgaggggaagguaguacagcacgaaaaccuaaaguacacaguaauaauaaccguacauaccggcgaccaacaccaaguggggaacgaaacgcaaggugucacagcugaaaucacuccacaagccucuacaguggaggcaauacugcccgaauauggaacccugggccuugagugcagcccccgcaccggucuugacuucaacgagaugauccuacuaacaaugaaaaauaaagcguggaugguccauaggcaaugguuuuucgaccuaccucuaccauggacaagcggcgcaaccacagagacuccgacuuggaacaagaaagaacuccuaguuacguuuaagaaugcccacgccaagaaacaagagguaguuguguuaggaagccaagaaggugcgaugcauacggcccuaacaggcgcgacagagauucaaacaaguggaggcaccaguaucuucgcggggcaccucaaaugccgcuugaagauggacaaacucgagcuaaaaggcaugaguuacgcaaugugccuaaacgcauucguacucaagaaagaagucagugagacacagcacggaacuauacuaaucaaggucgaauacaagggcgaggacgcacccugcaaaauaccuuucucaaccgaggauggucaggguaaagcucacaacgggagacuuaucaccgcaaaccccgucguuguaaagaaggaggagccuguaaacaucgaagcggaaccgccauuuggagaaucuaacaucguaauaggaauaggggacaaggcucucaaaaucaauugguacaagaagggcagcucuaucggaaaaauguucgaggccaccgccaggggagcacgccggauggccauccuaggggacacggcuugggauuucggauccgugggcgggguguuaaacucucuaggaaagaugguacaccaaauauuuggcagugcauacacggcccucuuuagcggaguuagcuggauaaugaaaauagguaucggaguauugcugacguggaucggccucaauagcaaaaauacauccaugagcuucaguuguaucguaauagggaucaucacccuauaccugggcgcagucguucaggcggauaugggaugugugauaaacuggaaaggcaaagaacucaagugcgggucaggaaucuuugugaccaacgagguacacaccuggacggaacaguacaaguuccaggccgacucaccuaaacgcuuagcaacagcuaucgcaggagccugggaaaacggggugugcggcaucaggagcaccaccagaauggagaaucugcucuggaagcaaauugcaaacgaacuuaacuacauccucugggaaaacaacauaaagcuaacuguaguagucggagacaucauaggaguccucgaacagggaaagcggacccuaacaccacagccaauggagcugaaauacuccuggaaaacguggggcaaagcuaaaauaguuacagcugagacccagaacucgucauuuauuauugacggaccuaacacaccggaaugcccuucagccucucgggcauggaacguaugggagguagaagacuacggcuucgggguauucacaacaaacauuuggcuaaaacuacgggagauguacacacagcucugcgaccaccgccuaaugucagcggcagugaaagaugagagggcaguccacgcagacaugggauacuggauagaaucccaaaagaacggaaguuggaaacucgaaaaagcgucucugaucgaaguaaagacaugcacauggccaaagucacacacucucuggagcaauggcguacuggaaagcgauaugauaauaccaaagagccuagcaggaccugugucacaacacaacuaucggccaggauaccacacgcagacggcuggcccguggcaccuaggcaagcuggagcuggacuucaacuacugugaaggcaccacaguggugauuacagaaaacugcgguacgcgcggaccaucucugcggacuaccacagugagugggaaauuaauacacgaguggugcugccgaucuuguacacugccucccuugagauacaugggagaggacggaugcugguacgggauggaaauacgcccaaucaacgagaaagaagagaacaugguaaaaagccucguuucugccggcucggggaaggucgacaacuucacaaugggcguuuugugccuagcgauccucuuugaagaagucaugagaggcaaauucggcaagaaacacaugauagcgggaguccuauucacguucguguuacuccuuagcgggcagaucaccuggcgggacauggcgcguacacugaucaugauaggcucgaacgcaagcgauaggauggggauggguguaacauaccucgcacucaucgccacguucaaaauacagccauuucuggcacuaggguucuuucuccgcaaacugacaucacgggaaaaccuccuccucgggguuggacuagccauggccacgacccuccagcugccugaggauaucgaacaaauggcaaacggcauagcccuuggccucauggcccuaaaacugauuacgcaauucgaaacauaucaacuuuggaccgcccuugucucacugauguguucaaacaccauauucacccucaccguugcauggcgcacagccacgcucauccuggcaggcauuaguuuguucccugucugccaaucuucguccaugcggaagacagacuggcuacccguaacagucgcggcgaugggcguaccgccucuaccauuauuuauauucagccugaaggauacgcucaaaaggcggagcuggccccucaacgagggggucauggcggugggccucgucuccauacuggcgucgucccuacucagaaacgacgucccaauggccggaccguuagucgcagggggccuacuaauugccugcuacgucauaacagguacaagugcagaccuaacagucgaaaaagcugcagacguaauaugggaggaggaggcggagcaaacgggaguuucucacaaccuaaugauaaccgucgacgaugaugggacgaugcgcauuaaggacgacgagaccgaaaauauucugacagugcugcucaagacggcacuccugauugugagugguaucuuccccuauucgauucccgccacauuacuuguauggcacaccuggcaaaagcaaacccaacgcuccggaguacuaugggacgucccauccccgcccgaaacgcagaaagcagagcuagaggaaggcgucuacaggaucaaacaacagggcauuuucgggaaaacacaagucggagugggagugcagaaagagggggucuuccacacaauguggcaugugacacguggagccgucuuaacacacaacggcaagcgucucgagccaaacugggccucagucaagaaagaccuaaucaguuacggaggaggauggagacuuucugcccaguggcaaaagggcgaagaaguucaagucauagcggucgaaccuggcaaaaacccaaagaauuuucagacuaugccggggacuuuucagaccacuacuggggagauaggagcuauugcguuggauuucaagccagguaccucaggcucgcccauaauuaauagagagggaaaaguaguggggcucuacgggaauggaguuguaacuaaaaaugguggguacguauccggaaucgcacaaacgaacgcggaaccagacggaccgacaccugaacuggaagaagaaauguucaagaaacgcaaccugaccaucauggauuugcaccccgguucgggcaagacccgaaaauaucucccugcaaucguaagagaggcaauaaaacgaagacuaagaacccucauacuugcgcccacaagagugguagcggcggaaauggaagaagcccuuaagggacucccaauacgguaccagacuacugcaaccaaguccguccacaccgggaaagagauuguggaccuuaugugucacgcgacguucaccaugcgucuauuaagcccggucagggugccaaacuacaaucuaauaauaauggacgaagcacacuuuacggaccccgcguccaucgcggcuagaggauauaucucaacacgcgucggcaugggcgaggcagcagccauuuucaugacagcuacacccccaggcacugcagacgcuuucccucaaagcaacgcaccaauucaagacgaggaaagagacauaccugaacggagcuggaacucgggaaacgaauggauaaccgacuucgcagguaaaacuguaugguucguuccauccaucaaagcggggaacgacaucgcgaacugccuccggaaaaauggcaagaaagucauacaauuaagcagaaagacauucgacaccgaguaccagaaaacuaaacuuaaugauugggauuucgugguaacaacggacauaagcgaaaugggggcaaacuucaaggccgacagggucauagauccaaggagaugccugaagcccgucauccuaaccgacgguccagagcgggucauucucgcuggaccgaugccgguaacuguggcguccgcggcacaaaggcgcgguagagucgggcggaacccccaaaaggaaaacgaucaguauauuuuuaccggccagccucucaacaacgacgaggaccaugcacauuggacggaagcaaaaauguuacuagauaacaucaacacuccagaaggaaucauuccagcacuauucgagccugagcgggagaaaucggcggcaaucgacggcgaauaccgucuaaagggggaaagccgaaagacuuuuguggagcucaugcggcguggggaccuucccgucuggcucgcacacaaagucgcgagugaaggaaucaaauacacagaccggaaauggugcuucgauggagagagaaacaaucaaauccuagaagagaacauggauguggaaaucuggacgaaagaaggagagaaaaagaaacuacggccacgaugguuggaugcaagaacauacucggaccccuuggcccugaaagaguucaaagacuucgcagcgggccgcaaaagcauagccuuggaccugguaacggaaauaggccgaguacccucccaucuggcacacaagacaagguccgcgcuggauaaccuugucaugcugcacacaucugagcacgguggacgggccuacagacacgccguagaagaacuucccgagacaauggaaacucuacuucugcuuggguuaaugaucuugcuuaccgguggcgccaugcuauuucugauaagcgguaaagguauaggaaaaacaagcaucggccuaauaugcguagucgccagcagcgggaugcucuggauggcagacgucccacugcaauggauagcguccgccaucguccuagaauuuuucaugaugguacuguuaaucccggagccggaaaaacaacgcacaccccaagacaaccagcucgcuuacguaguaaucgggauacuaacguuggcggcaaucgucgccgcgaacgagaugggauugcuugagacaaccaaacgggaucugggcaugucaaaggagccuggaguuguaaguccuacaucguaucuugacguagacuuacaccccgcaagugcguggacccuuuacgccguugccaccacaguaauaacuccaaugcugcgacacacaauagaaaauuccacugcgaacgugucacuggcugcaauugcaaaccaagcggucguucuaaugggccuggacaagggguggcccauaagcaagauggaucugggaguaccccuguuggcuuuaggauguuacucacaaguaaacccacuaacgcucaccgcggcuguacuacuccugguaacucacuaugcgauaauaggcccaggacuacaagccaaagcgaccagagaggcgcaaaaacgaacggcugcaggcaucaugaagaacccaacagucgacggaaucaugaccauagaccucgauccggucaucuacgacucuaaguuugaaaagcagcucggccaagucauguugcuuguucuaugcgcagugcaacuccuccucaugcggacaaguugggccuucugcgaggcuuugacacucgcaaccggaccaauaacaacucuaugggagggaucucccggaaaauucuggaauacgaccaucgcuguaagcauggccaacauuuucaggggguccuaccuggccggggcaggguuagcguucucaauaaugaaauccguugggacaggcaaaagggggaccgguucccaaggcgagacgcuaggagagaaauggaaaaagaaacuuaaccagcucucgcgcaaggaguucgauuuauauaagaaaucaggcaucacagaagucgauagaacugaggcgaaagagggccucaaaaggggcgagaucacgcaccacgccgucucccguggcucggcaaaguugcagugguucguagaacgaaacauggucauaccagaaggaagggugaucgacuugggcuguggccgaggcggguggucauacuacugugcaggacugaaaaaggucacggaaguacgcggauacaccaaaggaggaccaggccacgaggagccggugccaauguccacauacggcuggaacaucgucaaacuaaugucggggaaggauguuuucuacuugccacccgagaagugcgacacccuacugugcgacaucggcgagucgagucccuccccaacagucgaggagucccguacaauacgcguucugaaaaugguggaaccguggcuaaagaacaaucaauuuuguaucaaaguccuaaacccguacaugccaacuguaauagagcauuuggagagguuacagcgaaaacacggcgggaugcuuguaagaaacccucuaagucggaacucgacgcaugaaauguauuggaucagcaauggcacagggaacauagucagcagugucaauauggucagucgauuauuacugaaccgauuuacgaugacccacagaaggccgacgaucgagaaagacguugacuugggcgccggaacucggcacguuaacgcugaacccgaaacacccaacauggacguaaucggggaaaggauccgacgcauaaaggaagaacacucgagcaccuggcacuaugacgaagaaaacccauauaaaacgugggcauaccauggauccuacgaaguaaaggcaaccggaucggccagcaguaugauaaacgguguugugaaacuacuaacaaagcccugggacgugguccccacgguaacccagauggccaugacagacaccacacccuuugggcagcaacggguauucaaagagaaaguagacacaagaaccccacggccaaugccagguaccaggaaagcaauggaaauaacagcggaauggcucuggagaacccuggggaggaacaagcgcccacgauuauguacgcgggaagaauuuacgaaaaaggugagaacaaacgcggccaugggcgcggucuucaccgaggaaaaccaaugggacuccgcaaaagcagcgguggaggaugaggaguucuggaagcuaguggauagagagcgagaacuacacaagcugggcaaaugcggcuccugcgucuacaauaugauggguaaaagggagaagaaacuaggggaauuuggcaaagccaaaggaagcagggcaauaugguacauguggcugggggcccguuaccucgaguucgaggcauuaggcuucuuaaaugaagaccacugguucucucgagagaacaguuucucuggagucgaaggggagggacuacacaaacucggcuacauauuaagagacaucucaaaaauaccagguggagcuauguacgccgaugacacggcaggcugggacacacggaucacagaggacgaccuccauaacgaggagaaaauaacgcagcagauggauccugaacacagacaacuagcaaacgccaucuucaaacucacuuaccagaacaaagucguaaagguccagcggcccacuccaaagggcacagugauggacauaaucagcagaaaagaucagagggggucggggcaaguaggaacauauggccucaacaccuucaccaacauggagguacagcucauacggcagauggagggagaaggagugcugaguaaagcagaucuggaaaacccacaccuacucgagaaggaaauuacgcaguggcuggaaacgaaagguguagagaggcucaagcggauggccauaucgggugaugacugcguaguaaagccaaucgacgacagauuugccgacgcacuccucgcacuuaacgacaugggcaaaguucguaaagacauaccucaauggcagcccagcaaaggguggcacgacuggcaacaagucccguuuugcucacaccacuuucaugaacugaucaugaaagauggccggaaacugguaguuccgugucgaccgcaggacgagcucauaggacgagcccgaauaucacaaggcgcaggcuggagccugagggaaaccgcaugccugggcaaagcguacgcccagaugugggcgcugauguacuuucaccguagggaccuacgcuuagccuccaacgccaucugcagcgcaguaccagugcacuggguuccaacgucccgcacaacauggagcauacacgcacaccaucaauggaugacaacagaagacaugcuaacgguguggaacagaguuuggauagaagacaaccccuggauggaagauaaaacgcccgugacaacgugggaggacgugcccuaccucggcaagcgcgaagaucaauggugcggcucccuaauagggcucgccucgagggcaacuugggcccaaaauauauuaacggccauccaacaagugagaagucuaaucgggaaugaagaauuucuggacuauaugccaagcaugaagagauuucgaaaagaagaagaaagcgagggagcaauuugguag

SEQ ID NO: 26156 - RNA, 9873 nt, Artificial Sequence
  derived and/or modified CDS sequence (opt11) from DENV-3__KC762688__SS-prME
accucacugugccucaugaugaugcugccagccacccuggcauuccaccucaccagccgugacggcgagccuagaaugauuguaggaaagaacgagcgcggcaagagccugcuguuuaagaccgcauccggcaucaacaugugcacccucauagccauggaccugggcgagaugugcgacgacaccguuacauauaagugcccccugauaaccgagguggagcccgaggacaucgacugcuggugcaaccucacaagcaccugggugacguacgggaccugcaaucaggccggcgaacaccgcagagacaaacgauccguggccuuagcgccucacgugggcauggggcuggacacgcgcgcacagaccuggaugagcgccgaaggcgccuggcggcaggucgaaaagguggagacgugggccuuccgccaccccggguucaccauacucgcgcuguuccuggcccauuacaucggcacaucccucacucagaagguggugaucuucauccuacuuauguugguuacacccagcaugacuaugcgcuguguaggggugggcaaucgcgacuucgucgagggccuguccggggcgaccuggguggacgugguucuggagcacggcggguguguaaccaccauggccaagaacaagcccacacucgacaucgagcuacagaagaccgaggccacacagcuggcgacucuccggaagcugugcaucgagggaaaaaucacgaacgucaccaccgacagccgcugucccacgcaaggagaggccauacuucccgaggagcaggaccagaacuacgucugcaagcacaccuauguggacaggggguggggcaacggguguggccucuuuggcaagggaucccugguaacgugcgcgaaguuccagugccuggaguucaucgaagguaagguagugcaacacgaaaaccucaaguauacggugaucauuacgguccacaccggggaucagcaucagguaggcaacgagacccagggaguuaccgcugagaucacgccccaggccagcacaguggaggcgauccugcccgaguacggcacucucggguuagagugcagcccccgcaccggacuggauuucaaugagaugauacuguugaccaugaagaacaaggcguggauggugcaccggcagugguucuucgaccugccguuaccauggacgagcggcgccacaaccgagacuccuacguggaauaagaaggagcuacuggucaccuuuaagaacgcccacgccaaaaaacaggaggucgucgucuugggaucgcaggagggcgcgaugcacaccgcgcucacaggugccacugaaauccagaccagcggcggaaccuccaucuucgccggccacuuaaagugcagguuaaaaauggacaaacucgagcugaagggcaugagcuacgccaugugucugaacgcuuucgugcucaagaaggagguauccgaaacccaacacggaacgauacugaucaaggucgaguacaagggcgaggaugccccaugcaagauccccuucagcacagaggacgggcagggcaaggcacacaacgggcggcugaucaccgccaaccccguggugaccaagaaggaggagccggucaauaucgaggcggagcccccguucggugagucaaacauuguuauuggcaucggugacaaggcuuuaaagauuaacugguacaagaaggguuccagcaucgggaagauguucgaggcuacggcgcgcggcgcccggcgcauggcuauccuuggcgacaccgccugggacuucggguccgugggcggaguccugaacagccugggcaaaauggugcaucagaucuucggcucagccuacacagcccuauucucaggcgugaguuggaucaugaagaucggaauugggguccuacuuaccuggaucggcuugaacagcaaaaacacguccaugagcuucuccugcaucgugaucggaaucaucacccuguaccuuggcgccgugguccaggcggacauggggugcgugaucaacuggaagggcaaggaacucaagugcggcagcggcauuuucgugacgaacgaaguacacacguggacggagcaguacaaguuccaggcggacucccccaagcggcuggccaccgccaucgccggcgcgugggagaauggggucugugggauucggucaacuaccaggauggagaaccuguuguggaagcagaucgccaaugaacugaacuacauccugugggagaacaacauuaagcucacgguugucgugggggacaucaucggagugcuggagcagggcaagcggacccugacgccccagcccauggagcucaaguacuccuggaagaccugggggaaggccaaaaucgucacugcggagacgcagaacagcuccuucaucaucgacggaccuaacacccccgagugucccuccgcgagccgggcauggaacgugugggaaguagaggacuacggguucggaguauucaccacgaauaucuggcugaagcuucgugagauguacacccagcucugcgaccacagacugaugucugcugcagugaaggacgagcgggccgugcacgcagacaugggcuacuggauugagagccagaagaacggguccuggaagcuggaaaaggccucgcucaucgaagucaagacuugcaccuggcccaagucccauacccuguggucgaacgguguacuggaguccgacaugaucauucccaagucccuugccggucccgugucccagcauaauuaccgccccggcuaccacacgcagaccgccgggccguggcaccugggaaaguuagagcucgacuucaauuacugcgagggcaccaccgucguuaucacggaaaacugcgggacacgcggccccagccuccgcaccaccacggugucggggaaguuaauccacgaguggugcugccggagcugcaccuuaccuccucuccgcuacaugggugaagacgggugcugguauggcauggagauccggccgauaaaugagaaggaggaaaacauggucaagagcuuggugagcgcagguucggggaaaguggacaacuucaccaugggcguccucugccuugcuauccuguucgaggaggucaugcgcgggaaguucgguaagaaacacaugaucgccgggguccuguucaccuucguccugcugcucucuggucagaucacguggcgggauauggcucguacucugauuaugauaggcuccaacgcuagcgaccggaugggaaugggcgugaccuacuuagcccucaucgccaccuuuaagauccagcccuuucuggcgcugggguucuuccuccgcaagcugacaucccgggagaaccugcuccugggcgucggccuggccauggcuaccacccuccagcugcccgaggacaucgagcagauggcgaacgggaucgcacugggauugauggcccugaaacuuaucacgcaguucgagaccuaucagcucuggaccgcccuggucagccucaugugcucuaacacccucuuuacccugacgguggccuggcgcacagcuacccugauccucgccgggaucucccugcugcccguuugucagagcuccucaaugaggaaaaccgacuggcucccgguaacgguggccgcgaugggcgugccgccccugccccuguucaucuuuucccucaaggauacccugaagcgccgcagcuggccgcugaacgaaggugugauggcggugggcuugguuuccauccuggcgagcucccugcuccggaacgaugugcccauggccggcccccugguggcuggcggccugcucaucgcuugcuacgucaucaccgggacuagcgcugaccugacgguggagaaggcggccgacgucaucugggaggaggaggccgagcagaccggcgucucccacaaccugaugauaacuguggaugacgacgguacgaugcguauuaaagaugacgagacagagaacauccucaccgugcuucugaagacugcacuccuuauugucagcggcaucuuccccuauucaaucccggccacgcugcucguguggcacaccuggcagaagcagacacaacggaguggugugcugugggaugucccuagcccccccgagacccagaaagcagaacuggaagagggcguguaccgcaucaagcaacaggggaucuucgggaagacccaagugggcgucggggugcaaaaggagggcguuuuucacaccauguggcacgucacgcggggcgccguacucacccacaacgggaagcgccucgagccgaacugggccagcgugaagaaggaccugaucuccuacggcgguggcuggcggcugagcgcccaauggcagaagggggaggaaguccaagugauagcgguggagccggggaaaaaccccaagaacuuccagaccaugcccggcaucuuccagacaacgaccggggagaucggagccauugcgcuagacuucaagccggggacguccggcagccccauaaucaacagggaaggcaaagucgugggacuguacggcaacgggguggucacgaagaacggcggcuacgugucaggcauugcacagacaaacgccgagcccgacggaccaaccccugagcuagaggaggaaauguucaagaagcggaacuuaaccaucauggaccuccaccccggcuccggcaagacccguaaguaccugcccgcgaucguccgggaggccaucaagcgcagacugcguacucugauccuggcccccaccagggugguggccgccgagauggaagaggcgcucaaggggcugcccauccgcuaccagacaaccgccaccaagagugcucacaccggcaaggagaucguggaucugaugugccaugccaccuuuaccaugcggcugcugucccccguccgcguuccaaauuacaaucugauaaucauggacgaagcccacuucacggacccagcgagcauugccgcgcguggguacaucuccacccgagugggcaugggcgaagcagcugcaaucuucaugacagccacgccucccgguacagccgacgccuuuccccaaagcaacgcuccgauccaagacgaggagcgagacauucccgagagauccuggaacagcgggaacgaguggaucaccgacuucgccgguaagaccguaugguucgugcccuccaucaaagcaggcaacgacaucgccaauugccuccgcaagaacggcaagaaagucauucagcuuagccggaagaccuucgacacggaguaccaaaagaccaagcucaacgacugggacuucgucgugaccacagacaucuccgagaugggcgccaacuucaaggcggaccgcgucaucgacccccggagaugccuaaagccggucauccuaacggacggccccgagcggguuauucuggccgggcccaugcccguuaccguugcgagcgcagcccaacgccgcgggcgcgugggucggaacccgcagaaagagaacgaccaguauauauucaccggccagccucucaauaacgaugaagaucacgcgcacuggaccgaggcaaagaugcuguuagacaacaucaacacgccggaaggaauaauccccgcccucuuugaacccgagcgcgagaaauccgccgcgauagacggcgaguacagacugaagggggagagucguaagaccuucgucgagcugaugcggcgcggggaccuccccguguggcuggcccacaaggucgccuccgagggcaucaaauauaccgaccggaaguggugcuucgacggcgagagaaacaaccagauccuggaggaaaauauggacgucgagauauggacaaaggagggugagaagaagaagcuccggccccgcuggcuggacgcccggaccuacagcgacccccuggcacugaaggaguuuaaggacuucgcggcuggacgcaaauccaucgcccuggaccuggugacugagaucgggcgcgucccgagccaccucgcucaccggacccgcaacgcccuugacaaccugguaaugcuccacacgagcgaacacggcgggcgggcguacagacacgccgucgaagaauuccccgagaccauggagacacugcuacuccucggucugaugauccucuuaaccgggggagcuaugcuguuccucauaagcggaaaggggauuggcaagaccagcaucggacugaucugcguuguggccuccagcggcaugcuguggauggccgacgugccucuccaguggauagcguccgccaucguccuggaguucuucaugaugguccucuuaauuccggagcccgagaagcagcgaacgccccaagacaaccaacuggccuacguggugaucgggaucuugacguuggcugccaucgucgcggcaaaugaaaugggccuacuggagaccaccaagagagaccucggaaugagcaaggagcccgggguggucuccccgaccagcuaucuggaugucgaccuucaccccgcguccgccuggacccucuacgcgguugccaccaccgugauuacccccaugcugcggcauacgaucgagaacagcacugccaaugucuccuuggccgccaucgcgaaucaggccgugguuuugaugggcuuggacaagggguggccaaucagcaagauggaccugggagucccgcugcuggcccucgggugcuacucccagguuaacccccucacccugaccgccgccgugcugcuccuggugacgcauuaugcgaucaucggcccuggccugcaggcaaaggcaacccgcgaggcacagaagcggaccgccgcggggauaaugaagaaccccaccguggauggcauaaugacgaucgacuuggacccggugaucuaugacaguaaguucgagaagcagcuggggcaggucaugcuguuaguuuugugcgcuguucagcuccuccugaugcgaacaucuugggcuuucugcgaagcacuaacccucgcuaccggccccaucacaacgcugugggagggcagcccaggaaaguucuggaacacgaccauagcuguuucgauggcuaacaucuuccgcggcucuuaccuggcgggggccggccucgcguucagcauaaugaaguccguggggacggguaagcguggcacaggcucccagggcgagacgcugggggagaaguggaagaaaaagcuaaaccagcucagccgcaaggaauucgacuuguacaagaaguccggaaucaccgagguggacagaaccgaggcuaaggaagggcugaagaagggcgagaucacucaccacgcggucucacggggcagugccaagcuucagugguucguggagcgcaacauggugauccccgaggggcgagucauugacuugggcugcgggcgcggaggcugguccuacuacugcgccggccugaagaaagugacagaggugcggggcuacaccaagggcggcccggggcacgaggaaccaguucccaugucgacguacggcuggaacaucgugaagcucauguccgggaaggacguauucuacuuacccccugagaagugcgacacguuacugugcgacaucggagagagcucgcccagccccaccguagaggaaucccgcacaauccgggugcucaagaugguggagcccuggcugaagaacaaccaguucuguaucaagguccugaacccguacaugcccaccgugaucgagcaccuggagcgucugcaaagaaaacacggcggcaugcugguucggaacccccugagccgcaacuccacgcaugagauguacuggaucucaaauggcaccgggaacaucgucuccagcgucaacaugguaucaagacugcugcuuaaccgcuucaccaugacccaccggcgcccaaccaucgaaaaggacgucgaccugggugccggcacucggcacgucaacgcagagcccgagacccccaacauggacgucaucggcgagcgcauucggcgcaucaaggaggagcacagcuccaccuggcacuaugaugaggagaauccauacaagacgugggccuaccacgggucuuacgaggucaaggccaccggguccgccagcucgaugaucaacggaguugugaagcugcucacgaagccgugggacguggucccuaccgugacgcaaauggccaugaccgauaccacccccuucgggcagcaacggguguuuaaagagaagguggacacgcgcacuccgcggccgaugcccggaacccgcaaggccauggagauaacggccgaauggcucuggcggacccugggccgcaauaaacggccccgccuuugcacacgcgaggaguucaccaagaagguaagaaccaacgccgcgaugggggccguguucacggaagagaaccaaugggacuccgcccgcgcugccgucgaggacgaggaguucuggaaacugguagaccgggaacgcgagcugcauaaacucgggaagugcggguccugcgucuacaacaugaugggcaagcgggaaaagaagcugggggaguucggcaaggcgaaaggcucccgagccaucugguacauguggcugggggcuagguaucucgaauucgaggcacuuggcuuccuaaacgaggaccacugguucagccgcgaaaacucguuuagcgggguggagggcgagggacuccauaagcugggcuacauccuacgggacaucucuaagaucccgggcggugcuauguacgcggacgacaccgccggcugggacacccgcauaaccgaggacgaccuacacaacgaggagaaaaucacccagcagauggacccggagcaccggcagcuggcgaaugccaucuucaaguuaaccuaccagaauaaggucgugaaggugcagagaccuaccccgaaagggacggucauggacaucauuucccguaaagaucagcgcggcuccggccagguggggacguacggccucaauaccuuuacaaacauggaggugcagcuuauccggcagauggaaggggagggcguccuaagcaaggccgaccucgagaacccacaccuccuggagaaggaaauaacccagugguuagagaccaagggcguggagcgcuugaagcggauggcgaucuccggagacgacugcguggucaagccgaucgacgaccgcuucgccgaugcccuacuugcacugaacgacaugggaaaggugcggaaggacaucccccaguggcagcccagcaagggguggcacgacuggcagcagguccccuucugcucccaccacuuucacgagcucaucaugaaggacggccgcaagcucgucgugccuugcaggccccaagaugagcugauuggucgcgcccgaauuagccaaggcgcggggugguccuuaaaggagacagccugccucggcaaggccuacgcccagaugugggcacuaauguacuuucacaggcgcgacuugagauuagcaucaaacgcuaucugcucggccguuccgguacauugggugcccaccagccgaaccaccugguccauccaugcccaccaccaguggaugacgaccgaggauaugcugaccguguggaaccggguuuggauagaagacaacccguggaucgaggacaagacccccgugacuaccugggaggaugugcccuaucuuggcaagcgugaggaucaguggugcgggagccucaucggacuggccaguagagccaccugggcccagaauauccucaccgccauacagcaggugagaucccucaucgggaacgaagaauuucuggacuauaugccgagcaugaaacgguucaggaaggaggaagagucggaaggggccaucugguag

SEQ ID NO: 26157 - RNA, 9873 nt, Artificial Sequence
  derived and/or modified CDS sequence (opt11) from DENV-3__KC762689__SS-prME
accagccugugccucaugaugaugauucccgccacccuggccuuucaccugaccuccagagacggcgagccccggaugaucguggggaagaaugagcgcgggaagagucuccuguucaagaccgcuagcgggaucaauaugugcacacugaucgccauggaccucggcgagaugugcgaugauaccgugaccuacaagugcccccugauuaccgagguggagcccgaagacaucgacuguuggugcaacuuaacgaguaccugggucaccuacgggaccugcaaccaggccggcgagcaucgacgggacaagcgguccguggcccucgcgccucacgugggcaugggacuggacacacgcgcgcagaccuggaugagcgccgagggcgcuuggcggcaggucgagaaaguagagacgugggccuuccgccaccccggguucaccauacuugcccuuuuucuggcccauuacaucggcaccucccucacccagaaaguggugaucuucaucuuacugaugcuggucacgcccaguaugaccaugcggugcgugggggugggcaacagggauuucgucgagggccucuccggggcgaccuggguagauguaguccuggaacacggcgggugcgugaccacgauggccaagaacaagcccacgcuggauaucgagcuccagaagacugaggccacccagcuggccacguugcggaagcucugcaucgagggcaagaucacuaacgugaccaccgacucaagaugccccacgcagggcgaagcgauccugccagaggagcaggaccagaacuacgucugcaaacacaccuauguggaccgggggugggggaacggaugcggccuguucggaaagggcuccuuggugaccugcgccaaguuccagugccucgaguucaucgagggcaaggucgugcagcacgagaauuugaaguacaccgugauaaucacgguccacaccggugaccagcaccaggugggcaacgagacccaaggugucaccgccgaaauaacgccccaggccagcacgguggaggcgauccuccccgaguacggcacccugggauuagagugcuccccgcgcacaggccucgauuuuaacgagaugaucuugcucaccaugaagaacaaggcuuggauggugcaccgacagugguucuucgaccucccgcuucccuggacgucuggcgccaccacugagacacccacguggaacaagaaagagcugcuaguuacguucaaaaacgcccacgccaaaaagcaggagguagucguccuggggucccaagagggcgcuaugcacaccgcccugaccggggcaacggagauccaaacuagcggcgggaccagcauauucgccggucacuuaaagugccgcuuaaagauggacaaacuagagcucaagggcaugagcuacgccaugugccugaacgcuuucguguugaagaaggaaguguccgagacccagcacggaacgauccucaucaagguggaguauaagggagaagacgcgccgugcaagaucccguucagcacugaagacgggcagggaaaggcucacaacgggaggcuuauaaccgcuaacccgguggugacaaagaaggaggagcccgucaauaucgaggcggagcccccguucggcgagagcaacaucguaaucggcauaggagauaaagcguuaaagauaaacugguacaagaaaggauccuccauaggcaagauguucgaggccacagccaggggcgcacgccgcauggcgauccugggggacaccgccugggauuucgguucugugggcgggguccucaacagccugggcaagaugguacaccagauauucggguccgcauacaccgcccucuucagcggcguauccuggaucaugaagaucggcaucggggucuuacucaccuggauuggacuaaacagcaaaaauacguccaugagcuucuccugcaucguaauagggaucaucacccucuauuugggcgcagugguucaggccgacauggggugcgugaucaacuggaagggcaaggagcugaaaugcggcagcgggauuuucguuaccaacgagguccacacauggacggaacaauacaaguuccaggccgacucccccaagcgauuggccaccgccaucgccggcgcgugggagaauggcguguguggcauccgcucuaccacucgcauggaaaaucugcucuggaagcagaucgccaacgagcucaacuacauacugugggagaauaacaucaagcugacggucgucgugggugacaucaucggcguucucgagcagggcaagcgaacccugacgccccaaccuauggaacuaaaguacucuuggaagaccugggggaaagcaaagaucgucacggccgagacucagaacaguucguucaucaucgacggcccaaacacccccgagugccccagcgcgucccgcgccuggaacgugugggagguggaggacuacggguucggaguguuuacuacgaacauauggcucaaacugcgggaaauguacacacaacugugcgaccaucgccucaugagcgcugcaguuaaggacgagcgggccgugcacgcggauaugggguacuggaucgagucccagaaaaacggauccuggaagcuggagaaggccagccugauugagguaaagaccugcaccuggccaaaaucccauaccuuguggagcaacgggguucucgaauccgacaugauaauccccaaaagccuggcugggcccgugucccaacacaacuaccgccccggcuaccacacccagacugccgggccguggcaccuuggcaagcuggagcuugacuucaacuacugcgagggcaccaccgucgugaucacagaaagcugcgggacgcggggccccucccuccgcacaacaacgguaagcgguaagcugauccacgagugguguugccgcuccugcacccuuccgccccugcgcuacaugggcgaggacggaugcugguacggcauggagauccggccgaucaacgagaaggaggagaacauggucaagagccugguguccgccggcucgggcaagguggacaacuucacgaugggaguccugugccucgcgauucuguucgaggagguuaugcgcgggaaguuuggcaagaagcacaugaucgccggggugcuguuuaccuucgugcuccugcuuuccggccagaucacguggcgggauauggcccgcacccucaucaugaucggcucgaaugccuccgaccggauggggaugggagugaccuacuuagccuuaaucgcgaccuuuaagauccagcccuuccuugcucucggguucuuccugcgcaagcucacgagccgggaaaaccugcuccucggagugggccuggccauggccacaacucugcagcucccggaggacauugagcaaauggcaaaugggauagcccugggacugauggcccucaagcugaucacccaguucgaaacguaccagcuauggaccgccuuggugagccugaugugcuccaacaccaucuuuacucugacuguagccuggcgcaccgcgacacucauccuggcugggauaucucugcuccccgucugccaguccucuucgaugcggaagaccgacuggcugccggugacgguugccgccaugggcgugccgccccugccccucuucaucuucagccugaaagacaccuuaaagcggcgcuccuggccguuaaaugaggggguuauggccgucggccugguaagcauacuggcaucgagccuacugagaaacgacgucccuauggcgggcccccucguggcggguggcuuacugauugccugcuacgucaucaccgggaccuccgccgaccucacaguggagaaggcagccgaugucaucugggaggaggaggcagagcagaccggggucagccauaaccuuaugaucaccguggacgacgacgggaccaugcgcaucaaagacgacgagacggagaacauccugaccguucugcucaagaccgcccugcugaucgucuccggcaucuuccccuacagcaucccggccacccuccuaguguggcacacauggcaaaaacaaacgcagcguuccgggguuuuaugggacguccccagcccgcccgaaacccaaaaggcagagcucgaggaggggguauaccgcaucaagcagcagggcaucuucgggaagacucagguaggcgucgguguucagaaggagggcguguuccacacuauguggcacgucacuaggggcgcggugcugacccacaacgggaagcgccuggagccgaauugggccuccguaaaaaaggaccucaucucguacggcgggggcuggcggcuuagugcccaguggcagaagggcgaagaaguucaggugguggcaguugagccgggaaagaaccccaagaauuuucagaccaugcccggaauauuccagaccacgaccggggagaucggcgccauugccuuagacuucaaaccgggcaccagcggcagccccauaaucaaccgcgagggcaaggugguugggcuguacggcaacgggguagugaccaagaacgguggguacgugagcggcaucgcgcagacgaacgccgagcccgacggcccuacccccgaccuggaggaggagauguucaagaagcggaaccugaccauaauggaucuacauccaggguccggaaaaacacgcaaguacuugcccgcgauaguccgcgaagccauaaagcgucgccugcgcacgcugauccuggccccgacccgggugguggcagccgagauggaagaggcgcuaaagggccugccuauccgauaccagaccaccgccacgaaguccguccacacuggcaaagaaaucguugaccucaugugccaugccaccuucacuaugcggcugcugagccccguucgcgucccuaacuacaaucucaucauuauggacgaggcucauuucacggacccggcauccauugcggcccggggguauaucagcacccggguagggaugggcgaggcggcugcgauauuuaugaccgccacgccgcccgggacggccgaugccuucccacagagcaacgccccgauccaggacgaggagcgggacauucccgagcgcagcuggaacuccggcaacgaguggaucaccgacuucgcggggaagaccgugugguucguccccagcaucaaagcagggaacgacauugccaauugccugcgcaagaaugggaaaaaggugauccagcugagccggaagaccuucgacacggaguaucagaagaccaagcuaaacgacugggacuucguggucaccaccgacaucagcgagaugggcgccaacuucaaggccgaucgggugaucgaccccaggcgcugcuuaaagccggugaucuuaacggacggcccugagcgggugauccucgcagggccaaugccagugacugucgcgucugccgcucagcgcaggggccgcguggggcggaauccgcagaaggagaacgaccaguacauauuuaccggucaacccuugaacaaugacgaggaucaugcgcacuggaccgaggcuaagaugcugcucgacaauaucaacacgcccgaggggaucauccccgcucuguucgagccagagcgcgagaaguccgccgcgaucgacggagaauaccgacugaagggagagucccgcaagaccuuuguggaguugaugcggcgcggggaccuucccguguggcuggcgcacaagguggcaucggaaggcauaaaguauaccgaccggaaguggugcuucgacggggagcgcaacaaucagauccucgaggaaaacauggacguagaaaucuggacgaaggagggagagaagaaaaagcugagacccagauggcuggacgcgcggaccuacagugacccauuggcacugaaagaguucaaggacuuugccgcagggcgaaagaguaucgcacuggaccucgucacugaaaucgggcgcgugccgucccaccuggccuaccgaacuaggaacgcccuggacaaucuugugaugcugcauaccagcgagcacggcgguagagccuaccgccacgcggucgaggagcugcccgagaccauggagacgcuccugcugcucggccugaugauauuacucacugggggcgccaugcuguuucugauuagcggcaaggggaucgggaagaccucuaucgggcucaucugcgugguggccuccucugguauguuguggauggccgacguuccccugcaguggaucgccucugcgaucguacuagaguucuucaugauggugcugcugaucccggagcccgaaaagcagaggaccccccaagauaaccaacuugcauacguuguaaucggcaucuuaacguuggccgccaucguggccgccaacgagaugggccuccuggaaaccaccaagagagacuuaggcauguccaaggagccgggggucgugagcccgaccuccuaccucgauguagaucugcaccccgccucugcguggacgcuauaugcgguggcgacaaccgugaucaccccgaugcuccgccacaccaucgagaauucgaccgcgaacguuagccuugccgccauugccaaccaggcggucgugcugaugggccuugacaaaggguggcccaucuccaaaguagaucugggcgucccuuuacuggcucugggcugcuauagccagguuaauccgcugacacucaccgccgcagugcugcuguuggucacacacuaugccaucauaggccccgggcuccaagcgaaggccacgcgcgaggcccagaagcggaccgcugcggggauaaugaagaacccaaccguggacggaaucaugacgaucgaucuggacccggugaucuacgacucaaaguucgaaaagcagcugggucaagucauguugcuggugcuaugugcuguucagcugcugcucaugcgcaccaguugggccuucugcgaggcccugacccuggccacgggccccauaacaacacucugggagggcucaccggggaaguucuggaacacaacgaucgcagucagcauggccaacaucuuccgaggaucguacuuggcuggcgcaggccuagcguucuccaucaugaaguccguggggacggguaagcgcggcacaggaagccagggcgagacccucggggagaaauggaagaaaaagcugaaccagcugagcaggaaggaauucgaucuguauaagaaaaguggcaucacagagguggaccgcacagaggcgaaggaggggcucaagcgcggcgagaccacacaccacgccgucucacgcggcucugccaagcuacagugguuuguagagcggaacauggugauacccgaggggagagucauagacuugggcugcgggcgagggggguggagcuacuacugugccggccugaagaaggugaccgagguucgcggcuacaccaagggagggccggggcacgaggagcccguccccaugaguacguacggauggaauaucguuaagcugaugucagggaaggacguguucuaccuccccccagaaaagugcgacacacugcugugcgacauaggcgaguccucacccuccccgaccgucgaggagucucggaccauacgcguguuaaagaugguggagcccuggcucaagaacaaccaguucugcaucaaaguccugaaccccuacaugcccacagugauagagcaccuggagcgccuccagcggaagcauggcgggaugcuaguccgcaacccccugagucggaauagcacccacgagauguacuggaucuccaacgggacagggaacaucgucagcagcgugaauauggucagccgccuauuacugaaccgguucacgaugacgcaccgccggcccaccaucgagaaggacguggaccucggggccggcaccagacacgugaacgcggagccggagacucccaacauggacgugauuggggagcggauccgccgcauuaaggaggagcacuccagcacuuggcacuacgaugaggagaaccccuauaagacuugggccuaccacggcucauacgaggugaaggcgaccgggagcgccagcagcaugaucaacggcguggucaaacugcugaccaaaccgugggacguagugccgacagugacccagauggccaugacagacaccacgcccuucggccaacaacgcguuuucaaggaaaagguggauacccggacgccucgcccgaugccgggcacccgcaaggcgauggagaucaccgcagaguggcucuggcgcacccugggccggaacaagcgcccccggcuaugcacacgcgaggaguucaccaaaaaggugcgcacgaacgccgccaugggggcgguguucacugaggagaaccagugggacucagcccgggccgccgucgaggacgaggaguucuggaagcucgucgaccgggagagagagcugcacaaguuagguaagugcggguccuguguguacaauaugauggggaagcgcgagaagaagcucggggaauuugguaaggccaagggcagccgggcgauaugguauauguggcugggggcccgcuaccuggaguucgaggcccucggcuuccugaacgaggaccauugguucagucgcgagaacucauucucaggcguggaaggggaggggcugcacaaguuaggauacauccugcgggacauaagcaagauccccggcggggccauguacgcagacgacaccgcgggcugggacacccggaucacggaggacgaucugcauaacgaggagaagaucacccagcagauggauccggagcaucgccagcuggccaacgccauuuucaagcugaccuaucagaacaaggucgugaaaguacagcggccuacccccaaggggacggucauggacaucauuagucgaaaggaccagcggggaagcggucagguggggacuuacggcuuaaacacuuucaccaauauggaggugcaacuaauccgccagauggagggcgagggcguccugagcaaggccgaccuggagaacccccaccuccuggagaaggaaauaacacaauggcuggaaacgaagggggucgaaagauugaagcgcauggccaucuccggcgacgauugcguggucaagccgaucgaugaccgguucgcggacgcacugcuggcccucaacgacaugggcaaggugcguaaggacaucccccaguggcaaccauccaagggguggcacgacuggcagcaggucccuuucuguagccaccacuuccacgaacugaucaugaaggacggccgaaagcugguaguaccgugcaggccccaggaugagcuuaucgggagagcccgcaucucccagggggccggguggagccugaaggagaccgcgugccugggcaaggcauacgcccagaugugggcccucauguacuuccaccgccgggaucugcgucuggcguccaaugccaucuguagcgcugugcccguccacugggugccgaccagccggacaacauggagcauccaugcucaccaucaguggaugacgacugaggacaugcucaccguauggaaccgagucuggauagaagacaauccguggauggaagacaagacgcccguuacaaccugggaggacgugcccuacuugggcaagcgggaggaccaauggugcggaucgcugauuggucucgccuccagagcgacgugggcucagaacauccugacggcuauccaacagguccguagccugaucgggaacgaagaguuccucgacuacaugcccaguaugaagcgcuuccggaaagaggaggagagcgaaggcgccaucugguga

SEQ ID NO: 26158 - RNA, 9873 nt, Artificial Sequence
  derived and/or modified CDS sequence (opt11) from DENV-3__KC762690__SS-prME
accucgcugugccucaugaugaugcugcccgccacccuggcauuccaucuuacaagucgcgacggcgagccccggaugaucguggggaagaacgagcgcgggaaaagccucuuguucaagaccgccuccggaaucaauauguguacccucauugcgauggaccugggcgagaugugcgaugacaccguaaccuauaagugcccccuaaucaccgagguggagcccgaggacauugacugcuggugcaaucucaccagcaccuggguaaccuaugggaccugcaaccaggcuggcgaacaccggcgcgacaagcgguccguggcccuggcgccccacguggguauggggcuggacacgcgcgcgcaaaccuggaugagcgccgaaggcgcuuggcggcaggucgagaagguugaaaccugggccuuucggcaucccggguucaccauccucgcauuguuccuggcacacuacaucgggaccucccucacccagaagguugugaucuucaucuuguuaaugcucgucacgcccagcaugaccaugcgaugcguagggguggguaaucgggauuuugucgagggccuguccggcgccaccuggguggauguggugcuggagcauggcggcugcgugaccaccauggcuaagaacaaacccacucucgacauugagcugcagaagaccgaggcuacccaguuggcuacucuacguaaacuuugcaucgagggcaagaucaccaacguuaccacugacagccggugcccgacccagggcgaggccauauugccugaggagcaggaucagaauuacgugugcaagcacacuuacguugaccggggguggggaaauggguguggccucuuugggaagggcucgcuggucacaugugccaaguuucagugccuagaguucaucgagggcaaggucguucagcacgagaacuugaaguauacggugaucaucacgguccacaccggugaucagcaccaggucggcaacgagacucaagggguaacugcggagauaacgccucaggccagcaccguggaggcgaucuugcccgaguacggcacccugggucucgaaugcucgccccgcaccggccuggauuucaacgaaaugauccugcucaccaugaagaacaaggccuggaugguucacaggcagugguucuucgaccuuccucugcccuggacgaguggcgccaccaccgagaccccgaccuggaacaagaaggagcuccuggugaccuucaagaacgcucacgccaaaaagcaggaggucguggugcuggggucccaggaaggcgcgaugcacaccgcgcugaccggggccacggagauucaaacgagcggcgggaccuccaucuucgcaggccaccugaagugccgccugaagauggacaagcuagagcugaaggggaugagcuaugccaugugucugaacgcguucgugcucaagaaggagguguccgagacgcagcacggaacgauccugaucaagguggaguauaagggcgaggaugccccaugcaagaucccguucagcacggaggaugggcagggcaaggcccacaauggccgccugaucaccgcgaaccccguggugacaaagaaggaggagcccgucaacaucgaggcggaacccccguucggggagagcaacaucguuaucggcaucggggacaaggcgcuaaaaaucaauugguacaagaagggcucaagcaucgggaaaauguucgaggccacagccaggggcgccaggcgcauggcgauccucggcgacaccgccugggacuuuggguccgugggcggcguccugaacucccugggcaagauggugcaccagauauucgggagcgccuacaccgcccucuuuagcggcgucucuuggaucaugaaaaucgguaucgggguccugcugaccuggaucggccucaacucuaagaacacgucaaugagcuucuccugcauugugauagguaucaucacccuguacuuaggcgccguuguccaagcggacaugggaugugugaucaauuggaaaggcaaggaacuuaagugcggcagugggauuuucguuaccaacgaaguccacacuuggaccgaacaauacaaguuccaggccgacucccccaagcgcuuagccaccgccaucgcuggcgcgugggagaacggugugugcgguauccgcagcaccacccgcauggaaaaccuccucuggaagcagaucgcuaaugagcuuaacuacauccugugggaaaacaacaucaaguugacgguggucgugggggacaucaucggcguguuagagcaaggcaagcggacccugacaccccaacccauggagcucaaguacucauggaaaacgugggggaaggccaagaucguuacggccgagacccagaacagcuccuucauaaucgauggcccgaacacucccgaguguccuucggcgucccgagccuggaacgugugggagguggaggacuauggguucggcgucuucacuacgaacaucuggcugaaacugagggagauguacacccagcucugugaccaccgcuuaaugagcgccgcagugaaggacgagcgggccgugcacgcagauaugggcuauuggaucgagucacagaagaacgggucguggaagcuagaaaaggcgagccuaaucgaggucaagaccugcaccuggcccaaaucccacacacuguggaguaacggcgugcuugaguccgacaugaucauccccaagucccuugccgggcccgugucccagcacaacuaucgccccggcuaccauacgcagaccgccggaccuuggcaccugggcaaauuggagcucgacuucaacuacugugagggcacgaccgucgugaucacggagaacugcggaacccgugggccgagccugcgcaccaccacgguguccgggaaacuuauccacgagugguguugccgcaguugcacacugccgccccuccgguacaugggcgaggacgggugcugguacggcauggagauccggccgaucaaugaaaaagaggagaauauggucaagucccuagugagcgccggcuccgggaagguggacaacuucacuaugggcguccucugccucgcgauccuguucgaggaggugaugagagggaaguucggcaagaagcacaugaucgccggcguccuguucacauuuguccugcugcucucaggccaaauuacauggcgggacauggcccguacacugauuaugaucggcuccaaugccagcgaccggauggggauggguguaaccuaccuggccuugauugcaaccuucaagauacagccuuuccuggcccugggauucuuuuuacggaaguugacguccagggagaaccugcuccucggagugggccuggcuauggcuacgacccuccaguuacccgaggacaucgagcagauggcuaacgggauugcccucggccucauggccuuaaagcugauuacccaguucgagacuuaccaacucuggacggcccuggucucacugauguguagcaauaccaucuucacccucacgguugccuggcgcaccgcgacccugauccuggcuggcauuucccugcugcccgucugccagagcuccucaaugcggaagaccgacuggcugccggugacggucgccgccaugggcgugccgccccucccccuauucaucuucucccuuaaggacacguuaaagaggcgcagcuggccgcugaacgagggagugauggcagugggccucguauccauacucgcguccucacugcugcgaaacgacgugcccauggccggcccccucguggccgggggucucuugaucgccugcuacgucauuaccgggacuagcgccgaccucaccguggagaaggcggcggauguuaucugggaggaggaagccgagcagaccggcgucucccacaaccuuaugauuaccguggacgacgacgggaccaugcgcaucaaggacgacgagacagagaacauccugacggugcuucuuaaaacagcccugcucaucguaagcggcauauuucccuacuccaucccugcaacucugcugguguggcacaccuggcagaagcagacgcagcggaguggcgugcucugggacgugcccaguccgcccgagacccagaaggcggagcuugaggaggggguguaccgaaucaaacagcagggcauuuucgggaagacacaggugggcguugggguacagaaggaaggaguguuucacaccauguggcacguuacccggggcgcagucuuaacccacaacgggaaacgccuagagccgaacugggccucaguaaagaaagaccuuauuuccuacggcgggggcuggcggcugagcgcccaguggcagaaaggggaggagguccaggucaucgcgguggaacccggcaagaaccccaagaauuuucagaccaugccagggauauuccaaacaacgaccggggagaucggcgccauugcccuggauuucaaaccagggacguccggcagccccauaaucaaccgcgagggcaaggucguugggcucuaugguaacgggguuguaacgaagaacggcggguacguaagcgggaucgcccagacgaacgcugagcccgacggcccgacccccgagcuugaggaggaaauguucaagaagcggaaccugacuaucauggaccugcaccccggaucuggcaagacccggaaauaucugcccgccaucguccgggaggccauaaagcgucggcuccgcacccugauccuggcgccgacacgugugguggccgccgagauggaagaggcguuaaaggggcuaccgauucgcuaucagaccaccgccaccaaaagcgcccacaccgggaaggagaucguggaccugaugugccacgccaccuucaccaugcggcugcucucccccguccggguacccaacuacaaccugaucauuauggaugaggcucauuucacggauccugcgagcaucgcugcccggggguauaucuccacccgcgugggcaugggcgaagccgcggccauuuucaugaccgccacuccacccgggacggccgacgcuuucccgcaaucuaacgcgccaauacaggacgaggaacgggacauccccgagcgauccuggaauagcggcaacgaguggaucaccgacuucgcugggaagaccgucugguucguacccuccauaaaggccggcaaugauaucgccaacugccugcgcaagaacgggaagaaagugauacaacuuagccggaagaccuuugacacugaguaucagaagaccaagcugaaugacugggacuucgucgugacgacugacaucucugagaugggcgccaacuucaaggcggaccgagugauagacccgcggcgcugucugaagccggucauccuaacagacggccccgagcgggugauucuggcggggccgaugcccgugacuguagccuccgcugcccaacggcggggccguguggggagaaacccccagaaggaaaacgaccaguauaucuucaccggccagccccugaacaacgacgaggaccacgcgcauuggaccgaggccaagauguuacuggauaacaucaauacacccgaagggaucaucccagccuuauucgagcccgagcgcgagaaaagcgccgcgaucgacggcgaauauagauugaaaggcgagucgcgaaagaccuucguugagcucaugcggcgcggggaccugcccguauggcucgcccacaaagucgcuuccgagggcaucaaauauacugaccgcaaguggugcuucgacggggaacgcaacaaucagauacuagaggaaaauauggaugucgagaucuggaccaaggagggcgaaaagaaaaagcuccgaccccgcuggcucgacgcccgaaccuacucagaccccuuagcccugaaggaguuuaaagacuucgcggccggccgcaaguccaucgcccuugaccuggugacggagaucggacgcgugccgucgcaccuggcccaccggacccgaaacgcccucgauaaccuggucaugcugcacaccuccgaacacggcggccgugccuaucgccacgccguagaggagcuucccgagacgauggagacgcugcuacuccugggccugaugauacuccugaccgggggcgccaugcuauuccucauuaguggcaaagggaucggcaagaccagcauagggcugaucugcguggucgcuuccagcggcaugcucuggauggccgacgugccgcuccaauggaucgcgucagccaucgugcucgaguuuuucaugaugguccugcuuaucccagagcccgaaaagcagcggacgccccaggacaaccaauuagccuacguggugaucgggauccuuacucucgccgcgaucgucgcggcaaacgagaugggccugcuggagaccacuaagcgcgaucuggguaugucaaaagagccagguguugucucgccgaccucauaccucgacgucgaccuccaucccgcauccgccuggacgcucuaugccguggccacgacaguaaucacccccaugcugagacacacgaucgagaacucaaccgcaaacgucucccuggccgccauagccaaccaggccguggugcucaugggccuagauaagggguggcccaucuccaagauggaccuuggcgucccguuacuggcgcugggguguuacagucaggugaacccauugacccugaccgccgccgugcugcuccuggugacgcacuacgcgauaaucggcccaggccugcaggccaaagccacacgcgaggcucagaaaaggaccgccgccgggaucaugaagaauccaacgguggacggaaucaugacgauagacuuggacccggugaucuacgacagcaaguucgaaaaacaacucggccaaguuaugcuucucguguuaugugccgugcagcuccuccugaugcggacuucgugggccuucugcgaggcccugaccuuggcgaccggucccaucacgacucuaugggagggcucacccgggaaauucuggaacacuacgauagccgucucgauggccaacaucuucagaggcucguaccucgccggggccggucucgcguucuccauuaugaaguccgugggaacgggcaagcgcggcaccgggucccagggcgagacauuaggggagaaguggaagaagaagcugaaccagcucagcagaaaggaguuugaccuguacaagaagucuggcaucaccgaaguagaucguacugaagccaaggagggucugaagcggggagagaucacccaucaugccgucucccgcggcagugccaagcuccagugguucguggagcggaauaugguuauccccgaggggcgggugaucgaccuaggaugcggacggggcggguggucauacuacugcgcuggacuaaagaagguaaccgagguuagaggcuacaccaaaggagggccagggcacgaggagcccgucccgaugucgaccuacggcuggaacauagugaaacuuaugucaggaaaggacguguucuaccuucccccggagaagugcgacacgcugcugugugacauaggcgaaucaagucccagccccaccguugaggaguccagaaccauccgcgugcucaagauggucgaacccuggcucaaaaacaaccaguucugcaucaaggugcucaacccguacaugccaaccgucaucgagcaucucgagcgcuugcagcgaaagcacggcgguaugcuggugcgcaacccccucucucggaacagcacgcaugagauguauuggauaagcaaugguaccgggaacauugucucaagcgugaacaugguaucccgccuguuauugaacagauuuacuaugacccacaggcggcccacgaucgaaaaggacguggacuugggcgcggguacacggcacgugaacgccgagccggagaccccuaacauggacgucaucggggagcggauccgccggaucaaggaggagcauagcucgacguggcacuacgacgaggagaaccccuacaagacgugggccuaccacgguagcuaugaagucaaggcaacugguagugccagcagcaugaucaacggcgugguuaaguuauugaccaagccaugggauguggugcccaccgugacgcaaauggcgaugacagauacuacuccauucgggcagcagcgcgucuucaaagagaagguggacacgagaacuccccgcccaaugccuggaaccaggaaggccauggagaucacugccgaguggcucuggcgcacccugggccggaauaagcgcccccgucucugcacacgcgaggaguucacuaagaaggugcgaaccaacgccgcgaugggggccgucuucacggaggagaaucaaugggacuccgccagggcggcgguagaagaugaggaguucuggaaacuggucgaucgcgagcgggagcuccacaagcucggcaaaugugguagcugcguguauaacaugaugggcaaacgggagaagaagcugggggaguucggcaaggcuaagggcuccagagccaucugguacauguggcucggggcccgcuaucucgaguucgaggcacugggcuuuuuaaacgaggaccacugguuuagccgggagaacaguuucagcgggguggagggcgaggggcuccauaagcugggcuauauccugcgcgacauuuccaaaauccccggcggggccauguacgcagacgauaccgcaggaugggauacucggaucaccgaagacgaucuccacaacgaggaaaagauuacgcaacaaauggagccggagcaccgccaacucgccaacgccaucuuuaagcugaccuaccagaacaaagucgugaagguccagcggcccacgcccaaggguacagucauggacaucaucagccgcaaggaccagcgggguuccggccagguaggaacguacggccucaacaccuuuaccaacauggaaguacagcugauucggcagauggagggggagggcguacuuagcaaggccgaccucgagaacccacaucuccuggagaaggagaucacccaguggcucgagaccaaggggguggagcggcugaaacgcauggcgauauccggggacgacugcguggucaagccgaucgacgauagauucgcggaugcacugcuugcgcugaacgacauggggaaggugcgcaaggacauaccacaguggcagcccagcaagggcuggcacgacuggcagcagguaccuuucugcucgcaucauuuccacgagcugaucaugaaggauggccggaaacuuguagugccgugccgaccccaggacgagcugaucgggcgugcccgcaucagccaaggcgccggguggagccuaaaagagacggccugccucgguaaggccuacgcccagaugugggcguugauguacuuccaccgccgugaccuccgccuagccucaaacgccaucugcuccgcgguacccguccauugggugcccacuagccggacuaccugguccauccacgcccaccaccaguggaugacgaccgaggacaugcugacgguguggaaccgaguuuggauugaggacaauccuuggauggaagauaaaaccccugugacgacgugggaagacgugccguauuuagguaagcgagaggaccaguggugugguagccugauaggccuggcaagccgcgccaccugggcacaaaacauccugaccgccauccagcagguucggucccucauagggaacgaggaguuccuggacuacaugccaucuaugaagcgauuccggaaagaagaggaauccgaaggcgccaucugguag

SEQ ID NO: 26159 - RNA, 9873 nt, Artificial Sequence
  derived and/or modified CDS sequence (opt11) from DENV-3__KC762691__SS-prME
acgagucugugccucaugaugaugcuccccgcaacacuugcuuuccaccucacaucacgagacggggagccccguaugauuguggggaagaacgagcggggcaagucccuguuguucaagacagccuccgggauaaacaugugcacgcucaucgccauggaccuaggcgagaugugugacgauaccguaacauauaaaugcccccugauaaccgagguugaaccugaagacauagacugcuggugcaaccucacaucaaccugggugacuuaugggacaugcaaucaggccggggaacaccggcgcgacaaacgcucuguugcccuggccccccacgugggcauggggcucgacacccgagcgcaaaccuggaugagcgccgagggcgccuggcgccagguugagaaagucgagacgugggccuuccgacaccccggcuucaccauccucgcgcuguuccuggcccacuauaucggcacgucccucacacagaagguugugaucuucauacuguuaaugcuggugacucccucuaugacuaugcgguguguugggguaggcaacagggacuucgucgaagggcuguccggcgcuacguggguggaugugguacuggagcacggcgggugcgugacaacgauggccaagaauaagccuacccucgacaucgagcuacagaaaacagaagccacccaacuggccacccuccggaaacugugcaucgaggguaagauaaccaacguaaccacagacagccgcugcccuacacagggagaagccauucugccggaagaacaggaccagaauuacgucugcaaacauaccuacguugaccggggguggggaaacgggugcggccucuucggaaaagggagccuuguuaccugcgccaaauuccagugccuugagcucaucgaagggaaggucgugcagcacgagaaucuuaaguacaccguuauuauaaccgugcauacgggagaccagcaccaggugggcaacgagacacagggggucaccgccgaaaucacuccacaggccagcacaguagaggccauccuccccgaguacgggacccucggucuugaguguaguccccggacuggcuuggacuucaaugagaugauccuccugacgaugaaagacaaagccuggauggugcaccggcaaugguucuuugaccugccccuccccuggacaagcggcgccaccacagagaccccaacuuggaacaaaaaggagcuucuggucaccuuuaaaaacgcccacgccaagaagcaggaggugguggugcucgggagccaagagggagcgaugcacacagcccugacaggugcaacugagauucagacuuccggcgggaccuccaucuucgccggccaccucaagugucgccucaagauggacaagcuggagcugaaaggcaugaguuacaccaugugcagcaacgcuuucgugcuaaagaaggaggugucugaaacacagcauggaacuauccugaucaagguggaguacaagggcgaggacgcgccguguaagaucccguucagcacagaagaugggcagggcaaggcccacaauggccgauuaaucaccgcgaaccccguugugacgaagaaagaggaacccgucaacauugaggccgagcccccguucggugaguccaacauuaucaucggcauaggggacaaggcguugaaaauaaacugguauaagaagggcaguuccaucgggaagauguucgaagccaccgcccgcggcgcccggaggauggcuauccugggcgauacggcgugggauuucgggagcguggguggaguccugaacagccucggcaagaugguccaucagauauucgggagcgccuacacggcccucuucucuggcgugagcuggaucaugaaaauagguauaggggugcugcugacauggauugggcucaauuccaaaaacaccucgauguccuucagcuguauuguuaucgggaucaucacccuguaccugggcgccguagugcaggccgacaugggaugcguuauaaacuggaaaggcaaggaguugaagugcggcuccggaaucuucgucacuaacgaaguccauacguggaccgagcaguauaaguuccaggcggacagcccuaggcgucuugcuaccgcgauagcgggcgccugggaaaacggggucugcggcauacgcucgaccacgcggauggagaacuuacuauggaagcagaucgcgaacgagcugaacuacauccugugggagaacaauauaaagcucaccgucguggugggagauacaaucggcguguuagagcaggggaaacgaacccugaccccacaacccauggaacucaaguacagcuggaagaccugggguaaggcaaaaauugugacagccgagacucagaacuccagcuuuaucaucgacgggcccaacacgcccgagugucccaacgccuccagagcguggaacgucugggaggucgaagacuacggcuucggcgucuucacaacgaacaucuggcuaaagcugagagagauguacacucagcucugugaucaccggcugaugagcgccgcgguuaaagacgaacgcgccgugcacgcugacaugggcuacuggaucgagucgcaaaaaaacggcagcuggaaacucgagaaggcuucacugauugaaguaaagacuugcacguggcccaagucccauacauuguggucuaacggcguacuggaguccgacaugaucaucccaaaaucccucgcugggcccaucucccagcacaacuacagacccggcuaccacacccagaccgcagggcccuggcaccugggcaaacuugaguuggauuucaauuauugcgagggaacuacgguggucaucacggaaaacuguggagcucguggaccaagccugcggaccacgacagucuccggaaaguugauucaugaauggugcugccgcagcuguacucugccgccccuccgcuacaugggcgaggacggcugcugguacggcauggagaucagaccuaucaaugaaaaggaggaaaacaugguaaaaucgcuggugucggcuggcuccggaaagguagacaauuucaccaugggaguuuugugccuggcuauccuguucgaagaggucaugagggggaaguucgggaagaaacauaugaucgccggaguccucuucacguucguguuacugcucagcgggcagaucaccuggcgcgacauggccaggacauugaucaugaucgguuccaacgcaucugaccggauggggaugggcgugacuuauuuggcccuaauagcgaccuuuaagauccagcccuuccucgcucugggguucuucuuacggaaacugaccucccgcgagaaccugcuccugggagucggccuggccauggcgacaacgcuccaacugcccgaagacaucgaacagauggcgaacgggaucgccuuggggcucauggcccugaaacugaucacccaguucgagacguaccaacuauggaccgcgcucguaucccugauguguucaaauacaaucuucacgcucacuguggccuggcgcaccgcuacgcucauccuagcugggauuuccuuguucccggucugccaaagcaguagcaugcgcaagaccgauuggcugccaaugaccguggccgcaaugggcgugccgccccuaccucucuuuaucuucucccugaaggacacccugaaacgccggaguuggccgcucaacgagggggugauggccgucgggcugguauccauccuugcgagcucccucuugcggaacgacgugcccauggccggcccgcugguggccggggguuugcugaucgccuguuauguuaucaccgggacgucugccgaccuuaccgucgaaaaggcagccgaugugacgugggaggaggaggccgagcaaacuggugucucccacaaucuuaugauuacgguagacgacgauggaaccaugagaauaaaggacgacgaaaccgagaauauccugacggugcugcucaagaccgcccuguugaucguuagcggcauauuucccuacuccauuccggccacccuccugguauggcacaccuggcaaaagcagacccagcgcagcggugugcugugggacguaccgucuccccccgagacccagaaagcugagcucgaggaggggguguaccggaucaaacagcagggcaucuucggaaagacccaggugggcgucggggugcagaaggaagguguuuuccacacaauguggcaugucacacgcggcgccguccugacauacaacgggaaacggcuggagccgaacugggcuaguguaaagaaagaucuaauaagcuacggcggcggguggcgccuguccgcccaguggcagaagggggaagagguccagguaaucgcggucgagccaggcaagaauccuaagaacuuccagacuaugccugguaucuuucagacgaccacgggcgagaucggcgcgauagcccucgauuucaagccggggacaucagguucuccuaucauaaauagagaaggcaaggugguuggacuuuacggcaacgguguagugaccaagaacgggggguacguaagcgguauugcucagaccaacgccgagcccgauggacccacccccgaguuggaagaggaaauguucaagaaaaggaaccuaacgaucauggaccugcaucccgguuccggaaaaacacggaaguaccuucccgcuauuguucgggaggcaaucaaacgccgccuccggacccucaucuuagccccgacccggguaguggccgccgagauggaggaagcgcugaaggggcugccaauucgauaccagaccaccgccaccaaaagcgagcacaccggcaaggagauaguggaccucaugugucacgcgacauucacgaugcgacuacugucccccguccgggugcccaacuauaaccugaucaucauggaugaggcccacuucacggauccggcaagcauagcggcccgcggguacauaucaacccgggugggcaugggcgaagcagccgcgaucuucaugacggcaacaccaccugggacagcugaugccuucccacaaagcaacgcuccaauccaggacgaggaaagggauauccccgagaggagcuggaacucugguaacgacuggaucacggacuuugcggguaagacagucugguuugugccuagcaucaaggcgggcaacgacaucgcaaacugucugagaaagaaugggaaaaaggugauacagcuaagccgaaaaaccuucgauaccgaguaucagaagacaaagcucaacgacugggacuucgucguaacgaccgacauauccgaaaugggugcuaacuucaaggcggaccgagugaucgauccccgccggugccugaagccggucauccugaccgacgggcccgaacgcgugauacucgcggggcccaugcccguaacugucgccagcgcugcccaacgccgaggccguaucgggcgcaacccgcagaaggagaacgaucaguacaucuuuacgggccagccccuaaacaacgaugaagaccacgcucauuggacugaggccaagaugcuccuugacaacaucaauacgccugaggggaucauccccgcccuguucgagccugagcgggagaaguccgccgcaaucgacggugaguaccgccugaagggcgagucucgaaagacauucgucgagcucaugcggagaggggaccuaccuguguggcuggcgcauaaaguugcguccgaagggaucaaauauaccgaucgaaagugguguuucgacggcgagagaaacaaccagauccucgaggaaaacauggaugucgaaauuuggacuaaagaaggagagaaaaagaagcugcgcccccgguggcuagacgccaggacguacagcgauccccucgcacugaaggaguuuaaggacuucgccgcgggccgcaagagcaucgcccuggaccucgucaccgagaucggaagagugccaucgcaucuagcccaccgcacccggaaugcccuagauaaccucguaaugcugcauacuucagagcacggaggucgugcguaucggcacgcagucgaggaauugcccgagacgauggagacccuccugcuccucggucuaaugauccugcucaccgggggagcaaugcuguuucuaauuucaggcaaggggguggggaagacgaguaucgggcucauaugcguggucgcaucgagcgguauguuguggauggccgacaucccccugcaguggauugcaagugcaaucgugcucgaguuuuucaugauggugcugcugaucccagaacccgagaaacagcgcaccccgcaggacaaucagcuggccuaugugguuauagggaucuuaacccucgccgccaucguggccgcgaacgagauggggcuccuggaaaccacaaaacgggaccuuggcaugagcaaggaaccaggggucguauccccgacaucguaccuagauguggaccuccaccccgccuccgccuggacccuguacgccguugcgaccaccgugaucacgcccaugcuccgccacacgauagagaacucuacugcaaacguaucauuagcagcaaucgcgaaccaggcggucguucugauggggcucgacaaaggguggcccaucucaaaaauggacuuaggugugccgcugcucgcccugggguguuacucccagguuaacccacuaaccuugacugcggcgguucugcugcucgugacccacuacgccauuaucgggcccggccugcaggcgaaggcaacaagagaggcgcagaagcgcacggccgccggcaucaugaagaacccgacgguugauggcauaaugaccauugaucuagauccggugauuuacgacucuaaauucgagaagcagcucggccaggugaugcugcuggugcucugcgcgguucaacuguuacuaaugcguaccucaugggccuucugcgaggcucugacguuagccaccgguccaaucacgacguuaugggagggaagccccgggaaguucuggaacacuaccaucgcagugucgauggcaaacaucuuccguggcaguuaucuggccggagcaggccuggccuucuccaucaugaaauccguagggaccggcaagcgcggcacaggcagccagggggaaacgcucggggagaaauggaaaaaaaaauuaaaccaacugucacgcaaagaguucgaccuuuacaagaagaguggcaucaccgaggucgaucggacggaagcgaaggagggauugaagcgcggcgagaucacacaccacgccgugucucggggcuccgcaaaacuacagugguuuguagaaaggaauauggugaucccagaggggcgggugauagacuugggcugcgggcguggcggauggagcuauuacugcgccggucuaaaaaaagucacagaggugagaggguauaccaaaggcgggccgggucaugaggaacccgugcccaugucuaccuauggcuggaacauuguaaagcuaaugucagguaaggauguuuucuaccuaccgcccgaaaaaugugacacacugcugugugacaucggugaguccagucccucgcccaccguggaggagucccgaaccauacgcguucugaagaugguggagcccuggcugaagaacaaccaguuuugcauaaaggugcuaaacccuuacaugcccacuguuaucgagcaucuggaacggcuacagcgcaagcauggggguaugcuggugcggaacccccugucgaggaacaguacccaugaaauguacuggauaagcaacggcaccgguaauaucgugucaagcguaaacauggugagccgucuccugcucaaccgguucacgaugacuuaccgacgucccaccaucgaaaaagaugucgaccuaggcgccggaacccggcacgucaaugcugagccggagacgccaaacauggauguaauuggggagcgcauccgacggaucaaagaagagcauagcuccaccuggcacuacgacgaugagaaccccuacaagacaugggcauaccacggcucguacgaagugaaggccaccggguccgcaucaagcaugaucaauggugucguaaaacuacugacgaaaccgugggacgugguccccaccgugacacagauggcgaugaccgacacgaccccguucgggcagcagcggguauucaaggaaaaggucgauacaaggacccccaagccuaugccagguacgcguaagguuauggagauaaccgcagaguggcucuggaggacccugggccgcaacaagcgccccagacuguguacccgcgaggaguucaccaagaagguccgcacgaaugccgcaaugggugcaguguucacagaggagaaucagugggacuccgcgagagcagcaguggaggacgaggaauucuggaagcuggucgaccgcgagcgggagcugcacaagcugggcaagugcgggagcuguguguacaacaugaugggcaaacgcgagaagaagcuuggggaauucgguaaagcaaagggcucccgagcaauuugguauauguggcugggcgcgcgcuaccuggaauuugaagcauugggcuuccugaacgaggaccacugguucucgcgcgagaacagcuacucugguguggagggcgaggggcuccacaaguugggcuacauccugagggacauuuccaagauuccaggcggugccauguacgcagacgacacggcgggaugggacacgcggauaaccgaggacgaccuacacaacgaggagaagauuacacagcagauggacccagagcaccgccagcucgcgaacgcgauuuucaagcugaccuaucagaacaaggucguuaaggugcagcggccgacacccaaggggacagucauggacauuaucucgaggaaagaccaacggggcuccggccagguagggaccuacgguuugaacacuuuuacuaacauggaggcccaacucauacgccaaauggaaggagaaggagugcugucuaagacggaccuugagaauccgcaccucuuggagaaaaaaauaacgcagugguuggagaccaaagguguugaacgguugaagcgcauggcuauauccggggacgauugcgugguuaagccgaucgacgaccgcuucgcuaacgcgcuguuagcacucaacgacaugggcaagguacguaaggacaucccucaguggcagccaucuaaggguuggcacgacuggcaacagguacccuucuguagccaccacuuccacgagcuaaucaugaaggacggccggaagcugguaguuccgugccguccccaggacgagcuaaucggcagggcucgcauuagccagggcgcaggauggucgcugaaggaaaccgcuugucucggcaaggcguacgcccagaugugggcccugauguacuuucacagacgggaccugcgucuggccagcaaugccaucugcucugccgugcccguacacugggucccuacuagccguacuacuugguccauacacgcucaccaucaguggaugacgacggaggauaugcuuaccguauggaaccgcgucuggaucgaggacaacccguggauggaggauaagaccccagucaccacgugggaggacguuccuuaccugggcaagcgcgaggaccaaugguguggcagccugaucggucucaccagcagagcaaccugggcccagaacauccugaccgcgauccaacagguucgaucccugauuggcaacgaggaguuucucgacuacaugcccucgaugaagagauuccggaaagaagaggagagcgaaggggccauuugguaa

SEQ ID NO: 26160 - RNA, 9873 nt, Artificial Sequence
  derived and/or modified CDS sequence (opt11) from DENV-3__KC762692__SS-prME
accagccugugucucaugaugaugcugcccgccacccuugccuuucaccucacuucccgcgacggagagcccagaaugaucguggggaagaacgagcgcggcaagagccugcuguucaagaccgcuuccgggauaaacaugugcacccuuauugcuauggaccugggcgagaugugcgacgacaccgugacguacaagugcccccugaucacggagguggagcccgaagacauugacugcuggugcaaccucacaagcaccuggguuacguacgggacuugcaaccaggccggugagcaucggagggauaagcgguccguggcccuggcgccccacgugggcaugggacuggacacccgcgcgcagacauggaugagcgccgagggcgccuggcgccagguugagaaggucgagacgugggccuuccgccaccccggauucaccauccucgcgcuguuccuggcgcacuacaucggcaccucccucacccagaagguagugaucuucauacugcugaugcucguaacgcccucaaugaccaugcggugcguggggguagggaaucgugauuucguagagggacuguccggcgccacuuggguugacgugguccuggagcacggugggugugugaccacgauggccaagaacaagcccacccuugacaucgagcugcagaagaccgaggccacacagcuggcgacgcuccggaagcugugcaucgaaggcaagaucaccaacguuaccaccgacucgcgcugccccacgcagggagaagccauacugccggaggaacaggaucagaacuacgugugcaagcacacuuacguggaccggggcuggggcaacgggugcggccucuucggaaagggcucucuggugaccugcgccaaauuccaaugccuggagcucaucgagggcaaggucgugcagcaugagaaccugaaguacaccgugaucauuacgguccacacgggcgaccagcaccaggugggcaacgaaacccaggggguaaccgccgaaauuacgccccaggcuagcaccgucgaggcgauucugcccgaguauggcacgcucggguuagaaugcagcccccggaccggccuugacuucaacgagaugaucuuacugaccaugaagaacaaggccuggauggugcacagacagugguucuucgaccucccucuccccuggacgagcggcgccaccacagagacucccacguggaacaagaaggaacuucuggucacuuucaagaacgcccacgccaagaaacaggagguggugguucuagggucccaggagggcgcgaugcauaccgccuuaaccggggccacggagauccagaccagcggcgggaccuccaucuucgccggccaccuuaagugucgccucaagauggacaagcuggagcugaagggcaugucguacgccaugugcuccaacgcguucgugcucaagaaggaggugagcgagacccagcacgggacgauccuuaucaaggucgaguacaagggggaggacgcccccuguaagaucccguuuagcaccgaggacggccagggcaaggcccacaacggccgacugaucaccgccaaccccguggugaccaagaaggaggagccagucaacaucgaggcggagcccccguucggggaguccaacaucaucaucggcaucggcgacaaagcccugaaaaucaacugguacaagaagggcagcucuaucgggaagauguuugaggccacggccaggggcgcccggcgcauggcgauccucggcgacaccgccugggauuucgguagcgugggagggguguuaaacucccucggcaagaugguacaccagauuuuuggcagcgccuacaccgcacuuuucuccgguguuucguggauuaugaagauuggcauuggagugcugcucaccuggaucggacugaacuccaagaauacgagcauguccuucagcugcauaguaauaggaaucaucacucuguaccugggcgccguggugcaagcggacaugggcugcgucauuaacuggaagggcaaggaacucaagugcggcuccgggauuuucguuacuaacgaagugcacaccuggacggagcaauacaaguuccaggccgacagcccgaagcggcuugccaccgccaucgucggcgccugggagaacggugugugcggcauccguuccaccacccgcauggagaaucugcucuggaagcagaucgcgaacgagcugaauuacaucuuaugggaaaacaauaucaagcucacgguugucgucggggauaucaucggcgugcuggagcagggcaagcggacccuaacgccccagcccauggagcucaaguauaguuggaagaccugggggaaggccaagaucgucacggcagagauacagaauuccucauucaucaucgaugguccgaacacccccgagugucccaacgccucccgcgcguggaacgucugggaaguggaggacuacggguucggugucuucacgacgaacaucuggcugaagcugcgggagauguacacgcagcucugugaccaccgcuugauguccgccgcuguaaaggaugagcgggccguucacgccgacaugggcuauuggaucgagagccaaaagaauggauccuggaaacuggagaaggcgagcuuaaucgagguuaagacaugcaccuggcccaagucccauacacuuuggagcaacggcguacuggaguccgacaugaucauccccaagucccucgccgggccgaucucgcagcauaacuaccgcccaggcuaccacacccagacggccgggccguggcaccuggggaagcuggagcucgacuucaacuacugcgagggcaccaccgugguuauuaccgagaacugugggacgcgaggcccuagccugcgcaccaccacgguguccgggaaguugauacacgaguggugcugccggagcugcacgcugccgccccuccgcuacaugggcgaggacgggugcugguacgguauggagauacgaccaauaaacgagaaggaggagaacaugguuaagucgcuggucagcgccggcuccgggaagguggacaacuucaccaugggcgugcucugccucgccauccuguucgaggaagugaugcgcgggaaguucgggaagaagcacaugauagcggggguccucuucauguucguacugcugcucagcggccaaauaaccuggcgggacauggcgcgcacccuuaucaugauuggcuccaacgccagcgacaggauggggaugggcgucacguaucuagcccucauagcuaccuucaagauccagcccuuucuggcguugggguucuuccugcggaagcucaccuccagggagaaccugcuccugggcgugggccuggcuauggccaccacguuacaacugcccgaggauaucgaacagauggcgaacgguaucgcgcugggucucauggugcugaagcugaucacccaauucgagaccuaccagcucuggaccgcccuggucagccugacuugcuccaacaccaucuucacccuuaccguggccuggcgcacugccacccugauccuggcagggaccucccuccugcccgucugccaaagcuccuccaugagaaagaccgacuggcugccgaugacgguggcggccaugggcgugccgccccucccgcuguuuaucuucucccugaaggacacucucaaacgccgcagcuggccucugaacgaggggguaauggccgugggcuugguauccauccucgccagcucccugcugcggaacgauguccccauggccggcccccucguggccggcggccuauuaaucgcaugcuacguuaucaccgggaccagcgccgaccucacggucgagaaggccgccgacgugacaugggaggaagaggcggagcagacgggggugucccacaaccugaugauuaccgucgacgacgacgggacuaugcgcaucaaggacgacgaaaccgagaacauccugacuguacuccugaagacggcgcugcucaucgugagcggcaucuuccccuacuccaucccggcgacccugcugguguggcacacguggcagaagcagacccagaggagcggcguauuaugggacgugcccagcccgcccgaaacccagaaggccgagcuggaggaggggguuuaccgcaucaagcagcagggcaucuucgggaagacccaggugggcguggggguccaaaaggagggcguguuccacaccauguggcacgucacccggggcgccgucuugacuuacaacggcaaacgacucgagccgaacugggcgagcguaaagaaagaccuuaucuccuacggagguggcuggcggcugagcgcccaguggcagaagggugaggagguucaggucaucgccguggagcccgguaagaaccccaagaacuuccaaaccaugcccggcaucuuccagacgaucacuggagagaucggcgcuaucgcgcuggacuucaaaccggggaccuccggcaguccuaucaucaacagggagggaaaaguggucgggcucuauggcaacgggguugugaccaaaaauggcggcuacgugagcgggaucgcccagacgaaugcagagcccgacggcccgacccccgagcuggaggaagagauguucaagaaacgaaaccugaccaucauggaccuccaucccggaucaggcaagacucgcaaguaccugccaacgaucgugcgggaagccauaaaacgacggcuccgcaccuuaauccuagcccccacccggguggucgcugccgaaauggaggaggcccugaaggggcugcccauccgcuaccagaccacggccacaaagagcgagcacaccggcaaagagauuguggaccugaugugccacgcgaccuucacgaugcggcuucuaucccccgugcgcgucccuaacuacaaccugaucaucauggacgaagcgcacuucaccgacccggccagcaucgccgcccggggauacaucagcacccgcguggguaugggagaggccgccgccaucuucaugaccgccacgccgccggggaccgccgacgccuucccccagagcaacgccccgauccaggacgaggagcgggacauccccgagcguuccuggaacagcggcaacgacuggaucaccgauuucgccgggaagaccgugugguuuguccccuccaucaaggccggcaacgauaucgccaacugccugcgcaagaaugggaagaaggugauucaacucagccggaagaccuucgacaccgaguaccagaagaccaagcugaaugacugggauuucguagugaccacggacaucuccgagaugggcgcgaauuucaaggccgaucgcgugaucgaccccagacgcugccuuaagccgguuauccucaccgauggccccgagcgcgucauccuggccggacccaugcccgugaccguggccucagccgcgcaacgccggggcagggucgggcggaacccgcagaaggagaacgaccaauacaucuuuacggggcagccccugaacaacgacgaagaccacgcucacuggaccgaggccaagaugcuccuggacaacauaaacacccccgaggggauuauccccgcccuguucgaaccugaacgggagaaauccgccgcgauugauggcgaguaccggcucaagggcgagagccgcaagaccuucguugaacugaugcggcgcggggaccugcccguauggcucgcccacaagguggcauccgaggguaucaaauacaccgaucggaaguggugcuucgacggggagagaaacaaccagauuuuggaggagaacauggacguggagaucuggaccaaggagggcgagaagaaaaagcugcggccgcgcuggcucgacgcccggacuuacucggauccacuugcuuugaaggaguucaaggacuucgccgccggacgcaaauccaucgccuuggacuuagugacagagaucgggcggguuccgagccaccuggcccaucggaccaggaacgcgcucgacaacuuagucaugcugcacaccuccgagcacggcgggcgggccuacagacacgcggucgaggagcuccccgagacgauggagacccuccugcugcugggccucaugauccugcugaccggaggcgccaugcuguuccucauuucuggcaagggggugggcaaaaccucuaucgggcugauuugcguggucgccuccaguggcaugcuguggauggcggacaucccccuacaguggaucgccuccgccaucgugcuugaguuuuucaugaugguucugcuuaucccggagcccgagaagcagcggacaccccaggacaaccaacuggccuacguggugaucgggauccugacucucgccgcgaucguggccgccaacgagaugggccugcuggagaccaccaagcgcgaccucggcaugagcaaggagcccgguguaguguccccgacaagcuaccuugacguggaccugcaccccgcguccgccuggacccuauacgcggucgccaccaccgugauaacgccuaugcugcggcacaccaucgagaacaguaccgccaacgugucccuggcagcgaucgccaaccaggcagucgugcucaugggccuggacaagggguggccuauuucgaaaauggaccugggcgugccgcuucuggccuuagggugcuacucacaggucaacccccugaccuuaacggccgcgguucugcucuuaguaacccacuaugccaucaucggucccggccuucaggcuaaggccaccagggaggcccaaaagagaaccgcggccggaaucaugaagaacccgacgguagauggcauaaugaccaucgacuuggacccggugaucuacgauagcaaguucgaaaagcagcugggccaggugaugcuguuaguccugugcgccgugcagcugcuccugaugaggaccuccugggcguucugcgaagcccugacccucgcgacgggccccauaaccacucugugggagggcagccccgggaaguucuggaacaccacgaucgccguguccauggcuaacauuuuccggggcagcuaccuggccggggccggccucgcguucuccaucaugaaaucagucgggaccggcaagcgcggcaccgggagccagggcgagacccugggggagaaauggaagaagaagcugaaucaacucagccguaaggaguucgaccuguacaagaaguccggcaucacggagguagaucgcaccgaggcaaaggaggggcugaagcggggcgagaucacccaccacgccgugucacgcggcagcgccaaacuccagugguucgucgaacguaauauggugauccccgaggggcgggugaucgaucugggcugcgggcguggcgggugguccuauuacugcgcgggcuugaagaagguuaccgaggugcgcggcuacaccaagggcgggccggggcacgaagagccugugcccaugagcacguacggguggaacaucgucaagcuuauguccgggaaggacguguucuaccugccgccggagaagugcgauacguuacugugcgacauuggcgagaguucacccagccccaccguagaagagucccggaccauccgcguccuuaagaugguugagcccuggcugaagaacaaccaguucugcaucaaggugcugaacccguacaugccaacggucaucgagcaccuagaacggcugcaacggaagcacggcggaaugcuggugagaaacccccucagccggaauuccacucacgaaauguacuggaucagcaacggcacugggaacaucguguccagcguaaacauggugucccgucuccuacucaaccgcuucaccaugacuuaucgucggcccaccaucgagaaggacgucgaccugggcgccggaacccgccacgugaacgccgaaccggagacucccaacauggacgugaucggcgagcggauccgccggaucaaggaggagcacagcucaaccuggcacuacgacgacgagaaccccuacaagaccugggccuaccacggcagcuacgaagucaaggccacggguagugcgagcaguaugauuaacggcgugguuaaguugcugaccaagcccugggacgucgugcccacagugacccagauggcgaugaccgauaccacgcccuuugggcagcagcgcguauucaaggaaaagguggacacacggacccccaagcccaugcccggcacacgcaagaucauggagaucacggccgguuggcuauggcggacccugggacgcaacaagcggccccgccucugcacccgggaggaguucaccaagaaggugcgcacgaacgccgccaugggagcgguuuucacugaggagaaccagugggacuccgcccgagccgccguggaggacgaggaguucuggaagcugguggaucgggagcgggaguuacacaagcaagggaagugcggcagcugcguuuacaacaugauggggaagcgggagaagaagcucggcgaauucgguaaggcgaaggggucccgcgcuaucugguauauguggcugggcgcccgguaccuggaguucgaggcccucggguuccugaacgaggaccacugguuuagccgcgagaacuccuacagcggcguggagggugagggccugcacaagcucgguuacauccuacgggauaucuccaaaauccccgggggugccauguacgcggacgacaccgccggcugggacacuaggaucacggaagacgaccugcacaacgaggagaagaucacccaacagauggacccggaacaccggcagcucgccaacgccaucuucaagcugaccuaccagaacaagguggucaaggugcagcgccccacgcccaaggggacagugauggacaucaucagucggaaggaccagcgcggcuccgggcaggucgggacauacgggcugaacaccuuuaccaacauggaggcgcagcucauccgccagauggagggcgaggggguccugagcaaaaccgaccuggagaacccccaccucuuagagaaaaagaucacgcaguggcuggagaccaagggcguggagcgccugaaacgaauggcuaucuccggugaugacugcgucgugaagccgaucgacgaccgcuucgccaacgcccugcuggcucucaacgauauggggaagguucgcaaggacaucccccaguggcagcccagcaaggguuggcacgacuggcaacagguccccuucugcagucaccacuuccacgagcugaucaugaaggacgggcgcaaucugguggugccgugccggccccaagacgagcuaaucggccgcgcgagaaucagccagggggcuggcuggucccuaaaggaaaccgccugccucggcaaagccuacgcccagaugugggcccucauguacuuucaccgacgcgaccugcggcuggcgagcaacgccaucugcagugccguccccgugcacugggugccaaccagccguacgaccugguccauccacgcccaccaccaguggaugaccacugaaaacaugcucacaguguggaaucgcguguggauagaggacaacccguggauggaggacaagacucccgugaccaccugggaggacguccccuaccuggggaaacgggaggaccagugguguggcagcuugauagggcucaccucccgggcaaccugggcccagaacauacucaccgccauccagcagguccggucccugauuggcaaugaggaguuccuagauuacaugccuagcaugaagcgguuccguaaggaggaggaaagugagggggccaucugguga

SEQ ID NO: 26161 - RNA, 9873 nt, Artificial Sequence
  derived and/or modified CDS sequence (opt11) from DENV-3__JQ920481__SS-prME
acaagccugugccugaugaugaugcugcccgcgaccuuggcauuccaucucacuagccgggauggagagccccggaugaucguggggaagaaugagcgcgggaaaagccuucuguucaagaccgccuccggcauuaacauguguacccucauugccauggaccugggggagaugugugaugacacugugaccuauaagugcccauuaaucacagagguggagcccgaggacaucgauugcugguguaaccucaccuccaccugggugaccuacgguaccugcaaccaggccggcgaacaccggcgcgauaaacggagcguagcgcuggcgccgcacguugggauggggcuggacacccgcacccagaccuggauguccgccgagggcgcuuggagacagguggaaaaggucgaaacaugggccuuccgccaccccggguucaccauccucgcccuauuccucgcucacuacauagggacaucucucacgcaaaagguggugaucuucauucuucugaugcuugucacgcccaguaugaccaugcgaugcgugggagugggcaaccgggacuucguugaaggccucucuggcgccaccuggguggacguuguccuugagcacggcggaugcgugacgaccauggccaaaaacaaaccgacccuagacaucgagcuucagaaaaccgaagccacucagcucgcuacccuccgcaaacuaugcauugaggguaagaucaccaaugugacuacggacucucgcugccccacgcagggcgaggcgauccuacccgaagaacaggaucagaacuacgucugcaagcacacguacguggaccgcggguggggcaacggaugcgggcucuuugggaaggggucccuaguuacuugugccaaguuccaaugccuggaaagcaucgagggcaaggcgguucagcacgagaacuugaaguacacagugaucauaaccguucacacgggggaccagcaccaggucggcaacgagacacagggggugacugccgaaaucacgccgcaggcaucgaccgucgaggcgauccucccugaauacggcacgcugggguuagaauguagcccacggaccggacuggauuucaacgagaugauccuguugacaaugaagaacaaagcguggaugguacaccgucagugguucuuugaccugccucuccccuggacguccggggcgacgacagagacgccuaccuggaauaagaaggagcuacuggucaccuuuaaaaacgcccaugccaagaaacaggaggucgugguacugggcagucaagagggugcgaugcauaccgcacucacgggggccacugaaauccaaaccagcggcgggaccucgaucuuugcaggacaccugaagugucgucugaagauggacaaacucgaguuaaagggcaugucuuacgccaugugccugaacgccuucguucucaagaaagaggugucggaaacgcagcacgggacaauacugaucaagguggaauacaagggcgaggacgcccccuguaagaucccguucagcacagaggacgggcaggguaaggcccauaacggccggcugaucacugccaaucccaucgucacgaagaaggaggaacccgugaacaucgaggccgaaccgccguucggcgaguccaacaucgucaucggcaucggggacaaggcccuaaagaucaacugguacaaaaagggcucauccaucgggaagauguucgaggccacugcacgaggagcccggcggauggcgauacucggugacaccgccugggacuucgggaguguugggggcguucugaacucccugggcaagauggugcaccaaaucuuuggaagcgccuacacagcccucuuuucuggcgucagcuggaucaugaagauagggaucgguguauuacuaacguggaucggccucaauuccaagaacaccagcauguccuuuucaugcaucgugauugggaucaucacgcuguaccugggcgcggucgugcaagcggacauggguuguguaaucaacuggaagggcaaggagcuuaagugcggcuccgguaucuucgucaccaacgaggugcacacguggaccgagcaguacaaguuccaagccgacagccccaaacggcuggcaacagccaucgcgggcgcaugggaaaacggcgugugcggcauccgcuccacuacucgcauggagaaucugcucuggaagcagauugccaacgaacuaaacuacauccugugggagaacaacaucaaacucaccgucgugguaggggauguaaucggcgugcuggagcagggcaaacggacccugacgccccagccaauggagcugaaguacaguuggaagacauggggcaaggccaagaucguaaccgccgaaacccaaaauaguaguuucaucaucgacgggccgaacacccccgagugcccauccgcgucccgugccuggaacgucugggagguagaggacuacggguucgguguguucacaaccaauaucuggcugaagcugagagagauguacacgcagcucugcgaucaccgccugaugagcgccgccguaaaagacgagcgggccgugcacgcggacaugggcuauuggauagagucccagaagaacgguucauggaaauuagagaaggcguccuuaauugaggucaagaccugcacuuggcccaagagccacacgcuuuggaguaacggcguccuggaaagcgauaugaucaucccgaaauccuuggcuggucccaucucacaacauaacuaucgcccuggcuaccacacccagaccgcagggccguggcaccuugggaagcuggagcuugacuucaacuacugcgagggcacaacgguagugaucaccgagaacugcggcacccggggccccagucugcgcaccacuaccgucagcgguaagcugauccacgaguggugcugucgguccugcacgcugccgccccuacgcuacaugggcgaggacggguguugguacggcauggagauccgcccgaucaacgaaaaagaggagaacauggugaaaagccuugugucagcgggaagcgguaaggcugacaacuucacaaugggaguucucugccucgccauccuguucgaggaagucaugcgcgggaaauuugggaagaagcacaugaucgccggggcccucuucacguucgucuuacugcucucaggccagauaaccuggcgugacauggcccacacccugaucaugauuggcucaaacgccagcgaccguauggggaugggcgugaccuaccuggcucuuauagccaccuucaagauccaacccuuccuggcccuuggauuuuuccuccgcaagcugacaucucgcgaaaaccugcuccucggcgugggcuuggccauggccaccacccuacagcugcccgaggacaucgaacagauggccaacgguaucgcccugggacucauggcccugaagcugauuacacaguucgaaaccuaccagcucuggacugcgcuggugagccuuauguguucgaacacgaucuucacguugaccgucgccuggcggaccgcuacccugaucuuagcugucaucagcuuacugcccgugugccaaucgucuuccaugagaaagacagauugguuaccgaugaccgucgccgcgaugggggugccgccccucccccuguucauuuucagccugaaggacaccuuaaaacggcgcuccuggccucugaacgaaggcguaauggccgugggguuggugucgauccucgccuccagcuuccugcgcaaugacguccccauggcaggcccgcugguugccggaggguuacucauugcgugcuacguaaucaccggaacguccgccgaccugaccgucgagaaggccgccgacgugaccugggaggaggaagccgagcagacuggugugagccacaaccucaugaucacugucgacgacgacggaaccaugcgcauuaaggacgacgagaccgagaacauccugacuguucugcucaagaccgcgcugcuuaucguuagcgggaucuuccccuacucuaucccugccacacuacuggucuggcauaccuggcagaaacaaacccagcgcaguggcgugcucugggaugugcccucaccgcccgagacccagaaggcagagcuagaggaaggcguauaccgcaucaagcaacagggcaucuucggcaaaacccagguaggggugggcguccagaaagaaggcguguuccacacaauguggcauguaacccgcggcgcuguucugacccacaacggcaagcgacuggaaccgaacugggcgaacgugaagaaagacuuaaucuccuauggggguggguggaagcugagcgcgcaguggcagaagggagaagaagugcaagucauagcgguggaaccgggcaagaaccccaagaacuuccagacgaugccagggaucuuccagaccacuaccggcgagaucggggccaucgccuuagacuucaagccuggcaccuccggauccccuaucaucaaccgcgaaggaaaaguggucgggcucuacgggaacggcguggugaccaaaaauggaggguacgucagcgggaucgcacaaaccaacgcggagccagacggaccgacccccgaguuggaggaggaaauguucaagaagcggaaccugacgaucauggacuuacaccccggcuccgggaagacccgcaaauaucuccccgccauaguccgggaggccaucaaacgucggcuaaggacccugauccucgccccgacccgggugguggcggccgagauggaggaggcccugaagggccuucccauccgcuaucagacgaccgccaccaagagcgagcacacggggcgagaaauaguggauuugaugugccacgcgacguuuaccaugcggcuguuguccccuguacguguuccuaauuacaaccucauugugauggacgaggcgcacuucacggacccugccagcaucgcagcccgcggcuacaucuccacgcggguggggaugggcgaagcggcugcaauuuucaugacggcuacgccucccggaaccgccgaugcguucccucagagcaaugcuccgauacaggacgaggaacgugacauccccgagcgcuccuggaauagcgguaacgaauggaucaccgacuucgccggaaagacggucugguuugugccauccaucaaagcaggaaacgacaucgccaauugccugcgcaaaaacggcaagaagguuauucagcuaagcaggaagaccuuugacaccgaauaccagaagaccaagcucaacgacugggacuuugucgucaccaccgauauaucagagaugggggcgaacuucaaagcugaccgggugaucgacccucgccggugccuuaagccggucaucuuaaccgacggcccagagcgcgugauccucgccggccccaugccgguuacagucgcaucggccgcgcagcggcgcggacgagugggccggaacccacagaaggaaaacgaucaguacauuuucacugggcaaccgcugaacaacgacgaggaccaugcgcacuggacggaggccaagaugcuccucgacaacaucaacacuccugagggaauuauuccugcucuguuugaaccugagcgggagaagagugcagcaaucgacggcgaguaccgccugaagggcgagucaagaaagaccuucgucgagcucaugcgccgcggugacuuacccguuuggcuggcccauaaaguggccagcgagggaaucaaguauacggaccgcaaguggugcuucgauggcgagcggaauaaucagauacucgaagaaaauauggaugucgaaaucuggacgaaggaaggcgagaagaagaaacuucgucccagguggcuggaugcacgcaccuacagcgacccgcucgcccucaaggaguucaaggauuuugccgccggccggaaguccaucgcgcuggaccucguuacagagaucgggcgaguuccgagccaucuagcucaccgcacucguaaugcucuagacaaccucgucaugcugcacacgagugaacacggaggccgugccuaccggcacgccguggaggaacuaccggagaccauggaaaccuuacuccuguuggggcugaugauacugcucaccggcggagccaugcuguuccugaucuccgggaaaggcaucgggaagacaagcaucggacucauuugcguggucgcguccuccggcaugcuguggauggcggacgugccucugcaguggaucgccagugccaucgugcucgaguuuuucaugaugguacuucugauaccggagcccgagaagcagcguacgccgcaagacaaccaguuggcauacguggugauaggaaucuuaacccucgccgcgauuguugcagccaacgagaugggguugcuugagacuacuaagcgcgaccugggcaugucuaaggaacccgguguggucucaccuaccagcuaccucgaugucgaucugcaccccgccuccgccuggacgcuguacgccguggccaccacggugauaaccccgaugcugcgccauaccaucgagaacucaacugcgaacgucagucuggcggcgauugccaaucaagcaguggugcugauggggcuggauaaagguuggcccaucucuaagauggaucugggggugccacucuuggcauugggcugcuacagccaggucaacccccuaacgcucacggccgcgguucuccuacucguaacccacuacgccaucaucggaccuggccugcaggcuaaagccacuagggaggcgcagaaaaggacggccgccgggaucaugaaaaaccccaccguggacgggaucaugacgauagaccuugaccccgugauauacgauagcaaguucgagaagcagcuuggccaggucaugcuucuggugcugugugccguucaacugcuuuugaugcggaccuccugggcguucugcgaggcccugacgcucgcaaccgggccuauaaccacccucugggaagggucacccggcaaguucuggaacacaacgaucgcgguuuccauggccaauaucuuccgggggaguuaccuugccggcgcggggcuggccuucuccaucaugaaaagcguggguaccgggaaacgggguacaggcucacagggggagacccucggcgagaaguggaagaagaaguuaaaccagcugagccgcaaggaguuugaucuuuacaaaaagagcggcaucaccgagguggaccgaaccgaagcgaaggaggggcugaagcgcggggagaucacccaucaugccgucucccgcggcucagccaagcugcagugguuugucgaacgaaauauggugauccccgagggccgggucaucgaccuugggugugggcgcgguggcugguccuacuauugcgcggggcuuaagaaaguaacugagguacggggcuauacgaagggcgggccgggccacgaggagcccguccccauguccacguacggguggaacaucgucaaacugauguccggaaaggacguguucuaccucccgcccgagaagugcgacacccugcugugcgacaucggcgagucgucucccagccccacagucgaggagucucgcacaaucaggguucugaagaugguggagccguggcucaagaacaaucaguucuguauuaaggucuugaauccguauaugcccaccgugauagagcaccuggaacgccuccaacgcaagcacgguggcaugcugguccggaauccccucucucguaacagcacccacgagauguacuggaucucaaacggaaccggcaacauugucuccagcgugaacauggugucccgucuccugcugaaucgcuuuacuaugacccacaggcgacccaccauugaaaaagacguggaucuuggagccggcacccggcacgugaacgccgagccggagacucccaacauggaugucaucggcgaacgaauacggcgcaucaaggaggaacacagcagcaccuggcacuacgacgacgagaacccuuacaagaccugggccuaccacgggagcuacgaggugaaggccaccgguuccgccucgucuaugaucaacgggguggucaagcugcucacgaaacccugggacguuguacccaugguuacccagauggcaaugaccgacaccacuccguucgggcagcagcguguguucaaggagaaagucgacacgcggacgccccguccgaugcccggaacccgcaaggucauggagaucacagcggaauggcucuggaggacucuaggccguaacaagcgcccacgucugugcacacgcgaggaauuuaucaagaaaguccgcacgaaugccgcaaugggcgccgucuucacagaggagaaccaaugggacuccgccagggccgccgucgaggacgaggaguucuggaagcucgucgaccgcgaacgcgaacugcacaagcuggggaagugcggaagcugcguguacaacaugauggggaaacgggagaagaagcucggcgaguucgggaaggcgaagggaucgcgcgccaucugguacauguggcugggagcacgauaccuggaguucgaggcccuagguuuccucaacgaggaucacugguucagcagggaaaacuccuacucuggcgucgagggggagggccugcacaagcucggguacaucuuacgagauaucucaaagauucccggcggcgccauguacgcggaugacacugccgggugggacacacggauaaccgaagacgaccuccauaacgaggaaaagaucacgcagcagauggacccggagcaccggcaguuggccaacgccaucuucaaacugaccuaccagaauaaagugguaaagguccaacggccgaccccgaaggggaccgugauggacaucaucucaagaaaggaccagcgaggguccggccaggugggcacguaugggcugaacaccuuuaccaacauggaagcacagcuaaucagacagauggaaggagaggggguacugagcaaagcggacuuagagaacccccauuuguuggagaagaaagugacccagugguuagagaccaaagggguggagcgccuaaaacggauggcuaucagcggggacgauugcgucguaaagcccaucgaugaccgguucgcaaacgcccuguuagcgcucaacgauauggggaaaguucguaaggacaucccccaguggcagccaagcaagggcuggcaugacuggcagcagguccccuucugcucccaccacuuucacgaacugauaaugaaggacgggcguaaacuuguaguaccgugccggccccaggacgaacucaucggccgcgcacggauuagccaaggggccggcugguccuugcgcgagacggccugccuggggaaagccuacgcgcagaugugggcacugauguacuuccaccgccgggacuuacgucuggcgagcaaugcuaucuguuccgccguccccgugcauugggugcccaccagccggaccacauggaguauucaugcucaccaucaguggaugacuacagaagacauguugaccgucuggaaccgaguguggaucgaagauaacccguggauggaggacaagacucccgugacgaccugggaggauguccccuacuuaggcaagcgggaggaccaguggugcggcagucugaucgggcucaccagccgagcgacgugggcucagaacauccugacugccauccagcagguccggucucugaucggcaacgaagaguuucuggacuacaugccuucuaugaagagauuuaggaaggaggaagaauccgagggggcgaucugguga

SEQ ID NO: 26162 - RNA, 9873 nt, Artificial Sequence
  derived and/or modified CDS sequence (opt11) from DENV-3__JQ920483__SS-prME
accagcuugugccucaugaugaugcugccggcuacccuggccuuccaccucaccagccgugauggggagccccggaugaucguggggaagaacgagcgggggaagagccugcuuuucaagaccgccagcgggaucaacaugugcacccugaucgccauggaccugggcgagaugugcgaugacaccgugacuuauaagugcccccugaucacugagguggagcccgaggacaucgacuguugguguaaucuuaccagcaccugggugaccuacgggacuugcaaccaggcuggcgagcaucggcgcgacaagagguccguggcccuagcgccgcauguggguaugggacuggacacccgcacccagaccuggaugagcgcggagggagccuggcgccagguggaaaaggucgagaccugggccuuccgacaccccggguucacaauccucgccuuauuccucgcacauuacaucggcacuucccucacgcagaaggugguuaucuucauacugcugaugcucguaacaccgagcaugaccaugaggugcgugggggugggcaaucgggacuucgucgaaggccuguccggggccacuuggguagaugugguccuagagcacggggggugcgugacgaccauggccaagaacaagcccacgcucgacaucgagcugcagaagaccgaggccacgcagcuggcaacccuccggaagcugugcaucgagggcaagaucaccaacgugacaacggacagccgcugccccacacagggcgaggcgauccugcccgaagagcagaaccagaacuacgucugcaagcauacauacguggaccgggguuggggcaacggguguggcuuguucgguaagggcucccuggugaccugcgccaaguuucagugccuggagagcaucgagggaaaagccguccagcacgagaaccucaaguacacggugaucaucaccguccacacaggggaccagcaccaagucggcaaugagacccagggggugacggccgaaauuacgccccaggcguccaccguggaggcgauacugcccgaguacgggacccugggccucgagugcagcccccgcaccggccuggacuucaacgagaugauccugcucacgaugaagaacaaggccuggauggugcaccggcagugguucuucgaccugccgcugcccuggaccucuggugcaaccacugagacgccgacauggaacaagaaggaguugcuggucaccuucaagaacgcccacgccaagaagcaggaggucguagugcucgggagccaggagggcgcgaugcacacggcccucacgggggccacggagauucaaacuuccggugggacuucaaucuucgccggccaccugaagugccgcuuaaaaauggacaaauuggaguugaaaggcauguccuaugcuaugugccugaacgcuuucguccucaaaaaagagguuagcgagacgcagcacgggaccauacugauaaaggucgaguacaagggcgaggacgcaccaugcaagauccccuucagcaccgaggacgggcaggguaaagcucacaacggccggcugauuaccgccaacccgaucgugacgaaaaaggaagagcccgucaacaucgaggcggagccacccuuuggcgaguccaacaucguuaucgggaucggggacaaagcacugaagauuaacugguacaagaagggcagcuccaucgguaagauguucgaggccaccgcccggggggcccggcgcauggcaauccucggcgacacugcaugggacuucgggagcgucggcgggguccugaacucccugggcaagauggugcaccagaucuuugggucggccuauaccgcccucuucucuggcgucagcuggauaaugaagaucggcaucggagugcuucugacguggauuggacucaauuccaagaacaccagcauguccuucagcuguaucgugauagggaucaucacccuguaccugggcgccgucgugcaggcugacauggggugcguaauuaacuggaaaggcaaggagcugaagugcggcuccgggaucuucgugaccaacgaggugcacacauggaccgagcaauacaaguuccaggccgacagucccaagcggcuggcgaccgccaucgccggcgcgugggagaacggggucugcggcauccgcuccaccacgcgcauggagaaccugcucuggaagcaaaucgccaacgagcugaacuacauccucugggagaacaacaucaaacucaccaucgucguaggggacgugaucgguguccuggagcagggcaaacggacccugacaccccagccaauggaacucaaguacucuuggaagacuuggggaaaggccaagaucgugacggcugagacccagaacuccagcuucaucaucgacgggcccaacaccccugagugccccucggccucccgcgccuggaacguuugggaggucgaggacuauggcuuuggcguguucacgaccaauauuuggcugaagcuucgggagaaguacacccaacucugugaucaccgccugaugagcgccgccgugaaggacgaacgggccguccacgcggacaugggcuacuggaucgagucccagaagaacgggagcuggaagcucgagaaggccucccucaucgaggugaagaccuguaccuggcccaagagccauacgcugugguccaacggcgugcuggaaagcgacaugauuaucccgaaaucccucgcagggcccaucagccagcacaacuaccgccccggcuaccacacccaaaccgccgggccguggcaccugggcaagcuggagcucgacuucaacuacugugagggcaccacggucguaaucaccgagaacugcgggaucaggggcccgagccugcggacuaccacggugagcgguaagcuuauccacgagugguguugccgguccugcacccugccgccccuccgcuacaugggcgaagacgggugcugguacgguauggagauccggccgaucaacgagaaagaggaaaacauggucaagucgcugguguccgccggcagcgggaagaccgacaauuucaccaugggcgugcuaugccuggcgauucuuuucgaggaggucaugcgcgggaaguucggcaagaagcacaugauagcgggggcccuuuucacguuuguucugcugcuauccggccagaucaccuggcgggacauggcccauacccuaaucaugaucgguagcaacgccuccgaucgcauggggaugggcgugaccuaccuggcgcucauugccacuuucaagauccagcccuuucuggcccugggguucuuucuccgaaaauugaccagccgggagaaccugcuucugggcgucggccuggcuauggcgaccaccuugcagcugcccgaggacaucgagcaaauggccaacggaaucgcccuggggcucauggcccugaagcugaucacgcaguucgagaccuaccagcucuggaccgccuugaucagccuaauguguuccaacaccaucuucacucucaccguggcguggcggaccgccacccugauccuggccgugauuagccuccugcccgucugccaguccuccuccaugagaaagacggacuggcugccgaugaccguggccgccaugggggugccgccucucccccuguucaucuucagccugaaggacacccuaaagcggcgcuccuggccguuaaacgagggcgucauggcggugggguuagucuccauacucgccuccagcuuuuugcguaacgacgugcccauggccgguccccugguggcaggagggcuccugauugccuguuacgucaucaccggcacgagcgcggaccugaccguggagaaggccgccgauguuaccugggaggaagaggccgagcagaccggggucucgcacaaccucaugaucacuguggacgaugacggcaccaugcggaucaaggacgacgaaaccgagaacauccugaccgugcuucucaagaccgcccugcuuauugucuccgggaucuuccccuauagcaucccggcgacgcuccugguguggcacacuuggcagaagcagacacagcgcucuggcguucugugggacguccccuccccgcccgagacccaaaaggccgagcucgaggaaggcguuuaccggaucaaacagcaggggaucuucggcaagacccaggugggggucggcgugcagaaggagggcguguuccacaccauguggcaugucacccgcggugccguguugacccacaaugggaagcggcuggagccgaacugggcuaacguaaagaaggacuugaucucauacgggggcggguggaagcuaagcgcgcaauggcagaagggggaggagguccaggucaucgccguggaacccgggaaaaaucccaagaacuuccagacgaugcccgguaucuuccagacuaccaccggcgagaucggggccaucgcccucgacuucaagcccggcacguccggaagccccaucaucaacagagagggcaaggucgugggccuguacggaaacgguguggucaccaagaacgggggcuacgucagcgggaucgcacaaaccaacgcugagcccgauggcccgaccccagaguuagaggaggagauguuuaagaagcggaacuugacgaucauggaccuccaccccggcuccgggaagacccgcaaguaccucccagccaucgugcgcgaagccauuaagcggcggcuccgaacccugauacucgcacccacccggguuguggccgcagagauggaggaggcccugaagggccugcccauucgcuaccagaccacggccacuaagagcgagcacaccgggcgggagaucguggaccugaugugccacgcaacguuuaccaugcgccuacucucccccgucagggugcccaacuacaaccuaaucgugauggacgaggcccauuucaccgaccccgcgagcaucgccgcccggggcuacaucuccacccgggucggcaugggcgaggccgcggccaucuucaugacggccacuccgcccgguaccgccgacgccuuuccccagagcaacgcgccgauccaggaugaggagcgcgacaucccggagcgcuccuggaacagcgggaacgaguggaucacugauuucgcgggcaagacggugugguuugugcccuccaucaaggccggcaacgauaucgccaacugccugcgcaagaacgggaagaaggucauccaguuaucccgcaagaccuuugacaccgaguaccagaagacaaaacucaacgacugggacuucguggugacgaccgacaucuccgagaugggggccaacuuuaaggcggaccgggucaucgacccccgccggugucugaagccggugaucuuaacggacggccccgagcgcgugaucuuggccggccccaugcccgucaccguggcgucggcagcacaacggcgcgggcgggugggccgcaacucccagaaggaaaacgaccaguacaucuucaccgggcaaccgcuaaacaacgacgaggaccacgcccacuggaccgaggcgaagaugcugcucgauaacauaaacacacccgaaggaaucauccccgcucuguucgagcccgaacgggagaaguccgcagcuaucgauggggaguaccgccugaagggcgaaucacggaagaccuucgucgaguugaugcgccggggcgaccugccuguauggcuggcacacaagguugccagugaagggaucaaguacacagaccgcaaguggugcuucgacggugagcggaacaaccagauccucgaggagaacauggacgucgagaucuggacgaaggagggggagaagaagaagcugcgcccccgguggcuggacgcccgcacguauuccgauccccucgcccugaaggaguuuaaggacuucgcggccggucggaagagcauugcgcuggaccucguuaccgagaucggccgcgugcccucccaccuggcucaccgcaccaggaacgcccuggauaaccucgugaugcugcacacgagcgagcacgggggccgcgcguaccggcacgccgucgaggagcugccagagaccauggagaccuuacugcugcuaggucugaugauccugcucaccggcggggcgaugcuguuucugaucuccggcaagggcaucggaaagacguccaucgggcucaucugcgucguggccagcuccgggaugcuguggauggccgacguuccucugcaguggaucgcgucggccaucguccucgaguucuucaugaugguacugcugaucccggagccagagaagcagaggacgccccaggacaaccagcucgccuacgucguaaucggcauccugacccuggcugccaucguggcggccaacgaaauggggcucuuggagacuacaaagcgggacuuggggaugagcaaggagcccgguguggucagccccaccuccuaccucgauguagaccuacacccggccagcgccuggacccuguacgcgguggcgaccacggucaucacccccaugcucaggcauacuaucgagaauuccaccgccaaugugagccuggcagccaucgcgaaccaggcagugguccugaugggccucgacaagggcuggcccauuucaaagauggaccugggggugccccugcucgcccugggcugcuacagccaaguaaacccacugacgcucaccgccgccguucuucugcucgugacccacuacgcuaucauagggccaggccugcaagccaaggccacccgggaggcccagaagcguacggcugcgggcaucaugaaaaacccuacgguggacgguauaaugaccaucgaccuggaucccgucaucuaugacuccaaauucgaaaagcagcucggccaggugaugcuguuagugcucugcgcgguccagcugcugcuaaugcggaccagcugggccuucugugaggcgcugacgcuggcaacagggccgaucaccacccucugggaggggucccccggcaaguucuggaacacgaccaucgccguguccauggccaacaucuuccgcgggucguaccuggccggcgccgggcuagcguucucaauaaugaaguccgugggcacugggaagaggggcaccggcagccagggagagacgcucggcgaaaaguggaagaagaagcugaaucagcugagccgcaaggaguuugaccucuauaaaaaguccgggaucaccgagguggaccggaccgaggccaaggagggucugaagcgcggugagaucacccaccacgccguaagccggggcucggccaagcugcagugguuuguggagcgcaacauggucauacccgagggccgggucaucgaccucggguguggacgcgggggcuggagcuacuacugcgccggccugaagaaggucacagaggucaggggcuacaccaaaggaggccccggccacgaggagccggugcccauguccacauauggcuggaacaucgugaaacuuaugagcgggaaggacgucuucuaccugccgcccgagaagugugacacccugcuuugcgacaucggggaguccagcccgucccccaccguggaggagagccgcaccauccgggugcuuaagauggucgagccguggcucaagaacaaccaauucugcaucaaagugcugaaccccuacaugccgaccgugaucgagcaccucgaacgccuccagcgcaagcacggcggcaugcuggugcguaacccccucucccgcaacucuacccacgagauguacuggaucuccaacgggaccggcaacauagugucaucggugaacauggucucccggcugcuguugaaccgcuucacgaugacccaucggcgccccaccaucgagaaggacguggaccucggggcgggaacacggcacgugaacgccgagccugagacgccgaacauggauguuaucggcgagcgcauccgacgcaucaaggaggagcauuccagcacguggcacuacgaugacgagaaccccuacaagacaugggccuaccaugguuccuacgaagugaaagccacaggcagcgccagcucaaugaucaacggggucgugaagcugcugacgaagcccugggacguugugccgauggugacccagauggcgaugacagacaccacgcccuucggccagcagcggguguucaaggagaaggucgacacuagaacaccccggcccaugccugggaccagaaaggugauggagaucaccgccgaguggcucuggcggacccuaggccgaaacaagcgaccccgccugugcacccgggaagaguucauaaagaagguccgcaccaaugccgccaugggcgcggucuucaccgaggagaaucagugggacagcgcccgagccgccguggaggaugaggaguuuuggaagcucguggaccgagagcgcgagcugcacaagcugggcaagugcggcuccugugucuacaauaugauggggaagcgugagaagaagcucggcgaguucgguaaagccaagggaagccgcgcaauuugguacauguggcugggcgcccgguaccuagaguucgaggcccucggguuccugaaugaagaccauugguucagccgcgaaaacagccacuccggcguggagggggaaggccugcacaagcucggauauaucuugcgggacauuagcaagaucccaggcggcgccauguacgccgacgauaccgcggguugggacaccaggauaaccgaggacgacuuacacaaugaggagaagaucacgcaacagauggaucccgaacaccggcagcucgcgaacgcuaucuuuaagcugacauaccaaaacaagguugucaaaguucaacgcccgacccccaagggcacaguuauggacaucaucucccgcaaggaccagcgcggaucaggccaagucggcaccuacgggcugaacaccuucaccaacauggaagcccaacuaauccggcagauggagggggaggggguucuauccaaggccgaccuggagaacccucaccucuuagagcgcaaggugacccaguggcuggagaccaaaggcgucgagcggcucaagcgcauggcgaucuccggggacgauugcguggugaagcccaucgacgaccgguucgccaacgcccugcuagcccucaacgacaugggcaagguccgcaaggacaucccgcaguggcagcccuccaagggcuggcacgacuggcaacaggucccguucugcucucaucacuuucaugagcugaucaugaaagacgggcggaaguuagugguccccugccgcccgcaagacgagcucauaggccgagcacgcaucucccaaggggcgggcuggagccugcgcgagacugccugccuggggaaggccuacgcccagaugugggcgcucauguauuuccaccggcgcgaucuucggcuagccuccaacgccaucugcagcgccgugcccguucacuggguccccaccucccgcacuaccuggagcauccacgcacaccaucaguggaugaccacugaggacaugcuaacgguguggaacagaguguggauugaagacaacccauggauggaggacaagaccccgguuacgaccugggaagacgucccuuaccugggaaagcgcgaggaccaguggugcggcagccuaauugggcucaccagccgggcgaccugggcccagaauauucuaacggccauccagcagguccgcagccucaucgggaacgaggaguuccucgacuacaugcccaguaugaagcguuuccgcaaagaggaggagucagagggggccaucugguga

SEQ ID NO: 26163 - RNA, 9873 nt, Artificial Sequence
  derived and/or modified CDS sequence (opt11) from DENV-3__JQ920482__SS-prME
accagccucugccucaugaugaugcuucccgccacucuggccuuccaccucaccuccagagauggcgaaccccggaugaucguggggaagaacgaacggggcaaaagccugcuguucaagaccgccucagggaucaacaugugcacccugaucgcgauggaccucggcgaaaugugcgacgauaccgugaccuacaagugcccucugaucaccgagguggagcccgaagacaucgacuguuggugcaacuuaaccuccaccugggugaccuacggaaccugcaaccaagcaggcgagcaccggcgggauaagcggaguguggcccuggcgccccacgugggcauggggcuggacacacguacccagaccuggaugagcgcggagggcgccuggcgccagguggaaaaagucgagaccugggccuuccgucauccgggguucacaauccuagccuuauuccuggcccauuauaucgggaccucacucacgcagaaaguggugauauucauccuguugaugcucgucacccccagcaugaccaugcggugcguagggguaggcaaccgcgacuucgucgagggccugucuggggccaccuggguggacguggucuuggagcacggcgggugcgugacgacgauggccaagaacaagccuacccucgacauagagcuucagaagacugaggccacgcagcuggccacccuucggaagcuguguaucgagggcaagaucaccaacguaaccacugacagccgcugccccacccagggcgaggcgaucuugcccgaggagcaggaccagaacuacgucugcaagcacaccuacguggaccggggguggggcaacgggugcggcuuguuugggaagggcucucuugugaccugcgccaaguuucagugccuggagagcaucgagggcaaggccgugcagcacgaaaaccucaaauacacgguaaucaucacugugcacaccggcgaccagcaccagguaggcaacgagacccagggggucacggccgagaucacgccccaagccucuaccgucgaggcgauccugcccgaguaugguacccuggggcucgaguguagcccccguaccggccuggacuucaacgagaugauccuccucacgaugaagaauaaggcauggaugguccaccggcagugguucuucgaucugccgcugcccuggacaucgggugccaccaccgagacgcccaccuggaauaagaaggagcuccucgugaccuucaagaacgcccacgccaagaagcaggagguggucgucuuagguagccaggagggcgcgaugcacaccgccuuaacuggggccaccgagauccagaccuccggugggaccucaaucuucgccggccaccuaaagugccgccugaaaauggauaaguuagagcugaagggcaugucauacgccaugugucugaacgcguucguccucaagaaggagguuagcgagacgcagcacgggaccaucuuaaucaagguugaguacaagggcgaggacgccccuugcaagaucccuuucagcaccgaggaugggcagggcaaggcccacaacggccgccugauuacugcuaacccgauagucacgaagaaggaggagccagugaacauagaggcggagccgcccuucggggaguccaacauugucaucggcaucggggacaaggcccugaagauuaacugguacaaaaagggcagcucuaucgggaagauguucgaggccaccgcccgcggcgcccgucgaauggcgauccucggcgauaccgcuugggacuucgguucggucgguggggugcugaacucccugggaaagauggugcaccagaucuucgggagcgccuacaccgcucucuucuccggcgucagcuggaucaugaaaauuggcauaggugugcugcucacguggauaggccucaauucuaagaauaccagcaugagcuucagcugcaucgugauaggcaucaucacccuauaccuaggcgccgucgugcaggcggacauggggugcgugauuaacuggaaaggcaaggagcucaagugcggcuccgggaucuucguuaccaacgagguccacacguggacggagcaguacaaguuccaagccgacagccccaagcgacucgccacugccauugcgggcgcaugggagaacggggugugcggcauccguagcaccacgcgcauggagaaccugcucuggaagcagaucgccaaugagcugaacuacauacugugggagaacaacauaaaacucaccaucgucgugggagacgugaucggcguacucgagcaaggcaagcggaccuugacgccccagcccauggagcucaaguacagcuggaagacguggggaaaggccaagaucgugaccgccgagacccagaacuccaguuucauaaucgacggccccaauacccccgagugccccuccgcuagccgcgccuggaacgugugggaggucgaggacuauggguucggcguguucacgaccaacauauggcugaagcugcgagaaaaguacacccaacucugcgaucacaggcugaugagcgccgccgugaaggacgagcgggcuguccacgcggauaugggcuacuggauagagucccagaagaacggguccuggaagcucgagaaggccucccucauugaggugaagaccuguacguggcccaagagccacacgcuguggucaaauggcgugcuggaaagcgauaugaucaucccgaagucgcucgccgggcccauaagccagcacaauuaccggcccggcuaccacacccagaccgccgggccguggcaccugggcaaacuggagcucgacuucaacuacugcgaaggcaccacggucgugauuaccgagaacugcgguaucagaggccccucacugcgcaccaccacggugagcggcaagcugauccacgaguggugcugccggaguugcacccugccaccccugcgcuacaugggcgaggaugggugcugguacggcauggagauccggccuaucaacgaaaaggaggagaauauggucaagagcuugguguccgccggcagcggcaagaccgacaacuucacaauggguguguugugccuugcgauccuguucgaagaggucaugcgcgggaaguuuggcaagaagcauaugaucgcgggggcccucuuuacguucguguuacuguuauccgggcagaucaccuggcgagacauggcucacacccugauaaugaucggcagcaaugccuccgaccgcauggggaugggcgugaccuaucucgcccucaucgccacguucaagauccaacccuuccucgcccugggguuuuuccuccggaagcugaccagccgcgagaaccugcuccugggcguaggccuggccauggcgaccacccuccaguugccggaggacaucgagcagauggccaacgggauugcccugggccucauggcccugaagcugaucacucaauucgagaccuaucagcuuuggaccgcccucaucagcuugaugugcuccaacacaaucuuuacgcucaccguggcguggcggacggccacccugauccuggccgugaucagccucuuacccgucugccaguccuccuccaugcgcaagacagacuggcuaccgaugacuguugccgccaugggggugccgccccucccccuguucaucuucagccugaaagacaccuugaagcggagguccuggccgcugaacgagggcgucauggccguaggucuggucagcaucuuagccaguucauuucugagaaacgaugugcccauggccggcccucugguggcuggagggcuccugaucgccugcuacgucaucaccggcacguccgcggaccugacaguggaaaaagccgccgacgucaccugggaggaggaggccgaacagaccggggucagccacaaccucaugaucacgguggacgacgacggcaccaugcggauaaaggacgacgagaccgaaaacauccugacugugcugcucaaaacugccuuacugaucgucuccgggaucuucccguacagcaucccggccacgcuccugguguggcauaccuggcagaagcagacacagcgcuccggcguucugugggacgugcccuccccacccgagacgcagaaggccgaacucgaggagggcguuuaccggaucaaacagcaggggaucuucggaaagacccaggugggggucggagugcagaaggaggggguguuccacaccauguggcacgugacccgaggcgcaguucugacccacaacggcaagcggcuggagccgaacugggccaacgugaagaaggaccugaucuccuacgggggcggauggaagcugagcgcccaguggcagaagggggaggagguccaggugaucgccguggagccagggaagaacccgaagaacuuccagacgaugcccgguaucuuccagacuaccacuggcgaaaucggggccaucgcccuggauuuuaagccgggcacguccgggagccccaucaucaaccgcgagggcaaagucgugggacuguaugggaacggcguagugaccaaaaacggcggcuacgugagcgggaucgcccagaccaacgcggagccagacggcccgacgccugagcuugaggaggagauguucaagaagcggaauuugacgaucauggaucugcaccccggcucagggaaaacccgcaaauaucuccccgcgaucguacgggaggccaucaagcgccggcugcgcacccuaauccucgcuccgaccagagucguagccgcggagauggaggaggcgcugaaaggccuacccauucgguaccagacgaccgccaccaagagcgagcacaccggcagagaaauagucgaccucaugugccacgccacguucaccaugcgccugcuguccccuguccgggugcccaacuauaaccucaucgugauggacgaagcucacuuuaccgauccugcgagcauagcagcccgcggcuacaucuccacccggguugggaugggcgaagcggcggccaucuucaugacggccacgccucccggcacagccgacgccuucccccagagcaacgcgccaauccaggacgaggagcgcgacauuccggagcgguccuggaacuccgggaacgaguggaucaccgauuucgccggcaagacugugugguuugugcccuccaucaaggccggaaacgacauagccaacugccuccgaaagaacgguaagaaggucauccagcugagucgcaagaccuucgacaccgaguaccagaagaccaaacucaacgacugggacuucguggugacgaccgacaucuccgagaugggcgccaacuucaaagcggaucgggucaucgacccccgccggugccugaagccggugauccugaccgauggcccugagcgcgugauccucgccggacccaugccagucaccguggccagcgccgcgcaacggcgcgggagggugggccgcaacagccaaaaggagaacgaccaguacaucuucacggggcagccgcugaacaacgacgaggaccacgcgcacuggaccgaggccaagaugcugcucgauaacaucaacacccccgagggcaucaucccagcgcuguucgagccggagagagagaagagugccgccaucgacggcgaguaccgccugaagggcgagucccggaagaccuucguggagcucaugcgcagaggugaccugccgguguggcuggcccacaaaguggcuagcgaagggaucaaguacaccgaccgcaaauggugcuucgauggcgagcggaacaaucagauccucgaggagaacauggacgucgagaucuggaccaaggagggugagaaaaagaaacuucgcccccggugguuggacgcacgcaccuacuccgacccccucgcccuuaaagaguucaaggacuuugcggccgggaggaaaagcaucgcccuggacuuggugacugagaucggccgaguccccagccaccuugcgcaccgaacccggaacgcccuggacaaccucgugaugcugcacacgucagagcacgggggacgcgcguaccggcacgccguggaggagcugcccgagaccauggagacccuccugcugcuagggcugaugauccugcucaccggcggggcuaugcuguucuugaucagcgguaaaggcaucgggaagacguccauaggucucaucugcgucguggcuagcuccgggaugcuguggauggccgacgucccccugcaguggauugcgagcgccauaguccucgaguucuucaugauggugcugcugauccccgagccggagaagcagcgcacgccccaggacaaccaguuggccuacgucguuaucggcauacugacccuggccgccaucguggcggccaacgagauggggcugcuggaaaccacgaagcgggaccugggcaugagcaaggagccuggcguggucagcccuaccuccuaccucgacguggaccugcacccggccucggcuuggacccuguacgcgguagccaccacggucaucacccccaugcugagacauaccauagaaaauuccacugccaacgugagccuggccgccaucgcgaaccaggcagugguccugauggggcucgacaagggcuggcccaucuccaagauggaucugggggugccgcugcucgcccucgggugcuacagccaggugaacccucugacgcucaccgcggccguuuugcuacucgugacccacuacgcgaucaucgggcccggccugcaggcuaaggccacacgggaggcccagaagaggacagccgcgggcauuaugaagaacccgacaguggaugggaucaugaccauagaucuagacccggugaucuaugacuccaaguucgaaaagcaguugggccagguuaugcugcuugugcucugcgccgugcaguuacugcucaugcggaccagcugggcguucugcgaggcccugacgcuagccaccggcccgaucaccacccuuugggagggcuccccuggaaaguucuggaacacgacaaucgccguaagcauggccaacaucuuccgggggagcuauuuagccggcgcagggcuggcguucagcaucaugaagagugugggcaccggaaagcggggcacuggcagccagggugagacuuuaggcgagaaguggaagaagaaacugaaccaacugagccgcaaggaguucgaucucuauaagaaguccgggaucaccgaggucgaccggaccgaggcgaaggagggccugaagaggggcgaaauuacucaccaugcugugagccggggguccgccaagcuccagugguucguggaacgcaacauggugauccccgagggccgggugaucgaucucgggugcggccgcgggggcuggucuuacuacugcgccggucugaaaaagguaacagaggugcgaggcuacacgaagggagggcccggccacgaggagcccguucccauguccaccuauggguggaacaucgugaagcugaugagcggcaaggacgucuuuuaccuuccgcccgaaaagugcgacacuuuacugugugacauuggggagaguagcccgucccccaccguggaagagagcaggacgaucagagugcugaaaauggucgaacccugguugaagaacaaucaauucugcaucaaggugcugaaccccuauaugccgaccgugauagagcaccuugagcgccuccagcgcaagcacggcggcaugcugguccggaaccccuuaucccgcaacagcacccacgagauguacuggaucuccaaugggaccggcaacaucgugaguuccgugaacauggucagccggcuccuacugaaccgcuucacuaugacccaccggcgccccaccaucgaaaaggacguggaccucggggcgggcacccgacacgugaacgccgaacccgagacgccgaauauggacguuaucggcgagcgcauccggcgcaucaaggaggagcacuccuccaccuggcacuaugacgacgagaacccguacaagacgugggcuuaccacggguccuacgaagugaaggccaccggcucugccagcuccaugaucaacggggucgugaagcuccugacgaagcccugggacguggucccuauggugacccagauggccaugaccgacacuacgcccuuuggccagcagcggguuuucaaggagaaggucgacaccagaacuccccggcccaugccugggacccgcaaggugauggagaucacggccgaguggcuauggcggacgcugggcaggaacaagcggccccgccucugcacccgggaagaguucaucaagaaggugcgcacgaaugccgcuaugggcgccgucuuuacggaggagaaucagugggacucggcccgcgccgccguggaggacgaggaguucuggaagcucguggacagggagcgcgagcugcacaagcuaggcaaaugcggcuccugcgucuacaacaugauggggaagcgggagaagaaacucggcgaguucgggaaggccaagggcagccgggccaucugguacauguggcugggggcucgguaucuggaguucgaggcccucggguuccugaaugaggaccacugguucucccgcgagaacucgcacuccggcgucgaaggggagggcuuacauaagcucggguacauccugcgggacaucagcaaaaucccgggcggcgccauguacgcagacgacaccgcggggugggacacccgcaucaccgaggacgaucugcacaaugaggagaagaucacgcagcagauggaucccgagcaucgccagcuagcuaacgccaucuucaaacugaccuaccagaacaaaguggucaaggugcagcgcccgaccccaaagggcaccgugauggacaucaucuccagaaaggaccaacgcgggagcggccaggucggcacguacggucugaacacuuucaccaacauggaagcccaguuaauccggcaaauggagggagaggggguguuauccaaggccgaccuggagaauccccaccuccuggagaagaaagugacccaguggcuggaaacgaaaggcgucgagcgccucaagcggauggcaaucagcggggacgauugcguggugaagcccauagacgaccgcuucgccaacgcccugcuagccuuaaacgacauggguaagguccggaaggacaucccgcaguggcagccguccaaaggcuggcacgacuggcagcaggucccguucugcucgcaccacuuccacgagcugaucaugaaggacgggcggaagcuggugguaccaugucggccgcaggacgagcucaucggacgcgcccgcauuucccaaggugcgggcuggagucucagggaaacggccugccugggcaaggccuacgcccagaugugggcgcucauguacuuccacaggcgggaccugcgccuggccucuaacgcgaucugcagcgcugugcccgugcacuggguuccuacgucccguaccaccuggagcauccacgcccaccaccaguggaugaccaccgaggacaugcucaccguguggaaccgcguguggauugaggauaaccccuggauggaggacaagaccccggucacaaccugggaggacgugcccuaccugggcaagcgggaggaucaguggugcgguagccugaucggguugaccucccgcgcgacaugggcacagaacauccugaccgccauccagcagguccggagccucaucggcaacgaggaguuucuugacuacaugccauccaugaagcgcuuucguaaggaggaggagagcgagggggcaaucugguga

SEQ ID NO: 26164 - RNA, 9873 nt, Artificial Sequence
  derived and/or modified CDS sequence (opt11) from DENV-3__JQ920484__SS-prME
accucccuuugccugaugaugaugcugcccgccaccuuagcuuuccaccucaccagccgggacggugagccacggaugauugugggaaagaaugagcgggguaagagccugcuguucaagacagccucagggauaaacaugugcacccucaucgccauggaccuaggcgaaaugugcgacgacaccgugaccuacaagugcccacugaucacggagguggagccugaggacaucgacugcugguguaaccucacgagcacuugggugaccuacgggaccuguaaccaagcgggcgagcaccggcgcgacaagcgguccguggcccuggcaccccaugucggcauggggcuggacacacgaacccagaccuggaugagcgcggagggcgccuggcgccaagucgagaaagucgagaccugggccuuccgccacccuggguucaccauacucgcuuuguuccucgcgcauuacaucggcaccucccucacgcagaaagugguuaucuucauccuguugaugcucgucacgcccucgaugaccaugcggugcgugggggugggcaaccgggacuucguagagggcuuguccggggccaccuggguggacgugguccuggaacacggugggugcguaaccaccauggccaagaacaagcccacacucgacaucgagcuacagaagaccgaggccacgcagcuggccaccuugcggaaacugugcaucgagggcaagaucacuaacgugacaacggacuccaggugccccacccagggggaggcgauccugccggaagaacaggaccagaacuacgucuguaagcacacguacguggaccgggggugggggaauggaugcggccucuucgggaagggcucccuggugaccugcgccaaauuccagugccuggagagcaucgagggcaaagccguccagcacgaaaaccucaaguacacggugaucaucacugugcacaccggggaucagcaccaggucggcaacgagacccaagggguuacagccgagaucacaccccaggccucaaccgucgaggcaauccugcccgaguacggcacccuggggcucgaauguagcccccgaacgggacuggacuucaacgagaugauccugcucacgaugaagaacaaggccuggauggugcaccggcagugguucuucgaccuuccucuacccuggaccuccggcgccaccaccgagaccccuaccuggaacaaaaaggaacuccugguaaccuucaaaaacgcccacgccaagaaacaggagguuguggugcuggggagccaagagggcgcgaugcacaccgcauuaacuggggccaccgaaauccagacuuccggcggcacgagcaucuucgccggccaccucaagugucgccuaaagauggauaaguuggaacugaagggcaugaguuacgccaugugccucaaugcguucguccucaagaaggaggugagcgaaacucagcaugggaccauacuuaucaagguggaguacaaaggcgaggacgcccccuguaagauucccuucagcaccgaggacggccagggcaaggcccauaacggccggcugauuaccgccaaccccaucgucacuaagaaagaggagccagugaauaucgaggcggagccgccguucggggaaagcaauauagugaucggcaucggggacaaggcccugaaaaucaauugguacaagaagggcagcagcaucgguaaaauguucgaggccaccgcccgcggugcccgccgcauggcgauccuaggcgacaccgcaugggauuucggcagcgucggcgggguguuaaacucgcugggcaagauggugcaccaaaucuucgggagcgccuauacggcccucuucuccggcgucucuuggaucaugaagaucggcaucgggguacugcugacguggaucggccucaauuccaaaaacaccagcaugucuuucagcugcauagugaucgggaucaucacccuguaccugggugcgguugugcaagcggauaugggaugcgucaucaacuggaaggggaaggagcucaagugcggcuccgggaucuucgucacaaaugaggugcacacguggacugagcaguacaaguuucaggccgauagccccaagcggcuggccaccgcuaucgccggggccugggagaacggggugugcggcauccgcuccaccacgcgcauggagaaccuacucuggaagcagaucgccaacgaacuuaacuauauccugugggaaaacaacauaaaacuuaccaucgucgugggggacgccaucggcguguuagaacaggggaagcggacacugacgccccagccuauggagcucaaguacucauggaagaccugggggaaggcgaagaucgucaccgcggaaacccagaacagcaguuucauuauagacggccccaauacccccgagugccccucagccucacgagccuggaacguuugggagguggaggacuacggcuucggcgucuucacgaccaacaucuggcugaagcuacgggaaaaguacacgcagcucugcgaccaccgucugaugagcgccgccgugaaggacgagcgggcggugcacgcggauaugggcuacuggauugaaucgcaaaagaacgggagcuggaagcuagagaaagccucccucaucgagguuaaaacaugcaccuggcccaagucacacacauugugguccaacggggugcuagagucugacaugaucauaccgaagucccucgcugggcccaucucacaacacaacuaccggcccggcuaccacacccagaccgccgggccguggcaccugggaaaacuggaacucgacuucaacuauugugagggaacuacugugguaauaaccgagaacugcgggauccggggccccucccuaagaacgaccacgguuucggggaagcucauucaugaguggugcugccggucauguacccugccgccccuccgcuacaugggcgaggacgggugcugguacggcauggaaauucggccgaucaaugaaaaggaggagaauauggugaaaucacuggucagugcgggcagcggcaagaccgacaauuucacgaugggcguguuaugccuggccauccuguucgaggaggugaugagaggcaaguucggcaagaagcacaugauagcuggagcccucuucacguuuguccugcugcuauccggccagaucaccuggcgggacauggcgcacacccugaucaugauagggagcaacgcguccgaccgcauggggaugggcgucacguacuuggcccucaucgccacguucaagauccagccuuuccuggcccugggguucuuccuccggaagcugacaagccgcgagaaccuguuacugggcgugggccuagcgauggccaccacuuugcagcugcccgaggacaucgagcagauggccaacgggaucgcccugggccucauggccuuaaaacugaucacacaauuugagacauaucagcucuggacagcguuaaucagccugaugugcucgaacaccaucuucacauugaccguugccuggcggaccgccacccugaucuuagccgugauuucucuccuccccgugugccaguccagcuccaugcgcaaaaccgacugguuacccaugaccgucgccgcgaugggggucccgcccuuaccccuguucaucuucagccugaaagacaccuuaaagcggcgcucauggccucuaaacgagggugugauggccgucggucugguaagcauccucgccuccagcuuucugcgcaacgacguccccauggccggcccccugguggccggcggucugcugaucgcgugcuacgugaucaccggcacauccgccgacuuaaccgucgagaaggccgccgacguaaccugggaggaggaggccgaacagacuggggugagucacaauuuaaugaucacagucgacgacgacgguacaaugcggaucaaggacgacgagaccgagaacauacugaccgugcugcucaagaccgcgcugcugaucgugucgggaaucuuuccauacaguaucccggcaacacuccuugucuggcauaccuggcagaaacagacccagcgcucgggugugcuaugggacguucccagcccucccgagacccagaaggcagagcuugaggagggcgucuaccgcaucaagcagcagggcaucuucggcaagacccaggugggggugggcguucagaaagaggggguguuucacaccauguggcacgugacccgcggcgcggucuugaccuauaacggcaagcggcuggagccgaacugggcaaacgugaagaaggaccucauuagcuacgggggcggguggaagcugagcgcccaguggcagaagggagaggaagugcaggucaucgcuguagagcccgggaagaaccccaagaacuuccagacgaugcccggcaucuuccagaccacgaccggcgagaucggggcuaucgccuuagacuuuaaaccgggcacguccgggagccccaucaucaaccgcgagggcaagguggugggccuguacgggaacggcguggugaccaagaacgggggcuacgugucagggaucgcacagaccaacgcggagcccgauggcccuacccccgagcucgaagaggaaauguucaagaagcgaaaccuaacgaucauggaccuacaccccggcuccgguaagaccagaaaguaccuccccgccauaguucgggaagccaucaaacgccggcugcgcacccugauccuugcaccgacgcggguggucgcggcagagauggaggaggcccugaagggccugcccauccgcuaccagaccaccgccaccaagagcgagcacaccggucgggagauuguggacuuaaugugccacgccaccuucaccaugcgcuugcugagccccguucgggucccgaauuauaaccugaucgugauggacgaggcucacuucaccgacccggccagcauugccgcccgcggcuacaucucuacccgggugggcaugggggaagcggccgcaaucuucaugacggccacgccgcccggcaccgccgaugcguucccucagagcaacgccccgauccaggaugaagaacgcgauaucccagagagguccuggaauagcggaaacgaguggaucaccgauuucgccggcaagacgguuugguucgugcccucuaucaaggccgggaaugacaucgccaacugcuugcguaaaaacgggaagaaaguuauccagcugagccggaagaccuucgacaccgaguaccagaagacaaaguuaaacgacugggacuucgucgugacgacagauaucucggaaaugggggcgaacuuuaaggccgaccgggugaucgacccucggcggugucuaaagccagucauccuuacugacggccccgagcgggugauccucgccggaccgaugcccgugaccguagccucggccgcgcagagaagaggaaggguggggcggaacucacagaaggaaaaugaccaguacaucuucacggggcagccgcuaaacaaugacgaggaccacgcgcacuggaccgaagcgaagaugcugcuggacaacauaaacacccccgagggcaucaucccagcucuguucgagcccgagcgggagaaguccgcggccaucgacggggaguaccgccugaagggcgagucccggaagaccuucguggaacuaaugagaaggggcgaccugccggucuggcuggcccacaagguggccagcgaggggaucaaguacaccgaccgcaaauggugcuucgacggcgagcguaacaaccagauucucgaggagaacauggacguggagaucuggacgaaggagggagagaaaaagaagcugcgcccccgguggcuggaugcccgcacguauuccgacccccuggcgcugaaggaguuuaaagacuucgccgccggcagaaagucuaucgcauuagaccucgucaccgagauuggccgggugcccucacaccuggcccaccgcacccggaacgcguuagacaaccucguaaugcuacauacgucggagcacgggggacgcgccuaccgucacgccguggaggaacucccggagacuauggaaacucucuugcugcucggccucaugauccugcucaccgggggcgccaugcuauuccucauauccggcaaaggcauaggaaagacguccaucggcuugaucugcguggucgcaagcuccgguaugcuguggauggcggacgugccgcugcaguggaucgccagcgcgaucgugcuagaguucuuuaugaugguccugcuuauccccgagccggagaagcagaggacaccccaggacaaccaacucgcauacguugugaucggcauccugacucuggccgcgaucgucgccgccaacgagauggggcuccuggagaccacgaagcgagaccugggcaugagcaaggagccuggcguggugagcccgaccucauaccucgacguggaccugcacccggccagcgccuggacccucuacgccguggcaacaacggugaucacacccaugcuccggcacaccauugagaacucgaccgccaaugucagccuggcagcgaucgccaaccaggccguggugcugaugggauuagacaaaggcuggcccauauccaagauggaccuggggguuccccuguuagcccuggggugcuacagucaggucaacccguugacacucaccgccgcgguguuauugcucgugacacacuacgcgauaaucgggccuggccugcaggccaaggccacccgugaagcucagaagcgcacggcggccggcaucaugaaaaaccccaccguggacgggauaaugaccaucgaccuugaccccgugaucuacgacuccaaguucgaaaagcaacuugggcagguuaugcuguuagugcuuugcgccguccagcugcugcucaugcgcaccagcugggccuucugugaggcgcugacgcucgcgacagggccaaucaccacucuuugggagggcuccccgggcaaguucuggaacacgacgauugccgucagcauggccaacauauuccggggguccuaccuugccggcgcggggcuggccuucagcaucaugaaauccgugggcaccgggaagcguggcaccggcagccaaggagagacccuaggcgagaaguggaagaagaaguuaaaccagcuaagcaggaaggaguucgaccucuauaaaaagagcgggaucaccgagguggacagaaccgaggccaaggagggccugaagcgcggggaaaucacccaccacgcaguuagccggggcuccgccaaguugcagugguucguggagcgcaacauggugauccccgagggccgggucaucgaccucgggugcggacgcggaggguggucguacuacugcgcggggcugaaaaaggugacagaggugagaggcuacaccaagggcgggcccggacaugaggagccggucccgaugagcacuuacggauggaacaucgugaagcugauguccggaaaggauguauucuacuuaccacccgagaagugcgauacccugcuuugugacaucggggaguccagcccguccccgaccgucgaagagucccgcacgauccgggugcucaagaugguggagcccuggcucaagaauaaccaauucugcaucaagguccugaaccccuacaugccgaccgugauagaacaccuggagcgccuccagcgcaagcacggcggcaugcuugugcggaacccccugucccgcaauucaacccacgagauguacuggauauccaacgggaccgguaacauugucagcuccgugaauaugguuucacggcuccugcugaaccgcuucacgaugacccaccggaggcccaccauagagaaggacgucgaccucggggcuggcacccggcaugugaacgcugagcccgagacgccgaacauggacgugaucggcgagcggauacggcgcaucaaggaggagcacagcagcaccuggcacuacgacgaugagaaccccuacaagaccugggccuaccacgggaguuaugaggucaaggccaccggcagcgcgagcuccaugauaaacgggguagucaagcuguuaacgaagcccugggacguggugccgauggucacccagauggccaugaccgacaccacgcccuucgggcaacagcggguauucaaagagaagguggacacucguacgccccgccccaugccggggacucgcaaggucauggaaauuacggcggaguggcucuggcgaacccugggccggaacaaacggcccagacuguguacccgggaggaguucaucaagaaggugcgcaccaacgcagcgaugggcgccguguuuacugaagaaaaucagugggacucagcccgcgccgccguugaggacgaggaguucuggaagcucguggaccgggaacgcgagcugcauaagcugggaaagugcggcuccugcguguacaauaugauggggaaacgggagaaaaagcuaggugaguucgggaaggcgaaagguagccgcgccaucugguauauguggcugggggcacgguacuuggaguucgaagcgcucggguuucugaaugaggaucacugguucuccagggagaacagccacuccggcgucgagggggaaggauuacacaagcucggcuacauucugcgggacaucucuaagauccccggcggcgcgauguaugcggacgacaccgccggaugggacacacgcauuacugaagaugaccugcacaacgaggagaagauaacacagcagauggauccugagcauagacagcucgccaacgccaucuucaagcugacauaccaaaauaagguggugaagguccagcgcccgaccccuaagggcaccguaauggacaucaucucccggaaagaccagcgcgggucaggccaggugggcacguacgggcuuaacacuuucaccaauauggaggcccagcucauacggcaaauggagggggagggaguccuguccaaagcggaccuugagaauccccaucucuuggagaagaagguuacccaguggcuggagaccaagggggucgagcgccucaagcguauggccaucagcggcgacgacugcguagugaaaccaaucgacgaccgcuucgcuaacgcccugcuggcccuuaacgacauggggaaagugcggaaggauauaccacaguggcagccguccaagggcuggcacgacuggcagcaggucccuuuuugcagccaccacuuccacgaguuaaucaugaaggacgggcguaagcucgugguucccugccggccccaggaugagcuaauuggucgugcgcgaaucucccagggugccggcuggagccugcgcgagacggcaugcuuggggaaagccuaugcgcagaugugggcccucauguacuuccaccgccgcgaucuacgccuggcaaguaaugccaucugcagcgccgucccagugcacugggugcccaccagucggacaaccuggaguauucacgcucaccaucaguggaugacgacagaggacaugcuaaccguauggaaccgcguguggaucgaggacaaccccuggauggaggacaagaccccggugacuaccugggaggacguccccuaucucggcaagagggaggaccaguggugcggcucccugaucgggcucaccucccgcgcgaccugggcccaaaacaucuugacugcaauccagcagguccggucucugaucggcaacgaagaguuccucgacuauaugcccuccaugaagcgcuuccggaaggaggaggaaagcgagggggcaaucugguga

SEQ ID NO: 26165 - RNA, 9873 nt, Artificial Sequence
  derived and/or modified CDS sequence (opt11) from DENV-3__JQ920486__SS-prME
accagcuuaugucucaugaugaugcugcccgccacccuggccuuccauuuaacuagccgggacggcgagccccggaugauaguugggaagaacgagcggggcaagagucuccuguucaagacagccucggggauuaauaugugcacccuuaucgcuauggaccugggagagaugugcgacgauaccgugaccuacaagugcccacugaucacugagguggagcccgaggacauagacugcuggugcaaucucaccagcacaugggugacguacgguaccugcaaccaggccggugaacaccggcgcgacaagagauccguggcccuugcgccacacguggguaugggucuggacacccgaacccaaaccuggaugagcgcggagggagcauggcgacagguggagaaggucgaaacaugggcguuccgccaccccggguucaccauacucgcgcuguuccuggcucacuauaucgguaccucccuaacgcaaaagguggugaucuucauccugcucauguuagucaccccaagcaugaccaugcgaugcgugggagugggcaaccgcgauuucgucgagggccuauccggggccaccuggguggacguaguccuggagcacggcggaugcguaacgaccauggccaagaacaaacccacccucgacaucgagcugcaaaagacagaagccacacagcuggccacccuccggaagcuaugcauagagggcaagaucacuaacguuaccacggacuccaggugccccacacagggcgaggccauccugccggaagaacaggaccagaacuacgucuguaagcacaccuauguugaccggggauggggcaaugggugcggccucuuugggaagggcucccuggugaccugcgccaaguuccaaugccuggagagcaucgagggcaaagccguccagcacgagaaccucaaauacacggugaucaucacgguucacaccggcgaccaacaccagguuggcaacgagacccagggggucacggccgagaucacgccccaagccuccacggucgaggcgauacugcccgaguacggcacccugggccucgaguguucuccccgaaccggccuggacuuuaaugaaaugauccugcugacgaugaaaaacaaggccuggauggugcaccgucaaugguucuucgaccugccgcugcccuggaccuccggcgccaccaccgaaacgcccacuuggaacaagaaggaauuacuggugaccuuuaaaaaugcccacgccaagaagcaagagguaguagugcuggggagccaggagggggcaaugcacaccgcccucacgggugccaccgaaauccagaccuccggagggaccagcaucuucgccggccaccugaagugccgccugaagauggacaagcucgagcugaaaggcauguccuacgcuaugugccugaacgcauucguccucaagaaagaggugagugagacgcagcacgguaccaucuugaucaaaguugaguacaagggcgaggaugcgcccuguaaaauaccauucucgaccgaggacgggcagggcaaagcccacaauggccggcugauuaccgcuaaccccauugucacuaagaaggaggagcccgugaacauagaagcggagccgcccuucggugagucaaacauagugaucgguaucggggacaaagcccugaagauaaacugguacaagaaggguucauccauagggaagauguucgaggccaccgcccgcggggcgcggcgcauggccauccucggcgacaccgccugggacuucgggucagucggcgggguguuaaacucgcugggcaaaauggugcaccagaucuucgggucugccuauaccgcacucuucuccggcgucucauggaucaugaagaucggcauuggcgugcugcugacguggaucggguuaaacuccaagaacacuucgaugucguucagcuguaucguaaucggcauuaucacccuguaccugggcgccgucgugcaggcggacauggggugcgugaucaacuggaagggcaaggagcucaaaugcggcucaggaaucuucgucacgaacgaggugcauacguggacugagcaguacaaguuccaagccgacucuccaaagcggcuggccacagccaucgccggcgcgugggagaacggugugugcggcauccgcucgaccacccgcauggagaacuuacucuggaagcaaaucgccaacgaauuaaacuacauccugugggagaacaacaucaaacucaccauuguugugggggacgccauaggcgugcuggaacagggcaagcggacccugacgccccaacccauggagcucaaguauagcuggaagaccugggggaaggccaaaaucgucaccgcggagacgcagaacuccuccuucauuaucgacggucccaacacgcccgagugccccuccgccagccgcgcguggaacgugugggagguugaggauuauggguucggcgucuucacgacuaauauauggcugaagcuucgggagaaguauacacagcuaugcgaucaccgccugaugucagccgccgucaaggaugagcgggcggugcacguggauaugggauacuggauagagucccaaaagaacgggagcuggaaacuggagaaggccucucugaucgaggugaaaacuuguacguggcccaagucucacacguuguggucuaacggcgugcuggagucggacaugaucaucccgaagucccucgcagggcccauuagucagcacaacuaccgucccggcuaccacacccagacagcggggccguggcaccugggcaagcuggagcucgacuucaacuauugugagggcaccacggucguuaucaccgagaacugcgguauccggggcccgucccugcgcaccacaacgguaagcgggaaacugauccacgaguggugcugccgauccugcacuuugccgccccuccgcuacaugggugaggacggaugcugguacggcauggagauccgaccgaucaacgagaaggaggagaauauggucaagagucuggugucagcagggagcggaaagaccgauaacuucaccaugggcguacuuugccuugcgauccuguucgaggaggucaugagagggaaguucggcaagaagcacaugaucgccggggcuuuauucacguucgugcugcuucuauccggacaaaucacauggcgggacauggcccacacccugaucaugauagguucgaacgccuccgacagaauggggaugggcgugaccuacuuggcgcucaucgcuacguucaagauccagcccuuuuuagcccugggguucuuucuccguaagcuaaccagccgcgagaaucuccucuuaggcguugggcuggccauggcaacaacucuccagcucccggaagacaucgagcagauggccaacgguaucgcccuaggccucauggcccuaaagcugaucacgcaguuugagacauaccaguuguggaccgcgcugaucagccugaugugcuccaacaccaucuucacgcucaccguagcguggcggaccgccacccugauccuagccguuaucucgcuuuugcccgucugccaguccuccuccaugagaaagacggauuggcuuccaaugacuguggcggccaugggagugccgccacucccccuguucaucuuuagccugaaggauacccucaagaggcgcuccuggccgcugaacgaggguguuauggccguggggcuggucagcauccucgccuccagcuuccuaagaaacgacgugcccauggccggaccgcugguggccggcgggcugcugaucgccugcuacgucaucaccggcacuuccgcggaccucacgguagagaaagccgcagacgucacgugggaggaggaggccgagcagaccggggucagucacaacuugaugaucacgguugaugacgacggcaccaugcguaucaaggacgacgagaccgagaacauccucaccgugcugcucaagaccgcccugcuuaucgucucugggauauuccccuacagcauuccggcaacuuugcugguguggcacacauggcagaagcagacccagcgcuccggcgugcucugggacguccccagcccucccgagacccagaaggcugagcucgaggagggcguuuaccggaucaagcagcagggcauauucggcaagacccaggugggggucggcgugcagaaggaagguguguuucacaccauguggcacgugacccgcggcgccguacugacccacaacggcaaacggcuggagccgaacugggccaacgugaagaaggaucucaucucauacgguggcggguggaagcuaagcgcgcaauggcagaagggcgaggagguccaggugauagccguggagccggggaaaaaccccaaaaauuuccaaacgaugcccgguaucuuccaaaccaccacaggagaaaucggagccaucgcccuggacuucaagccggguacgucaggcagccccaucaucaaccgcgagggcaaagucgugggccuguacgggaacggcguggucacaaagaacgggggcuacgugagcggaauugcacagacgaacgcggagcccgauggaccaacccccgagcuagaggaggagauguuuaaaaagcggaaccucacgaucauggaccuacacccaggcuccgggaaaacccgcaaguaccuccccgccauagucagagaagccauaaagcguagacuacgcacccugauccucgccccgaccagagucguggccgcggaaauggaggaggcccugaagggacugccaaucagauaucagacgacagcaaccaagagcgagcacacugguagagagaucguggauuuaaugugucacgccacguucaccaugcgccugcuuucaccaguccgcgugcccaacuacaaccucaucgugauggaugaggcacacuuuaccgauccggcgagcaucgccgcccgcggcuauaucuccacacgggucgggaugggcgaggccgcggccaucuuuaugaccgcuacgccgccgggcaccgccgacgccuucccccagagcaacgcgccgauccaggaugaggagcgcgacauccccgaacgguccuggaauucggguaacgaguggaucaccgacuucgccggcaagacggugugguucguccccuccaucaaggcggggaaugauaucgcuaacugccugcgcaagaacggcaaaaaaguaauccagcugagccgcaagacauucgacacugaguaccaaaaaaccaaguugaacgacugggacuucguggugacgaccgauaucagugagaugggggccaacuucaaggccgauagagugaucgacccccgccggugccugaagcccgugauccugacggacgguccugagaggguaauccucgccggccccaugcccguuaccguggcaagcgccgcccagcggcgagggagagucggccguaacucgcaaaaagagaacgaccaguacauauucacgggccagccgcugaacaacgaugaggaucacgcgcacuggaccgaggccaagauguuauuagauaacaucaacaccccggagggcaucauccccgcccucuucgagccagaacgugagaagucagccgcgauugacggggaguaccgccugaagggggagucccggaagaccuucgucgagcucaugcgccggggcgaucugcccguguggcucgcccacaagguggcuagcgaggguaucaaguauaccgaccgcaaguggugcuucgacggugagcggaacaaccagauccucgaggagaacauggacgucgaaaucuggacgaaggaaggggagaagaagaaacuacguccacgguggcuggacgcaagaacauacucagacccccucgccuugaaggaguucaaggacuucgcggcuggccgaaagagcauagcucuggaccugguuacugagaucggcagagugcccucccaccuggcccaccgcaccaggaacgcccuggacaaccucgugaugcugcacacgagcgagcacggcggccgcgcguaucggcacgccguagaggaguugccggagaccauggagacacuccugcugcuugggcugaugauccuccucaccggcggggccaugcuguuccugaucagcggaaagggcaucgggaagaccuccaucggcuugaucugcgugguggcaagcuccgguaugcuguggauggccgacgucccccuacaguggaucgcgucagccauuguccucgaauucuucaugauggugcuguuaauucccgagccugagaagcagcgcacgccacaggacaaccaacucgccuacguggucaucggcauccugaccuuggccgccaucguggcggccaaugagauggggcuccuagagacaaccaagcgggaucugggcauguccaaggagccugggguggugagccccacuucauaccuggauguugaucugcauccggccagcgccuggaccuuguacgcgguggcuacgacugucaucacccccauguuacgccacaccaucgagaacagcaccgcgaauguuagccuggcagccaucgccaaccaggccguggugcugauggggcucgacaaaggcuggccgaucuccaagauggaccuuggggugccccuuuuagcccugggcugcuacagccaggucaacccccugacccucaccgcugcaguucuguuacuggugacacauuaugcgaucauaggcccggggcugcaggccaaggccacccgggaggcccagaagcguacagccgcgggaaucaugaagaaccccaccguugacgggaucaugaccauagaccuggaccccgucaucuacgacucgaaguucgagaagcagcuuggccagguaaugcuguuagugcucugcgccguccagcugcugcuaaugcgaaccaguugggcguucugcgaggcccuaacgcuggcgaccgggccgaucaccacccucugggagggcucccccggcaaguucuggaauacgaccaucgcugucagcauggccaacaucuuccgcggguccuaccuggccggggccgggcuggcguuuagcaucaugaaguccgugggcaccgguaagcggggaacaggcagucagggggagacgcucggcgagaaguggaagaaaaagcugaaccagcuaagccggaaagaguucgaucucuacaagaaguccgguauaacagagguagaccgcaucgaagcuaaggagggccugaaacggggagagaucacccaucacgcugugagccggggcuccgccaagcugcagugguucgucgagcgaaacauggucauucccgaaggccggguaauagaccucgggugcggucgcgggggcuggagcuacuacugugccggucugaagaagguuaccgagguucggggcuauaccaaggguggucccggccacgaggagccugugcccauguccacuuacggguggaacaucgugaaauuaaugucuggcaaagacgucuucuaccugccgcccgagaagugugacacuuuacugugcgacauaggggaguccucaccgucucccaccguggaggagagccgcaccauacggguacuaaagaugguggagcccuggcugaagaacaaccaguucugcauaaagguguugaacccuuacaugccgacggugaucgagcaccuggagcgccuccagcgcaaacacggcggcauguuagugcggaacccccugucccgaaacagcacgcacgagauguauuggaucuccaacgggaccggcaacaucgugaguagugugaacaugguaucccggcugcugcuuaaucgcuucaccaugacgcacaggcgccccacuaucgaaaaggacgucgaucucggggccgggacccggcacgucaacgccgaacccgagacgccgaacauggacgucaucggcgagagaaucagacgcaucaaggaggagcacuccucaacguggcacuacgacgacgagaauccguauaagaccugggcguaucacggguccuacgaggucaaggccaccggcagcgccagcuccaugauuaacggggucguuaagcuccuaacuaaaccgugggacguggucccgaugguuacgcagauggcaaugaccgauaccacucccuucggccagcagcguguguuuaaagagaaggucgauacgcgcacuccucgucccaugcccggaacccgcaaggucauggaaaucacagccgaguggcuauggaggacccugggccgcaauaagcggcccaggcugugcacccgggaggaguuuaucaagaaggugcgcaccaacgccgcuaugggcgcggucuucacggaggaaaaccaaugggacagcgcccgcgccgccguggaggacgaggaguucuggaaguugguggaccgggagcgcgagcuccauaagcuggggaagugcggcuccuguguguauaauaugauggggaagcgcgaaaagaagcucggcgaauuugggaaggccaagggcagucgcgccauuugguacauguggcuuggcgcccgguaccuggaguucgaggcccuaggcuuccugaacgaagaccacugguucucccgcgaaaacagccacuccggcguagaaggggagggauuacacaaacuaggguacauacugcgcgacaucagcaaaauacccgggggcgcgauguacgccgacgauacggcggggugggacacccgcauaaccgaggacgacuuacacaacgaagagaagaucacccagcagauggaccccgagcaccgccaguuagccaacgcaauuuucaagcucacguaccaaaacaagguggucaaggugcaacgcccgaccccgaaggggaccgugauggauaucaucucccggaaggaucagcgcgggaguggccaggucggcaccuacgggcugaacacguucaccaacauggaagcccagcugaucaggcaaauggagggcgagggggugcuguccaaggccgacuuagaaaacccucaccucuuagaaaaaaagguuacccaguggcuggaaaccaagggcgucgaacgccucaagcggauggccaucucaggggacgacuguguggugaagcccauagacgacagauucgccaaugcccugcuggcccucaacgauaugggcaagguccguaaggacauuccccaguggcagcccuccaaaggcuggcacgacuggcagcaggugcccuuuugcagccaccauuuucaugagcugauuaugaaggacgggcgcaagcuggugguccccugucggccccaagacgaauuaaucggccgcgcgcggaucucccagggggcuggcuggagccuacgcgagacagccugccuggggaaagccuaugcacaaaugugggcgcucauguacuuccaccgccgggaccugcgcuuagccuccaacgccaucugcagcgccguccccgugcacugggugcccacaucccggaccaccuggagcauccaugcccaccaccaguggaugaccaccgaggacauguuaaccguguggaaccgcguguggaucgaggacaaucccuggauggaggacaaaacccccgucaccaccugggaggacgugcccuaccugggcaagcgggaggaucaauggugcggcuccuugaucggccucaccucccgcgcgaccugggcccagaacauccugaccgccauccagcagguacgcucccuuaucggcaacgaggaguuccucgacuacaugccgaguaugaagcgcuuccggaaggaggaggagagcgagggagcuauaugguaa

SEQ ID NO: 26166 - RNA, 9873 nt, Artificial Sequence
  derived and/or modified CDS sequence (opt11) from DENV-3__JQ920485__SS-prME
accucccucugcuuaaugaugauguugcccgcaacacuagccuuucaucugaccucccgagacggcgagccccgaaugaucgucgggaaaaacgagagagggaagucgcuccuuuuuaagaccgcgucagggauaaacaugugcacguugauugccauggaccucggcgagaugugcgacgacacuguuaccuacaaaugucccuugauuacggaagucgaacccgaggacauagacugcuggugcaaucuaacgagcacaugggugaccuauggcacauguaaccaggcgggagagcacaggcgcgacaaacgaucugucgcacucgcaccacacguggggaugggauuggacacgcgcacgcagacauggaugagugcagaaggagcauggcgucaaguagagaaggucgaaacgugggcauuccgacacccagguuucacaauacuagcccucuuccuggcacacuauauagguaccagccucacccagaaaguagugauuuucauccugcugaugcucgucaccccaagcaugacuaugcggugcgucggcguagggaaccgagacuucguagaaggacuuagcggugcaacauggguugacgucguacuagaacauggcggcugcgucacgaccauggccaaaaacaaacccacccuagacauagaacugcaaaagacggaagcaacccaauuagcuacgcuacggaaacuguguauugaggguaaaaucacaaacaucacuaccgacucuagauguccuacccagggcgaagcaaucuuaccagaggaacaggaccaaaauuacgucugcaaacauacuuacgucgacagagguuggggcaauggguguggacucuucgggaaggggucacuuguaacaugugcaaaguuccaauguuuggaaucuauagaagggaaggcaguacagcaugagaaccugaaauacaccgucaucauaacgguccacacaggcgaucaacaucaagucgggaacgaaacgcaaggcguaaccgcugaaauaacgccccaagccaguaccguagaagcaaucuugccugaauauggcacacuaggauuagaauguagcccacguacaggguuagacuucaacgaaaugauauugcuaacaaugaagaauaaagccuggaugguacaccgacaaugguuuuucgaccuaccccuccccuggaccucgggcgcgaccaccgaaaccccgacauggaacaagaaagaacuacugguuacauucaaaaacgcccacgcaaagaagcaggaaguaguaguucuagggagucaagaaggagcgaugcacacagcuuuaacaggcgcuacagaaauucaaaccagcgguggaacgagcauauucgcugggcaccucaagugcaggcuuaagauggacaagcuugaacuaaaaggcauguccuacgccaugugccucaacgcuuuuguucucaaaaaagaggugucagagacacaacacgggacuauucugaucaaagucgaauacaagggcgaggacgccccaugcaaaauaccauucuccacagaagauggccagggcaaggcccacaacgggcgacucaucacggcgaaucccauaguuacaaagaaggaagaacccgugaacauagaagcugaaccacccuucggagaaagcaauaucguaauaggcauaggcgacaaagcacugaagauaaacugguauaagaaggguucuagcauuggcaaaauguucgaagcuacugcacgcggcgcgcgccgaauggcaauacuaggagacacagcaugggacuucggaagugucggagggguacucaacagucucggaaaaaugguccaccagauauucggauccgcauauaccgcacuguucagcggugucagcuggauaaugaaaauagggauagguguacuccugacguggauagggcuaaacucgaagaacaccaguaugucguucuccugcaucgucaucgggauaauaacccuauaccuaggcgcaguaguacaagccgacaugggcugcguuaucaacuggaaaggcaaggaguugaaaugcggcucgggaaucuucguuacuaaugagguacacacguggaccgaacaauacaaguuccaagcagacuccccgaaacgucuagcuacagccauagcaggggcgugggagaacggcgugugcgguauacgauccacaacacgcauggagaaccuacucuggaagcaaauagcgaaugaacuaaacuacauauuaugggagaacaacauaaaacuaacuaucgucguaggcgaugugauaggggugcucgagcagggaaagcggacacuuacuccccagcccauggaacugaaauacagcuggaagacauggggaaaggccaaaaucgugacggcggagacgcaaaacuccagcuucaucauagacggccccaacaccccagaaugcccgucagcgucccgagcguggaacguaugggagguggaagacuauggauucggcguuuucaccacgaacauauggcuaaaauugcgagaaaaacacacucagcugugcgaucaccgccugaugagcgcagccgucaaggacgaaagagcaguucacgcagacauggguuacuggauagaaucucagaaaaacggaagcuggaaacuagaaaaagccagccuuauagaagucaaaacgugcacauggcccaagagucacacccuauggagcaacggggugcuagaaucggacaugauaaucccaaaaagucuagcaggcccgauaagccagcacaacuaccgaccggguuaccacacacagacggcaggaccauggcaucuaggaaagcuagagcuagacuucaacuacugcgagggcacuacaguagugauuacggaaaacuguggcaucaggggcccaucccuacgcacaacaaccgucaguggcaaacuuauccacgagugguguugccgaaguugcacgcuacccccuuuacgcuacaugggggaagauggaugcugguacgggauggaaaucagaccaaucaaugaaaaagaggaaaacauggucaaaagccucgugagugccggauccggaaaaacagauaacuucacuaugggcguucugugccuggcaauucuguucgaagaagugaugcgcgggaaauuugguaagaaacauaugauugcaggcgcacuguucacguucguacuacuacuaagcggucagauuacauggcgggacauggcacacacgcuuauaaugauaggcagcaacgccuccgaccgcaugggaauggggguuacguacuuagcccuaauugccacguuuaagauacaacccuuucuagcacucgguuucuuuuugcggaagcugaccuccagagagaaccugcuccuagggguagggcuagcgauggcuaccacucuacaacuaccagaggacaucgagcagauggcuaacgguauagcgcucggccuuauggcacugaaguuaaucacucaauuugaaacguaucaguuauggacugcauuaauaagucugaugugcucaaauacgauauucacacucacuguugccuggcggaccgcaacgcuaauucuagcuguaauaucauuacuuccgguaugucagagcagcagcaugcgcaaaaccgacuggcuccccaugaccguggcggcgaugggcgucccgccgcucccauuauucaucuucucccucaaggacacauugaaacggcgaucguggccccuaaacgaggguguuauggcgguuggacucguaagcauccuugcaucaaguuuccugagaaacgauguccccauggccgggccacuggucgcagggggccucuugauugcgugcuacguuauaacagggacgucagcugaccucaccgucgaaaaggcggcggacguuacgugggaggaagaagcugaacaaacaggcgugagccacaaccuaaugaucaccguggacgaugacggcacaaugagaauaaaggacgacgaaacagaaaacauacuaaccguauuacuuaagacggcccugcucauagucucuggcauauucccauauaguauaccugcgacucuucucguuuggcacaccuggcaaaagcaaacccaaaggucaggaguccugugggacguccccucaccaccagaaacgcaaaaggcggagcucgaagaaggugucuacagaauuaagcaacaaggaaucuucgggaagacacagguaggcguggggguccaaaaagaaggaguauuccacacuauguggcacguaacucggggggcaguucuuacacacaacgggaaacggcuagaaccgaacugggcaaaugugaaaaaagaucuaauaagcuacggcggcggguggaaauuaagcgcacaauggcaaaaaggggaagaaguacaggugaucgccguggaaccaggaaagaacccgaaaaacuuucaaacgaugcccggcaucuuccaaaccacaacgggcgagauuggggccauugcccuugacuuuaaaccagguacauccggguccccuaucaucaaccgcgaagguaagguuguuggccucuacggaaacgggguagugacaaagaauggggguuaugucuccggcauagcccagacaaacgccgagccggacggcccgaucccggagcucgaagaggaaauguucaagaaacgcaaccucacgaucauggacuuacaccccggcuccggaaagacgcgcaaauacuuaccugcuauagugcgggaggcgauaaaacggagacuucgaacccugauucuagcccccacgagaguggucgcagcagagauggaagaagcccuaaagggucugcccauacgguaccagacuacagccacuaaauccgaacauaccggacgagagaucguagaccuaaugugccacgcaacguucacgaugcgccuauugagcccgguccgaguccccaauuacaaucuaauaguaauggacgaggcacacuucaccgauccagccucaaucgccgcccgagguuacaucuccacgcguguagggaugggcgaggccgcagcaauauucaugaccgcgacaccacccggaaccgccgacgccuucccacagagcaacgccccgauacaagacgaggaacgagauaucccagaacggucauggaacagcggaaaugaauggauuacggacuucgcggggaaaacggucugguucgucccgagcaucaaggcgggaaacgacauagcaaacugcuuaaggaaaaacggcaaaaagguaauccagcugagcagaaagacauucgauacggaguaccaaaaaacgaaacucaacgauugggauuucguuguaaccacugauaucagcgaaaugggcgcaaacuucaaagccgacaggguaaucgacccccgcagaugcuugaaacccguaauauuaaccgacggcccagaacgcgucauacucgccggaccuaugcccgucaccguugcuagcgcggcgcaacgccgcggccgugugggacgcaacagccaaaaggagaaugaucaguacauauucacgggucaaccccuaaauaacgacgaagaccacgcacauuggacagaagcaaagaugcugcuggacaacaucaacaccccggagggaauuauaccagcccuauucgagcccgagcgagagaaaagcgcagcaaucgacggggaauaccgccugaagggagaaagcaggaaaacuuuugucgagcuaaugcgacgcggagaucuaccgguguggcuagcacacaagguugccucagaagguauuaaauauacggaccgcaaauggugcuuugacggagagcgcaauaaccaaauauuggaggagaacauggacgucgagauauggacaaaagagggcgagaaaaagaaacugcgaccccgguggcuagaugcacgcacauacucggacccccuugcacuaaaagaauucaaggauuucgccgcaggacgcaagagcauagcgcuagaccuagucaccgaaaucgguaggguaccaucccaccuagcccacagaacucgcaacgcguuagauaaucuugucauguugcacacgagcgaacacgggggucgggccuaccgacacgcgguagaagagcuuccagagacuauggagacguuacucuuacuaggauugaugauucuacuuacugguggagcgaugcuguuucuaaucucaggaaaagggauuggcaagacgaguaucggccuuaucugcgugguagcuucaagcggcauguuauggauggccgaugucccgcuccaguggauagccucagccauaguccuagaguucuucaugauggugcuccuaauucccgagcccgaaaaacagaggacaccgcaagacaaccagcucgcauacguaguaauaggcauccugacacuagcagccaucgucgcugcuaacgaaauggggcucuuagaaacaacaaagcgagacuugggaauguccaaagagccggguguagucagcccaacgagcuaccuggacguugaccuacaucccgcgagugcauggacgcuuuacgcuguagccacaacaguaauaacaccaaugcuccgacacaccaucgaaaacagcacagccaacgugagccucgcagcaauugcgaaccaggcggucgucuuaaugggacuugacaaaggcuggcccauauccaagauggaccuaggcguuccgcuacuagcucuuggaugcuauucccaagucaacccacugacacucaccgcagcgguccuucuacucguaacacacuacgccauuauagggccgggucuacaagcgaaagcuacaagagaggcccaaaagcgaacggcagccgggauaaugaaaaacccuacugucgauggaaucaugacgauugacuuggaucccguuaucuacgauaguaaguucgaaaaacagcuaggucaggucaugcugcucguacucugcgcgguacaacuacuacucaugcgaacaagcugggcguucugcgaagcacucacacuugccacgggcccgauaacgacacuuugggaaggcucaccggguaaguucuggaacacaaccauagcagucagcauggcaaacaucuucaggggaagcuaccuagcaggggcagggcuggcuuucagcaucaugaaauccguaggcaccgggaaacgcggaaccggcucacagggagagacccuaggcgaaaaauggaagaaaaaguugaaccagcuaagcagaaaagaauucgaucuuuacaagaaguccggcaucacggaggucgaccgcaucgaggccaaagagggacugaagaggggagagaucacccaccacgcuguguccagaggcucggcuaaguugcaaugguucguggagcgaaacaugguaaucccggaagggcgaguaaucgaccuggggugcggaagggggggaugguccuauuauugcgcgggccuaaagaagguaaccgaaguaagaggguauacaaaaggaggcccaggucacgaagaacccguacccaugagcacauauggcuggaauaucgucaaacucaugaguggcaaagacgucuucuaucuaccaccagaaaaaugcgauacacugcuaugcgacauaggcgaaagcaguccaucgccgacgguggaagagagccgcacaaucaggguacuaaagaugguagagcccuggcucaaaaacaaccaauucugcaucaagguacugaacccauacaugcccaccgugauugagcaccuggaaaggcuucagcgcaaacacggaggaaugcucguaaggaaccccuuaaguaggaacagcacccacgaaauguauuggaucagcaacgggaccgggaacauagucucaagcgucaauauggugucgcgacuacuacucaaccgauucacuaugacccaucgucgcccaaccaucgagaaggacguagaccugggagcaggaacccgccacguaaacgcagaaccagaaaccccaaacaugaacgugaucggcgaaagaaucaggaggaucaaagaagagcacuccuccacguggcauuacgacgacgaaaacccauacaaaacgugggccuaccacggaucauaugaaguuaaagccaccggaucagcgucauccaugauaaacgggguagugaagcugcucacgaaaccaugggacguggugccuauggucacccagauggccaugaccgacaccaccccauucggccagcagaggguauucaaggaaaaaguggacacacgcacaccaagaccaaugccagggacgcgcaaagucauggaaaucacggcugaguggcuauggagaacgcuggggcgaaacaagcggccacgccuaugcaccagagaggaguucauaaagaaaguccgcaccaacgcagcaaugggagcaguauuuacggaggagaaucaaugggauagcgcacgggcagcaguagaggaugaggaauuuuggaagcucguagaccgcgaacgggaauuacacaaacugggaaaguguggaucgugcgucuauaacaugaugggcaagcgcgagaaaaaauuaggugaguucggcaaggcaaaaggaagcagagcaauaugguacaugugguugggagcccgauaucuagaguucgaagcccuagguuuccucaacgaagaccauugguuuucccgggaaaacagucacucgggaguagagggugaaggccuccauaaacuaggcuacauucugcgcgacauaagcaagauccccggcggcgcaauguacgcugacgacacggccggcugggacacacggauaacggaagacgaccugcacaaugaagaaaaaauuacacagcaaauggacccagaacaucgacaauuagccaacgcaaucuuuaaauugaccuaccagaacaaggucguaaaaguccaaaggcccacgccaaaaggaacagucauggacaucaucagccggaaggaccaaagagguucaggccaagucggcacauacggcuuaaacacauucacaaacauggaggcccaauugaucaggcagauggagggcgagggaguacuguccaaagcggaucuggaaaacccccaucucuuggagaaaaagguaacgcaauggcucgaaacuaaaggaguggaacggcuaaaacgaauggcaaucaguggggacgacugugucguuaaacccauugaugaccgauucgcuaacgcacuucucgcccuaaaugacaugggaaagguucgcaaggacauaccgcaguggcaaccuucaaagggauggcacgacuggcaacaaguucccuucugcagucaccacuuccacgaauuaauaaugaaagacggccgcaaacuuguggucccgugcaggccccaagaugaacugauaggccgagcgcguauuagucaaggggcaggguggucgcugagggagaccgccugccugggcaaagcguacgcacaaaugugggcucuaauguacuuucacagaagggaccuacgccuugccucuaacgcaauuugcuccgcggucccgguccacuggguuccgacaagucggacuaccuggagcauccacgcacaccaccaauggaugacaacagaagacaugcucacaguauggaaucgcguguggauugaagacaauccauggauggaagacaaaaccccagugacgacaugggaggacguucccuaucugggaaaacgggaagaccaauggugcgggucucuaauaggguugacaucaagggccacgugggcgcaaaauauacuaaccgccauacaacaaguaagaagccuuaucggcaacgaagaguuccucgacuacaugccaucaaugaagcgcuuucgaaaggaagaggaaccagagggcgcgauaugguag

SEQ ID NO: 26167 - RNA, 9873 nt, Artificial Sequence
  derived and/or modified CDS sequence (opt11) from DENV-3__FJ644564__SS-prME
accucgcugugccucaugaugauacugcccgccgcccuggcguuccaccucacgagccgugacggagaaccccgaaugaucguugggaagaacgagcgggguaaaagccugcuuuuuaagacggccagcgggauuaacaugugcacccuuauagcgauggaucucggggagaugugcgacgacaccgugaccuacaaguguccacacauuaccgaaguggagcccgaggacaucgacugcuggugcaaucucaccucgaccuggguaaccuacgggacgugcaaccaggccggcgagcaccggcgcgacaagcgauccguagcccucgcgccacaugugggcaugggguuggauacccgcacccaaaccuggaugagcgccgagggugcauggcggcaagucgagaagguggaaacgugggcucugcgccacccgggguucaccauccucgcucuauuccuggcccacuacaucggcaccucgcuuacccagaagguggugauuuuuauccugcugaugcucgugacgcccuccaugaccaugcggugcguggguguuggcaaucgcgacuuugucgaggggcuuuccggggccaccuggguggacgugguccuggagcacggcgggugcgucaccaccauggccaaaaacaaacccacccuagauaucgagcugcaaaagaccgaggccacccagcuggcgacgcuacgaaaguuauguaucgagggcaaaaucaccaauauaacgaccgacucccgcugccccacgcaaggcgaagccguguuaccggaggaacaggaucagaacuaugucugcaagcacaccuauguagauaggggcuggggaaacgggugcggccucuucgggaaagggagucugguuaccugcgcgaaguuucagugucuggagcccaucgaaggcaagguggugcaguacgagaacuuaaaauacacggugauuauuaccguccacaccggggaucagcaccaggugggcaacgagacgcagggggucaccgccgaaaucaccccccaggcaagcaccaccgaggccauccuucccgaguacgggacauuggggcucgaaugcuccccgcgaaccggccuggacuucaacgagaugauccugcucacgaugaaaaacaaggccuggaugguucaccggcagugguucuucgaccuaccccuccccuggaccucaggggccaccaccgagaccccgaccuggaaccgcaaagaacugcuggugaccuucaagaacgcccacgccaagaaacaggaaguggugguuuuagggucccaggaaggugcgaugcauacugcuuugacgggggccaccgagauucagaacagcggcgggacguccaucuucgccggccacuugaaaugccgguuaaagauggacaaguuagaacuaaaagguauguccuacgccauguguaccaacacuuuugugcugaaaaaggagguuuccgagacccagcacgggacgauuuugaucaaaguggaguacaagggcgaagacgcgccgugcaagaucccauucagcaccgaggacggacagggcaaggcccacaauggccgccugaucacggccaacccgguggugacaaagaaggaggagcccguaaacauugaggccgagccgcccuucggggagucgaauaucgucaucggcaucggggacaacgcgcuaaagaucaacugguacaagaagggcuccagcaucgguaagauguucgaggccaccgcccggggcgcaagacgaauggcuaucuugggcgacaccgcgugggacuucggaucagucgguggcgugcucaauucacucggcaagaugguccaccagaucuucgguuccgcuuacacggcccuguucucgggcguuuccugggugaugaagaucggcauugggguacuucugacguggauuggucugaacagcaagaauacuuccaugagcuucucuugcauugccaucgggauaaucacccuguaccugggugccguggugcaggcagacauggggugcguuaucaacuggaaggguaaagaacugaagugcggguccgggaucuucguaacgaacgaggugcacaccuggaccgaacaguacaaauuucaagccgauuccccgaagcgccucgccaccgccaucgccggagcaugggagaacggugucuguggcauucgcagcaccacucggauggagaaucugcucuggaaacaaaucgccaaugagcuuaacuauauccuaugggaaaacaacaucaagcugaccguaguagucggggacaccaucggcgugcucgagcagggcaagcgcacgcuuacgccccagccgauggagcugaaguacuccuggaaaaccugggggaaggcaaaaaucgucacggcagagacccagaacagcaguuucaucaucgauggucccaacacacccgaaugcccaagugcuagcagggccuggaacgugugggagguagaggacuacggauucggcguguucacaacgaacauauggcuuaaacuacgcgagguuuacacccagaugugcgaccaccggcugaugagcgcagccguaaaggacgagcgcgcagugcaugcggacaugggcuacuggauagagagccagaagaaugggucguggaagcuugaaaaggccagccugaucgagguaaagaccuguacuuggccgaagagccacacccucuggucgaacggcguguuggagucugacaugaucauuccgaagagcuuagccgggccgaucucgcagcacaaccaucguccuggguaucacacccagacggcagggcccuggcaccuggaaaaccucgagcuggauuuuaccuacugcgaaggcacuacgguggucaucacggagaacugcgggacccgagggcccuccuuaagaaccaccacgguguccgggaaguuaauccaugaguggugcugccgaagcugcacacuacccccguuaagauacaugggugaggauggcuguugguacgggauggagaucaggcccaucuccgagaaagaggagaacauggucaagagccucguuagcgccggaagcgguaaaguggacaacuucaccaugggaaucuuaugccuggcaauucucuuugaggagguuaugcguggcaaguucgggaagaagcacaugauugcuggcguuuuuuucaccuucgugcuguugcuuuccggccagaucacguggcgcgacauggcccacaccuugaucaugaucgguucaaacgccucugaccggauggguaugggggugaccuacuuagcgcugaucgcgacguucaaaauacagcccuuucucgcccugggauucuucuugagaaagcuuacgagcagagagaacuugcucuuaggggucggccuggcaauggccaccacgcugcagcuuccggaggacaucgaacagauggccaacggcauagcgcugggguugauggcccugaaacucaucacccaauucgagacauaccaacuguggaccgcacuaauauccuugacaugcagcaacaccaucuucacgcucaccguggccuggcgcaccgcgacccugauccuugccggcgugagccucuuaccugugugccaguccagcagcaugaggaagacggacuggcugccuaugacagucgccgcuaugggugucccgccguugccgcuguuuauuuuuagccugaaggauaccuuaaagcgcaggagcuggccccucaacgagggugugauggccguggggcugguaagcauccuggccagcagccugcuacggaacgacgugcccauggccggcccgcucguggccggcgggcugcugaucgccugcuaugugaucaccggcaccucggccgaccucaccguggagaaggcggcggaugugaccugggaagaggaggccgagcagaccggagucagucacaaccuuaugaucaccgucgacgacgacggcacgaugcgcaucaaggacgacgagaccgaaaacaucuugacuguacuucucaagaccgcacuuuugauugucuccgggaucuucccauauucgauccccgcgacgcuacugguuuggcauaccuggcagaaacaaacccagcguuccggcguccucugggacguccccagccccccggaaacccagaaggccgaguuagaggaagggguauaccguaucaagcaacaggggauccugggcaagacccaaguuggggucggcguccaaaaggaggguguguuccacaccauguggcacguaacccggggcgcggugcucacccacaacggcaagcgccuggagcccaauugggccuccgugaagaaggaucugaucagcuaugggggcggguggaggcucuccgcccaguggcagaaaggagaggagguccaggugaucgcggucgagccugggaagaacccaaaaaacuuccagacgaugccaggcaccuuucagacaaccacuggcgagaucggggccauagcacuagauuucaagcccgguacaucaggaagccccaucaucaacagagagggaaagguagugggccuguaugggaacgguguggucacgaagaaugggggguacguguccgguaucgcacaaaccaaugccgaaccggacggccccacgcccgagcuggaggaggagauguuuaagaaacggaaccucaccauaauggaccuucaccccggcucagguaaaacccgcaaauaccugcccgcuaucgugcgggaggcaaucaagcgucggcugcguacccugauauuagcacccacgcgagucguggccgcugagauggaggaggcgcucaagggccuacccauccgcuaccagacgaccgcgacaaagucggagcacacggggcgggagaucguggaccugaugugccaugcaacguucaccaugcgccugcugagccccguccgggugccaaacuauaacuuaauuaucauggaugaggcccauuucacugacccggcuaguauugcggccaggggcuacauaagcacacguguggggaugggcgaggccgcugcuaucuucauguccgcaacgccgcccggcaccgcggacgccuucccgcagucuaacgccccgauucaggacgaggaaagagacauccccgagcgauccuggaacucagggaaugaauggaucaccgacuucgcgggcaaaacggucugguucgugccguccauuaaggcugggaaugauauugcgaacugccuccggaagaaugguaaaaaggugauccaacugucgcgcaagaccuucgacacugaauaccagaagaccaagcugaacgacugggacuucgucgucacaacggacaucuccgagaugggugccaacuuuaaggccgacagagugaucgacccgcgccggugccucaagccugucauucugaccgacggacccgaacgcgugauucuggcgggcccuaugccagugaccgccgccagcgcagcccagagacgcgggcgggucggccgcaauccccaaaaggagaacgaccaguacaucuucacagggcagccccucaacaacgaugaagaccacgcgcacuggacggaggccaagaugcuccuggauaauauaaacacccccgagggcaucaucccggccuuguuugagcccgagagggagaaguccgcagcuaucgacggcgaguaccgccugaagggcgagagccgcaagacuuuuguagagcugaugcgacggggugauuuacccguguggcuggcacacaagguggccuccgaggggaucaaauacaccgaccggaaguggugcuuugacggccaacggaauaaccaaaucuuggaggaaaacauggacguugagauuuggacaaaggaaggggagaagaagaagcucaggcccagguggcuggaugcacgcaccuacagcgacccucuggcacucaaggaguucaaggacuuugccgcugggcgaaagucuaucgcccuugacuuagucaccgagauuggucgggugcccagccaccuagcccaccgcacccggaacgcucucgacaaccuggugaugcuccacacgagcgagcacggcggccgggccuaucggcacgcugucgaggaauugccagagacaauggagaccuuacucuugcuggggcugaugauucuacugaccggcggugccaugcucuuucucauuuccggcaaaggcaucgggaagacgagcauuggccugaucugcgugaucgcguccagcggcaugcucuggauggcggagaucccgcugcaguggauugcguccgcaauaguguuggaguuuuucaugaugguccuucucauacccgaacccgagaagcaacgcacgccccaggacaaccagcuggcauacguuguaaucggcauccuaacccuggccgcgauuauagcggccaaugagauggggcugcuugagacgacuaagcgggaccuaggcaugucaaaggagccgggcguggugucccccaccagcuaucuggacguagaccuccacccagcguccgccuggacccuguacgcggucgccaccacagugaucaccccuaugcugcgccacaccaucgagaauagcacagcuaacguaucccucgccgccaucgcgaaucaggcagucguacugaugggacuggacaagggcuggcccaucagcaaaauggaccucggagugccucugcuggcucucggauguuacucccaggucaauccccugacucucaccgcagcggugcuccuguugaucacgcacuacgcgauaaucggacccggccuccaggccaaggccacccgggaggcucaaaagcgcacggcagcgggcaucaugaagaacccuaccguggacgguaucauuaccauagaccuggacccugucaucuacgauagcaaguucgagaagcagcuggggcaggugaugcucuugguucuuugugcuguccaguuacugcugaugcggacgaguugggcacucugcgaggcccugacgcuggcgaccgggcccaucacuacccugugggagggaucgcccggcaaguucuggaacaccacgaucgcggucuccauggccaacaucuuuagagggagcuaucuugccggcgcggggcuggcguucuccaucaugaagucuguggguacggggaagcggggaaccggcagccaaggggagacgcuaggcgagaaguggaagaagaagcugaaccagcucucccgcaaagaguucgacuuguauaagaaguccgggaucacggaggucgaccggacagaagcuaaggagggccucaaacguggcgaaacuacacaccacgcuguguccagagguagcgccaagcuucaguggcugguggaacguaacauggucaucccggagggacgagugaucgauuuagggugcggccgcgggggaugguccuacuauugugccggccuuaagaaggugacggaagugaggggcuauacuaaaggcgggcccggccaugaagagccggugcccaugagcaccuacgguuggaacaucguuaagcucauguccggcaaggacgucuucuaccugccaccagagaagugcgacacauuacuaugcgacauuggggaaucguccccgagcccgacgguggaggagucccguaccauccgcguguuaaagauggucgagccuugguuaaagaacaaccaguucugcaucaagguccuuaaccccuacaugccugccguaauugaacaccucgagcggcuucagcgcaagcacggaggcaugcugguccggaacccccucagccgcaacagcacgcacgagauguauuggaucucaaauggaacaggaaauauaguguccagcguuaacauggugagucgucugcuguugaaucgcuucacgaugacacaccggcguccgaccaucgagaaggauguagaucugggggcuggcacuaggcacgugaacgcagaacccgaaacgcccaacauggacgucaucggcgaacgcaucaaacggauaaaggaggagcauaacagcaccuggcacuacgaugacgaaaacccguauaagaccugggccuaccacgggucuuaugaggugaaggccacaggaagcgcaagcaguaugauuaacgggguagucaagcugcucacuaaaccaugggacgucguccccaugguuacgcagauggcaaugaccgauacuacuccauucggccagcagcgcguauuuaaggaaaagguagacacgcggaccccgcgucccaugcccgggacccggaaaguaauggagauuaccgccgaauggcuauggcgcacguugggacgcaacaagcguccaagguugugcacccgcgaagaguucacuaagaagguacgaacuaacgcagcgaugggcgccgucuucaccgaggagaaccagugggacagcgccaaggccgccguugaggacgaagaguucuggaaacuaguggaccgggagcgcgaauuacacaagcucgggaaguguggauccugugucuacaacaugauggguaaaagagagaagaaacuuggcgaguucggaaaggcgaaggguagccgcgccaucugguacauguggcuggggucacgguauuuggaauucgaggcccuaggguuccugaaugaagaccacugguucucacgcgagaacaguuauagcggcguggagggggagggcuugcauaagcugggguacaucuuaagagacauauccaagaucccgggcggcgcgauguacgccgacgacaccgcggggugggauacccgcaucaccgaggacgaccuccauaacgaggaaaagauaacacagcagauggaccccgagcaccggcugcuagccaacgccaucuucaagcucaccuaccagaacaagguggucaaggugcagcgccccacacccacuggcacggucauggauaucauaucuagaaaggaccaacgcgggagcggucaagucggcaccuauggguugaacaccuucacaaauauggaagcccagcuagugcggcagauggagggggaaggagugcucagcaaggccgacuuagagaauccgcaccucccagagaagaagauaacgcagugguuggagaccaaaggcgucgagcgccucaaacggauggcgaucuccggggacgauugcgucgugaagccaaucgacgaccgcuucgccaacgcccugcuagcccugaacgauaugggcaaaguccggaaagacauaccacaguggcagccgaguaagggauggcacgacuggcagcaggugcccuucuguucccaccauuuccacgagcugaucaugaaagacggacgaaaacuggugguacccugccgcccccaggacgagcuuaucggccgagcucggauuucucagggggcgggcuggucccugcgcgagacagccuguuuagguaaggcauacgcgcagauguggagccugauguauuuucaccgcagagaccugcgccucgccucuaacgcaauuugcagcgccguuccggugcacuggguuccuacaagccgaacgacaugguccauccaugcccaccaccaguggaugacaacugaagacaugcugaccguguggaaccgcguauggauagaggacaaccccuggauggaggauaagacccccguuaccacgugggagaacguuccguacuugggcaagcgggaggaccaguggugcgggucucucauuggguuaaccagucgcgccacuugggcgcagaacauccccacggccauccaacagguccggagccugauuggaaacgaggaauuccucgacuacaugcccuccaugaagcgcuuccggaaggaggaggagagugagggcgcaaucugguaa

SEQ ID NO: 26168 - RNA, 9873 nt, Artificial Sequence
  derived and/or modified CDS sequence (opt11) from DENV-3__HQ235027__SS-prME
accucacugugcuugaugaugauccugccugcggcccuggcuuuccaccuaaccagcagagacggcgagccacggaugaucguggggaagaacgagcgggggaagagucuguuauucaagaccgcguccgggaucaauaugugcacccucauagccauggacuuaggcgagaugugugacgacaccgugaccuacaagugcccccacaucacggagguggagcccgaggacauugacuguuggugcaacuuaacaaguaccugggugacuuacgggacuugcaaccaggccggcgaacaccggcgcgacaagcgguccguagcacucgcaccccacgugggcauggggcuagacaccaggacccagacuuggauguccgccgaaggcgccuggagacagguggagaagguggagacgugggcccugcgccacccuggguucacuauccuggcgcuguuccuggcccacuacaucggcaccucccuaacccaaaagguggucaucuuuauacuguuaaugcucguuacgcccagcaugacgaugcggugcguaggcgugggcaaccgggacuuugucgaaggccuauccggggccaccuggguggacguuguccuagagcacggcgggugcgugacuacgauggccaagaacaagcccacccucgauaucgaacugcaaaagaccgaggcaacacaacuggcuacguugcgaaaguugugcauagaagggaagaucaccaacauaacaaccgacucacgcugcccuacucagggugaggccguacugccggaggagcaagaccagaacuaugucugcaagcacaccuacguggaucggggguggggcaaugggugcggcuuauucggaaagggaucccuggugaccugcgcaaaguuccagugucuugagccgaucgaaggcaaggucgugcaguaugagaaucuuaaguauaccgugaucaucacgguccacaccggggaccagcaccaggucggcaaugagacacagggggucaccgccgagaucacaccgcaggccagcaccaccgaagcgauucugcccgaguaugguacccuggggcucgagugcuccccgcgcaccggccuggacuucaacgagaugauauuacucacgaugaagaacaaggccuggauggugcauaggcagugguucuucgaccuuccccugcccuggacaucgggcgcgacuaccgaaacgccuaccuggaaccgcaaggagcuccuagugacauucaagaacgcccacgcgaagaagcaagagguugugguguuggggucgcaagagggagcgaugcacaccgcccucacaggcgccaucgagauccagaauagcggcgguaccuccauuuucgccggucaccugaagugccggcugaagauggacaaguuagagcugaagggaaugaguuacgccaugugcacgaagaccuucgucuugaagaaggagguguccgagacgcagcaugggaccauccucauaaagguggaguacaagggugaagaugcuccgugcaagauacccuuuagcaccgaagacgggcagggaaaagccuacaauggcaggcugaucacagccaaccccguggugacuaagaaggaugagccgguuaauaucgaggccgagccgcccuucggagaaagcaacaucgucauugguaucggggacaaugcgcuuaaaauaaacugguauaagaagggcuccagcauugggaagauguucgaggcuacggcccggggcgcccgccggauggcuauccugggggacaccgcgugggacuucggguccgucgguggggugcucaauagccuggggaaaauggugcaccagaucuucgguuccgccuauaccgcguuauucagcggugucuccugggugaugaagauaggcaucgggguccuacugacguggauuggcuugaacucuaagaacaucuccaugagcuuuuccugcaucgcaauugggaucaucacccucuaccugggggccguggugcaggcugacauggggugugucaucaacuggaagggcaaggaacugaaguguggcagcgguaucuucgugaccaacgaagugcacaccuggacggagcaguacaaguuccaggccgacucccccaagcgccucgccacggcgaucgccggagcgugggagaacggggucugcggcauccgcucgaccacccggauggagaaccugcuguggaagcagauagcaaacgagcucaauuacauccugugggagaacaacaucaagcugacggugguagucggagacaccaucggcgugcucgagcagggcaagcgcacccugacaccccaaccgauggaacugaaauacuccuggaagacgugggggaaggcgaagauagugaccgccgagacccagaacucguccuucauuauagacggccccaauacccccgagugccccuccgcgucccgcgccuggaacgucugggagguggaagauuacggguucggcguguucacgacgaacauuugguugaagcugcgagagguuuacacucaacucugcgaccaucggcucaugagcgcugccgugaaggacgagcgcgcugugcacgccgacaugggcuacuggaucgagagccagaagaacggguccuggaagcuagagaaggccucuuuaaucgaggugaagaccugcaccuggccgaaaucucacacgcucuggucgaacggcguccuggaguccgacaugauuauucccaagucacuggccgggcccaucucccagcauaaucaccggccgggguaccacacgcagaccgccgggcccuggcaccucggcaaacuugagcuggauuucaacuacugcgagggcaccacgguggucaucaccgagaacugcgggacgcgcggcccaagccuccggacgaccacuguguccgggaaguuaauccacgaguggugcugucgcucaugcacacugccgccgcuccgcuacaugggcgaggacgggugcugguacggcauggaaauucgccccaucuccgagaaggaggagaacauggucaagagccuggucuccgccgggucagggaaggucgacaacuucacgauggguguccugugccucgcgauccuguucgaggaaguuaugcgugggaaguucggcaagaaacacaugaucgcaggcguguucuucacguucguccuguuauuauccggccagaucacauggcgcgacauggcacacacccugauuaugaucggcagcaacgccucugaccggauggggaugggcgucacauaucuugcacuaauagcaacuuucaaaauacagccguuccuggcccucggguucuuccuaaggaagcugacgagccgggagaaccuccucuuaggcguaggcuuagccauggccaccacccugcaguugcccgaggauauugagcagauggcgaacgggaucgcucucggccugauggcccugaagcugaucacgcaguucgagaccuaccagcucuggaccgcccugaucucucugaccugcuccaacacgauguucacccugaccguggcauggcgcaccgcgacgcugauccucgccgggguuagccuacuuccaguuugccaauccuccuccaugcggaagaccgauuggcuccccauggcggucgcagcgaugggcgugccaccccuuccgcuguuuaucuucagccucaaggacacccugaagcgccgcucuuggcccuugaacgaaggggucauggcggucggccucgugagcauucuggccaguagucugcugcggaacgacgugcccauggccggcccgcuggucgccgggggucuccucaucgccuguuacgugauuacggguaccucggcggaccugaccguggagaaagccgccgacauuacaugggaggaggaggccgagcagacuggcguaucacacaaccuaaugaucacgguggacgacgacgggacgaugaggaucaaggacgacgagaccgagaacauccucacggugcugcugaagaccgcccuccuggucguguccggcgucuucccguacagcaucccugcuacgcugcucgucuggcauaccuggcagaagcagacccagcgguccggggugcugugggacguacccuccccgcccgagacccagaaggcagaguuagaggagggggucuaucgcaucaagcagcagggcauauuuggaaagacccaggugggcguggggguccagaaggaaggcguguuccacacuauguggcaugugacccggggcgccgucuuaaccuacaacgguaagagacuggagcccaacugggccagcgucaaaaaggaccugaucagcuacggcggcggcuggcgacuaagugcccaguggcagaagggggaagagguucagguuaucgcgguggagccuggaaagaaccccaagaacuuccagacgaugcccggcaccuuccaaaccacaacgggggagaucggcgccaucgcccuggacuucaagcccgggaccucaggcucccccauaauaaacagggagggcaagguaguugggcuguacggcaacggaguagucaccaagaacggaggguacgucuccggcauugcgcagaccaacgcggagccugauggccccacgcccgaacuggaggaggagauguucaagaagcggaaccucaccaucauggaucugcacccggggaguggcaagacccgcaaguaccugccagccaucguucgcgaagcaauaaagcgccgacuccgcacacugauccuggcgcccacgcgcgugguggcagcagagauggaggaggcccucaaaggucugcccaucagguaucagaccaccgcuacgaaguccgagcacacuggccgggagaucguggaucugaugugucacgcaaccuucacgaugcgucuccugucacccgugagaguuccaaauuauaaccugaucauaauggaugaggcccacuucaccgaccccgcgucuauugcagcacgcgguuacaucucuacgcggguagggaugggagaggccgcggccauauucaugacagccaccccgcccgggaccgccgaugccuucccgcaaucuaacgcgccgauccaggacgaggagcgcgacaucccugagaggagcuggaacaguggcaacgaguggauaacggacuuugccgggaagaccguuugguucguucccagcaucaaggcugggaaugacaucgccaacugucuccggaagaaugggaaaaaggugauacagcugagcaggaagacuuucgacacugaauaccaaaagacgaagcugaacgacugggauuucguggucaccaccgacaucagcgaaaugggcgcgaacuucaaagcggaccgggugaucgacccacgccggugccucaagcccguaauccugaccgacggccccgaacgcguuauccuggccgggcccaugccggugaccgccgccucggcagcccagcgcagaggccggguggggcgcaacccccaaaaggagaacgaccaauauaucuucacgggccagccccucaacaaugacgaggaccacgcccacuggaccgaggccaagauguugcuggacaacaucaacacccccgagggaaucauuccggcccuuuuugagcccgaacgggagaagucggcggccauagauggcgaguaccgccuuaagggcgagagccggaagaccuucgucgagcugaugcgccgcggggaccuccccguguggcuggcucacaagguugccucagaaggcaucaaguacacggaccgcaaauggugcuucgacgggcagcggaacaaccagauccuggaagagaauauggacguggagaucuggacgaaagagggcgagaagaagaagcuccgcccucggugguuggacgcccgcaccuacucagacccgcuggcgcucaaggaguucaaggacuuugccgccggccgcaagucuaucgcccuugaccuggugaccgagaucgggcggguccccucccaccucgcucaccgcacccggaacgcguuggacaaucuggugaugcuccauaccucggaacacggcgggcgcgccuaccggcacgccgucgaggaguuacccgagaccauggagacauuacuccugcugggcuugaugaucuugcugaccggcggggccaugcuguuccugaucagcgggaaggggaucgguaagacguccauugggcugaucugcgucauagcuuccuccgguaugcuauggauggcggagaucccguuacaguggaucgccagcgccauugugcuggaguucuucaugauggugcuccugauccccgagcccgagaagcagagaacgccgcaggacaaccagcuggccuacguagugaucgggauccucacccuggccgcaaucaucgcugccaacgaaaugggccuguuggagacgacuaagagggaccucgguaugagcaaggagccugggguggucagccccaccuccuaucuggacguggaccuccaccccgccagugcguggacgcuguacgcaguggccacgacagucaucacgccgaugcugaggcacaccaucgaaaauuccacggcaaacgugagccucgccgcaauagccaaccaagccguuguccugaugggacuugacaaaggguggccgauauccaagauggaccugggcguuccccugcucgcccucgggugcuacagccaagugaaccccuuaaccuuaaccgcagccguacuccuacugauuacccacuacgccaucaucggcccgggccuucaggcaaaggccacgcgggaagcccagaagcgcacugccgccgggaucaugaaaaacccaacaguggauggcaucaugaccaucgaccuggauccggugaucuacgauucaaaguuugagaaacagcuggggcagguaaugcuccugguacugugcgccgugcaguugcugcugaugagaaccagcugggcgcucugcgaggccuugacacuggccaccgggcccaucaccacguuaugggagggcagucccgggaaguucuggaacaccaccauagcugucucaauggccaacauuuuccgcgguuccuaccuggcgggggcgggccuagccuuuagcauaaugaaaagcguggggaccggcaagcggggcacggggagccagggggaaacacucggggagaaguggaagaagaagcugaaccagcugucgcgcaaggaguucgaccgguauaagaaguccgggaucaccgagguggaccgcacggaggcgaaggagggccucaagcggggcgaaaccacgcaucacgccgucagccgcggcuccgccaagcuccagugguucgucgagcggaacauggugaucccggaggggcgugucaucgaccugggcuguggacggggcggguggagcuacuacugcgcgggauuaaagaaggugaccgaggugcgcggguacacaaaaggagggcccgggcacgaggagccaguacccauguccaccuauggcuggaacauugugaaguuaaugagcgguaaagacguguucuaccugccgccugaaaagugcgacacguugcugugcgacauuggcgaguccagccccagucccaccgucgaggagucccgcacgauucgagugcugaagaugguagagccguggcugaaaaacaaccaguucugcaucaagauacucaaucccuacaugcccaccgucaucgagcaccuggagagacuccagcggaagcacggcggaaugcuagugcgcaacccccugucccgaaacagcacgcaugagauguacuggauaaguaacggcacugggaacaucguggccagcgucaacauggucucccgccugcuccuuaaccguuucaccaugacccauagacggccgacgauagagaaagacguggaccuaggcgcuggaacacgacaugucaacgcugagcccgagacccccaacauggacgugaucggggagagaaucaagcguauuaaggaagaacacaacagcacuuggcacuacgacgacgagaacccguacaagacgugggccuaccacggcuccuacgaggugaaggcgaccggcucggccagcagcaugauuaauggcgucgugaaacucuugaccaaaccgugggacguggugcccaugguaacccagauggccaugacggacaccacccccuucgggcagcagcggguauucaaggagaagguggacacccgcacgccgaggucuaugccggguacccgcagaguaaugggcauaacggcggaguggcuguggcgcacccucgggcggaacaagaagccucgccuaugcacgcgcgaggaguuuacaaagaaaguccggaccaaugcggccaugggggcuguguucacagaggagaaccagugggacucggccaaagccgccguggaggacgaagacuucuggaagcuggucgaccgcgagcgggaacuacacaaacuugggaagugcggcuccugcguauauaacaugauggggaagcgcgagaagaagcugggcgaguucggcaaggccaaagggucccgcgccaucugguacauguggcucggugccagauaccuggaguucgaggcccugggcuucuugaaugaggaccacugguucucacgggagaacuccuacagcggcguggaaggggaaggcuugcacaaacugggcuacauuuugcgcgacaucuccaagaucccagggggcgcuauguacgccgacgacacggcagggugggauacccggauaacagaggacgaccugcacaacgaggaaaagaucacucagcagauggacccggagcaccgccagcuggccaaugcaaucuucaagcuaacguaucagaacaagguggugaaggugcagcggcccacccccaccggcaccguuauggacaucaucucucgaaaggaccagcggggcagcggccagguggguaccuacgggcugaacacguucaccaacauggaggcgcagcugauacgccagauggagggugagggggugcucagcaaggcggaucuggagaacccccaccuccccgagaagaaaaucacccaguggcucgaaacgaagggcguagagagacugaaacgcauggccaucuccggcgaugacuguguggugaaacccaucgacgaucgguucgccaaugcccugcucgcgcugaacgacaugggcaagguccgaaaggacaucccccaguggcaacccagcaaggguuggcacgacuggcagcagguccccuuuugcagccaccacuuccacgagcuaaucaugaaggacggacggaagcuggugguccccugccgcccgcaggacgagcugauuggcagagcucggauaagccaaggggccggcuggagccuccgcgagacggccugccucggcaaggcauacgcgcagauguggucacucauguacuuucaccggcgcgaccugcggcucgccuccaacgccaucugcagcgccgugcccgugcacugggucccgaccucccgcaccaccuggucaauucaugcgcaccaccaguggaugaccaccgaggacaugcugaccguguggaaucggguguggaucgaggacaaccccuggauggaggacaagacccccgugacgacuugggaggaugugcccuaccuggguaagcgugaagaccaguggugcggcagccucaucggacuuacgagccgggccacaugggcccaaaacaucccgacggccauccagcagguucgcagccugauuggcaacgaggaguucuuggacuauaugcccuccaugaagcgguuucgaaaggaggaagagagcgagggggccauaugguga

SEQ ID NO: 26169 - RNA, 9873 nt, Artificial Sequence
  derived and/or modified CDS sequence (opt11) from DENV-3__JQ920476__SS-prME
accagccugugcuuaaugaugaugcuccccgccacacuggcauuccaccucaccagccgggauggcgaaccccggaugauuguggggaagaacgagcgugggaagagccuucuguucaagaccgcgagcgggaucaacaugugcacccucauagcgauggaccugggagagaugugcgacgacacugugaccuacaagugcccccugaucacggaaguggagcccgaggauaucgacugcugguguaaccucaccagcaccugggugaccuacgggaccugcaaccaggcgggcgagcaccgccgagauaagcguuccgucgcccuagcgccgcaugugggcaugggguuagacaccaggacucaaaccuggaugagcgcggagggcgccuggcggcaagucgagaaggucgaaaccugggcguucagacaccccggcuucaccauccuggcgcuguuccuggcgcauuauaucgguaccuccuuaacgcaaaaggucgugaucuuuauccugcucaugcucgucacccccucaaugaccaugcguugugugggcgugggcaaccgagacuucguggaaggccuuuccggggccacauggguggacgugguccuggagcacggggguugcguaacgacuauggcaaagaacaagcccaccuuagauaucgagcugcagaagaccgaggccacccaguuggcuaccuugcguaaguuguguaucgagggcaagauaaccaacguuacgacggauagccggugccccacccagggcgaggcaauccugcccgaagagcaggaccagaacuaugucugcaaacauaccuacguggaccgggggugggggaacggguguggccucuucgggaagggcucccuggugacaugcgcaaaguuccagugcuuagaaagcaucgagggcaaggccguucagcacgagaaccucaaauauacggucaucaucaccgugcauaccggagaccagcaccaggucggcaacgagacgcagggggugacggccgagaucacuccccaggccuccaccgucgaggcuauacugcccgaguacggcacauugggacucgagugcucaccccggaccggacuggacuucaacgagaugauucugcucaccaugaagaacaaggccuggauggugcaccgucagugguucuuugaucugccgcugcccuggaccucuggcgccaccaccgagacgcccaccuggaauaaaaaggagcuccuagugacguucaagaacgcccaugccaagaagcaggaagucgugguuuuagguagccaggaaggcgcgaugcacaccgccuuaacgggggcaaccgagauccagaccagcggcgguaccagcauuuucgccggacaccuaaagugucgccuaaagauggauaaacuagagcucaagggcauguccuacgccaugugccugaaugcguucgugcucaaaaaggagguauccgagacgcaacacggcaccauccuuaucaagguggaguacaagggggaggacgccccaugcaagaucccuuucucaaccgaggaugggcagggcaaggcgcacaacggacggcugauuacagccaaccccaucguuacgaaaaaggaggagccugugaacaucgaggcggaaccuccuuucggggaguccaacaucgucaucggcauaggggacaaggcucugaagauaaacugguauaagaaagggucauccaucgggaagauguucgaagccacggcccgcggcgcacggcggauggcgauucucggcgacaccgccugggacuuugggagcgucggcggugugcuaaacucccugggaaagaugguccaccaaaucuucgguagcgcauacaccgcacucuucaguggcgucagcuggaucaugaagaucgguaucggaguguuacugacguggaucggcuugaacucgaaaaacaccucuaugucguucagcuguaucgugaucggcauuaucaccuuguaucuuggcgccguagugcaggcggacauggggugcgugaucaacuggaaaggcaaggagcucaaauguggcuccggcaucuucguaaccaacgaagugcacacguggacagagcaguacaaguuccaggccgacagccccaagcgccuggccacggccaucgccggcgcgugggagaacggugucugcggcauccgcuccaccacgcguauggagaaucugcuuuggaagcagaucgcaaaugagcuaaacuacauccugugggagaacaauaucaagcucacgaucgucguaggggacgugauaggcguccuggagcagggcaagcggacccugacgccccagcccauggaguuaaaauacaguuggaagacgugggggaaggccaagauagugaccgccgagacccagaauuccagcuuuaucauugacggcccgaauacgcccgagugucccaacgcgucucgugcguggaacguuugggagguugaggacuacggguucggcguguucacgacuaacaucugguugaaguuacgggagauguacacccagcucugcgaccaccgcuugaugagcgcggccgugaaggaugagcgggcgguccacgcggacaugggauacuggaucgagagccagaagaacgggaguuggaaacucgagaaggcgagccugaucgagguaaagaccugcacuuggcccaagagccacacgcuauggagcaacggcgucuuggaguccgacaugaucauccccaagagucucgccgggcccaucucccaacacaacuauagaccgggcuaccauacccagaccgcuggacccuggcaccuggguaagcuggagcuagacuucaauuacugcgaaggcaccaccguggugaucacggagaacugcgggacccgcggacccagccugcgcacuacgaccgugucgggaaagcugauccacgaaugguguugccggagcugcacauugccgccucuccgcuacaugggcgaggacggguguugguauggcauggagauccggccgaucaacgagaaggaggagaauauggucaagucccuggugagcgccggcucagguaaagcggauaacuucacgaugggcgugcucugccuggccauccuguucgaggaggucaugcgcgggaaguucggcaagaagcacaugaucgcuggggcgcucuucacguuugugcuccugcuaagcggccagaucaccuggcgggacauggcgcacacauuaaucaugaucggcuccaacgcgucagaccgaaugggaaugggcgugaccuaccucgcccucauugccacguucaaaauacagccuuuccuggcccugggguucuuccuccgaaaguuaaccucccgugagaaccugcuucugggcguuggccuggcaauggccaccacccuccagcugccugaggacaucgaacagauggccaacgggaucgcgcugggccucauggcccugaaauuaaucacgcaguuugagacuuaucagcucuggacugcucuggugucacugaugugcagcaacaccaucuuuacgcuaaccguggcguggcggaccgccacccugauccuggccgucaucucacuccugcccgucugccaaagcuccucuaugcgcaaaacggacuggcugccgaugaccguagccgcgaugggggugccgccacucccacuguucaucuuuucgcugaaggacacccucaagcggcgcagcuggccguuaaacgaaggcgugauggccgucgggcugguuucuauccucgccagcagcuuucugcggaacgacgugcccauggcuggaccccuggucgccggugggcuccugaucgcaugcuacgugaucacggggacguccgccgaucugaccgucgagaaagcggcagaugucaccugggaggaggaggcggagcagacgggggucucccauaaccucaugaucacgguggacgacgacggcaccaugcggauuaaggacgacgagaccgagaacauccugacuguccugcucaagaccgcauuacugauugucagcgggaucuuccccuacucaaucccagcaacucuccugguguggcacaccuggcagaagcagacccagcgcagcggcguccugugggacguucccagcccuccagagacccagaaagccgaacucgaggagggcguguaccggaucaagcagcaaggaaucuucggcaagacgcagguuggugugggcgugcagaaggagggggucuuccauaccauguggcacgugacccgcggcgccgugcugacccauaacgggaagcggcuggagccgaacugggcgaacgucaagaaggaccucaucagcuacggcggcgguuggaaacuguccgcgcaguggcagaagggcgaggaaguccagguuaucgccgucgagccugggaaaaaccccaagaacuuccaaaccaugccuggaaucuuccaaaccaccaccggagaaaucggcgccauagcccuggacuuuaagccugggacgucggggucccccaucauaaaccgcgagggcaagguugugggccuguaugggaauggcgucgugaccaagaacggaggcuacgugagugggauagcgcagaccaaugcggagcccgacggaccgaccccagaacucgaggaggagauguuuaagaagcgcaaucugacgauuauggaccugcaccccggcagcggcaagacucggaaguaccuuccugccaucguccgggaggcgaucaagaggaggcugcguacccugauucuagccccgacccgggugguggcagcugagauggaggaggcccugaagggcuuacccauccgcuaccagacgaccgccacgaaguccgagcauaccgggcgggagaucguugacuuaaugugccacgccacguucaccaugagacugcugagccccgugcgggugcccaacuauaaccuuaucgucauggacgaggcucacuucaccgacccagccuccaucgccgccagggguuauaucucaacccgggugggcaugggggaagcggcggccaucuuuaugacggccacgcccccggggaccgcagacgcguucccccaauccaacgccccgauccaggacgaggagagagacaucccugagcggucauggaauuccgggaacgaguggaucaccgauuucgcuggcaagacugugugguucgugcccagcauaaaggcagggaacgauauugccaacugccugaggaagaacggaaaaaagguuauccagcugucccgcaagaccuucgacacagaguaccagaagaccaagcucaacgacugggacuucguggucacuaccgacaucagcgaaaugggggcuaacuucaaggccgaccgggucauagacccccgccggugccugaaaccggugaucuugacugacgggccugagagagucaucuuggccggccccaugcccgugacaguggccagcgcugcgcagcggagggggcggguaggccgcaacccgcaaaaggagaacgaccaguauaucuuuacggggcagccccugaacaacgacgaggaccaugcccacuggacagaggccaaaauguuacuagauaacaucaacacccccgagggcauuauccccgcccuuuucgagccggaacgagagaaauccgcggccauugacggggaguaccgccugaaaggugaaucccggaagacguucguggagcucaugcgccggggugaccugccgguguggcuggcacauaagguagcgagcgaggggaucaaguacacggaccgcaaauggugcuucgauggcgagcggaacaaccagauccucgaggagaacauggacguggagaucuggacaaaggagggggagaagaagaagcugcguccccgcuggcuggacgcacgcaccuacagcgacccccucgcgcugaaagaguucaaggacuuugcugccggccgcaagucgaucgcccuggaccucgucacagagauaggccgcgugccuagucaccuugcccaucgcacccggaaugcgcucgacaaccucgugaugcuacacacuagcgagcacggcggccgcgccuacagacacgccgucgaggagcugcccgaaaccauggaaacacuacuccugcucggacugaugauccugcucacaggaggagccaugcuguuccugaucuccgguaagggcaucgggaagacgucaaucggcuuaaucugcgugguugcaucuuccggaaugcuguggauggcggauguuccccugcaguggaucgccucugccaucgugcuagaguucuucaugauggugcugcugaucccggaaccggaaaagcagcgcacgccgcaggacaaucagcuggccuacguugugauuggaauccuaacccuggccgcgaucguugcugcaaacgagauggggcuccuggagaccacgaagcgggaccuaggcauguccaaggaaagcggcguugugucccccaccagcuaccuugacguggaccuacacccggccagcgccuggaccuuguaugccgucgcuacuacggugaucacccccaugcuccgacacaccaucgagaacucgaccgccaacgucucccuggccgcgaucgccaaccaagccgucguucuuaugggacucgacaaaggcuggcccauaagcaaaauggaccugggggugccccugcuggcccugggcugcuacucccaggucaacccgcugacgcucaccgcggcggugcugcuccucgugacccacuacgcgaucaucgggcccggccuccaggcuaaagccacccgggaggcccagaagcgcaccgcggccggcaucaugaagaaccccaccgucgacgggaucaugaccaucgaccuggacccaguaaucuacgacagcaaguucgagaaacaacucggccaggugaugcuucugguccucugcgccgugcagcugcugcucaugcggacauccugggcguucugcgaggcgcugacgcuggccaccgggcccaucacgacucucugggagggcagcccgggcaaguucuggaacacgaccaucgccgugaguauggccaacauuuuccgcggcagcuaccuggccggcgcggggcuggccuuuuccaucaugaagucagucggcacggguaagaggggaaccggaucccaaggugagacccucggggaaaaguggaagaagaagcugaaucaguuaagccgaaaagaguuugaucucuacaagaaaucugggaucacugaaguggaccggaccgaggccaaggaaggccugaagcgcggggagaucacacaccacgcagugucacggggaagugccaaguuacagugguucguagaacgcaacauggugaucccagagggcagggugaucgaccucggguguggucgcggcggaugguccuauuacugcgcugggcugaagaaaguuaccgaggugcgaggcuacacaaagggcgguccuggccacgaggagccggugccuaugagcaccuacgguuggaacauagucaagcugauguccggcaaagacguguuuuacuugccgcccgagaagugugacacccuguuaugcgacauuggggagagcuccccgagccccacuguggaggaaucccgcacuauccggguccugaagaugguggagccguggcuuaagaauaaccaguucugcaucaaggugcugaacccuuacaugccgaccguuaucgagcaccuggagaggcuccagagaaagcacggugggaugcuggugcggaacccccucagccguaacuccacacacgagauguacuggaucagcaacgggacuggcaauaucguguccagcguaaacauggugaguaggcuccuucugaaucgcuucacgaugacgcaccggaggccuacaauugagaaggacguggacuuaggggccggcacccggcacgugaacgccgagccggagacaccgaacauggacgugaucggcgagcgcauacggcgcaucaaggaggaacacucuuccaccuggcacuacgacgaugagaaucccuacaagaccugggcauaccacgggaguuacgaggugaaggcgaccggcucggcgagcagcaugauaaacgguguugugaagcugcugacaaagccuugggacgucgugccgauggugacccagauggccaugaccgacaccacgccuuucggccagcaacgggucuucaaggagaagguggacaccaggacgccgcggcccaugccgggaacccgcaaggugauggagauaaccgccgaguggcucuggcgaacccugggccgaaacaagcggccccgccugugcacccgagaagaauuuaucaagaaggugcguaccaacgccgccaugggcgccguguucacagaggaaaaccagugggacucagcucgggccgcgguggaggacgaggaauucuggaagcucguggaccgggagcgcgaguuacauaagcuggggaagugcggcagcugcguguacaauaugauggggaagagggagaagaagcugggcgaguucgggaaggcuaaaggaucccgcgccaucugguauauguggcugggcgcacgguaccuagaguuugaggcgcuuggguuccugaaugaggaccacugguucagccgcgagaacucccacuccggcguggaaggggagggccugcacaagcucggguacauucuucgggacauuuccaagaucccaggcggcgcgauguaugccgacgacaccgcagggugggacacccgcaucacagaggacgaucugcacaacgaggagaagauuacucaacagauggacccagagcaccgccaacucgccaacgcuauuuucaagcugaccuaccagaauaagguaguuaagguacagcggccuacccccaaggguaccgucauggacauaaucagccguaaggaccagcgcggguccggccagguaggaacguaugggcugaacaccuucaccaacauggaagcccaauuaauccggcagauggaaggcgagggggugcuaucuaaggcggaccuggagaauccccacuuacuagagaagaaagucacccagugguuagagaccaaaggcguggagcgccucaagcggauggccauuaguggggaugacugcguagucaagcccauugaugaccgcuucgccaacgcccuucuugcccucaacgauaugggcaagguccggaaggacaucccccaguggcagccuucuaagggcuggcacgacuggcaacagguccccuuuugcucccaccacuuucacgagcugauuaugaaggaugggcgcaagcuggugguacccugccggccgcaggacgagcucaucggacgcgcgcgcaucagccagggggccggcugguccuugagagagacggccugccuggggaaggccuaugcgcagaugugggcccuuauguacuuccacaggcgggaucugcggcuggccagcaacgccaucugcuccgccgugccgguccacugggugccuaccagcagaacgaccugguccauccaugcgcaccaccaguggaugacgacugaggauauguuaaccguguggaaccgcgucuggaucgaggacaaccccuggauggaggacaagaccccgguaacgaccugggaggacgugcccuaccugggcaaacgcgaggaccagugguguggcagccugaucggccuuaccucacgcgcuaccugggcccagaacauccuuacagccauccagcaaguccggucccugaucggcaacgaggaguuccuggacuacaugcccagcaugaagcgcuuucggaaggaggaagaguccgagggagccauaugguga

SEQ ID NO: 26170 - RNA, 9873 nt, Artificial Sequence
  derived and/or modified CDS sequence (opt11) from DENV-3__JQ920477__SS-prME
acaagccugugccugaugaugaugcugcccgccacccucgcauuucacuugacuucccgggacggcgaaccccggaugaucguggggaaaaacgagcgcggaaaaucccugcuguucaagaccgccucggguauuaacaugugcacccucaucgccauggaccucggcgagaugugcgacgacaccgucaccuacaaguguccccugaucaccgagguggagcccgaggacauugacugcuggugcaaccucaccaguacuugggugaccuaugggaccugcaaccaagcgggcgagcaccgucgcgacaagcggucaguggcucuagcgccccacgugggcaugggccuggacacccgcacccagaccuggauguccgcggagggcgcauggagacagguugaaaaggucgagaccugggccuuccgccaccccggguucaccauccucgcgcuguuccuggcccacuauaucggcaccucacucacgcaaaagguagugaucuucauccugcucaugcucgucacucccagcaugacuaugcggugcgugggggugggcaaccgagacuuugucgagggccuguccggggccaccuggguggacgugguccuggaacauggcgguugugugacgaccauggccaagaacaagccgacccucgacaucgagcugcagaagaccgaggcaacgcaguuggccacccuccgcaagcugugcaucgagggcaagaucaccaacguaaccacugauagcagaugccccacccagggugaggcgauacugcccgaggaacaagaccaaaacuacgucugcaagcauacauacguggaccggggguggggcaaugggugcgggcuuuuugguaagggcucccuggugacaugcgccaaguuccagugccuggaaagcauagagggcaaggcaguccagcacgagaaccucaaguacaccguuauaaucaccgugcacaccggggaccagcaccaggucggcaacgagacacagggggucaccgccgagaucacgccucaggcuuccaccgucgaagcgauccugccagaguacggcacccucggacucgagugcucaccccgcaccgggcuugacuucaacgaaaugauccugcucacgaugaagaacaaggcauggauggugcaccggcagugguucuucgaccuaccgcugcccuggaccuccggcgccacuaccgagacgcccacauggaacaaaaaggagcuccuggugacauucaagaacgcucaugcgaagaaacaggaggugguaguacuggggucacaggagggcgcgaugcauaccgccuugacgggcgccacggaaauccagaccuccggcgggaccuccaucuucgccggccaccugaagugucgccugaagauggacaaguuagaacuaaagggcauguccuacgccaugugccugaacgcguuuguccucaagaaagaggugagcgaaacgcagcacgggaccauucugaucaagguggaguacaagggcgaggacgcccccugcaagauacccuucagcacugaggacggucagggcaaggcccauaacggcagacucaucaccgcaaaccccaucgugacgaagaaggaggagcccgugaauauugaggccgagccuccuuucggggaguccaacaucgugaucggcaucggugacaaggcucucaagaucaauugguacaagaaagguagcuccauugguaaaauguucgaggccaccgcccgaggcgcccggcggauggcaauccucggggacaccgccugggauuucgggagcgugggaggugugcugaacucccugggcaagauggugcaccagauuuucgggagcgcauauaccgcacucuucucuggagucagcuggauuaugaagaucggcaucgggguccugcuuaccuggaucgggcucaacuccaaaaacaccagcauguccuucagcugcaucgugaucggaaucaucacccuguaccugggcgccgucgugcaggcggacauggggugcgugaucaacuggaagggcaaagagcugaagugcggaagcgggaucuuuguuaccaacgagguccacacguggaccgagcaguauaaauuccaggccgacagccccaagcggcuggccaccgcaaucgcuggcgcgugggagaacggggugugcggcauccgcuccacuacacgcauggaaaaccuacucuggaaacagaucgccaacgagcugaacuacauccugugggagaacaacaucaaacucacgaucgucgugggggacguaauuggcgucuuagagcaggguaagcggacccugacaccccagcccauggaguuaaaguacucauggaagacuugggguaaggcuaagaucgucaccgccgagacucagaauaguucuuucauuaucgacggcccgaacacccccgagugccccuccgcgcuccgcgcguggaaugugugggagguugaggacuacggguucggugucuuuacgaccaacaucuggcugaaacuccgggagaaauacacacagcugugugaccaccgcuuaaugagcgcugcagugaaggacgagcgagcaguucaugcggacaugggguacuggaucgagagccagaaaaacggguccuggaagcucgagaaggcaagccugaucgaagugaagacuugcaccuggcccaagucccacacguuauggagcaacggcgugcucgaguccgacaugauaauucccaagagccuagccgggccuauaagccagcacaacuaucgacccggcuaccauacccaaaccgccgggccguggcaccugggcaaacuugaguuggacuuuaacuacugcgaggguaccacugucgugaucaccgagaacugugggacccggggccccagccugagaaccacgacaguuuccgggaaacucauccacgaguggugcugccgguccuguacccuuccgccccugcgcuacaugggagaagacggcuguugguacggaauggagauccggccaaucaacgagaaggaggagaacaugguuaagucccucgugagcgccgguucagggaagaccgacaacuucacgaugggcgugcucugccuggcuauccucuucgaggaggucaugagggggaaguucgguaagaagcacaugaucgccggggcgcuguuuaccuucguccugcucuuaagcgggcagaucacauggcgggauauggcccacacacugaucaugaucggcuccaacgccagcgaccgaaugggaaugggcgugacuuacuuagcguuaaucgccaccuucaagauccagcccuuccuggcccuaggguucuuucugcggaaguuaacaucccgcgagaaccuccugcugggcgucggacucgcgauggcgaccacucugcagcuacccgaggacaucgagcagauggcuaacggaaucgcccugggccugauggcccugaaacucauaacccaguucgaaacauaccagcuguggaccgcacuggugagccucaugugcagcaacacuaucuucacgcugaccguagcguggcggaccgcaacgcugauccucgcugucaucucacugcugccaguaugucaaagcaguagcaugcgcaagaccgacuggcuuccgaugaccguugcggccauggguguuccgccauugcccuuguucaucuucuccuuaaaagacacccugaagcggcgcagcuggccgcugaacgaaggcgugauggccgucgggcucguguccauccuagccagcuccuuccugaggaacgacgucccgauggccggcccucucgucgccggcgggcugcugaucgcuugcuacgugaucacgggcaccagcgcggaccucacuguggaaaaggcagccgacgucaccugggaagaggaggccgagcagacgggggugagucacaaccugaugaucaccguggacgacgacggcacgaugcggauaaaggacgacgaaaccgagaacauacugaccguacuccuuaagacggcacuguugaucgugucggggaucuucccuuacuccaucccggcgacccugcugguguggcacaccuggcaaaaacagacccagcgcagcggcgucuuaugggacgucccaagcccgcccgagacgcaaaaggccgagcuggaggaaggcguuuaccggaucaagcagcaggggaucuuuggcaagacccaagucggggugggcgugcagaaggagggggucuuccacaccauguggcacgugacccgcggcgcagugcugacgcacaacggaaagcggcucgagccgaacugggcaaacgugaagaaggaccucauuagcuacgggggcggguggaagcuguccgcgcaguggcagaagggcgaggagguccaggugaucgccgucgagcccgggaagaaccccaagaauuuucagacuaugccgggcaucuuccagaccaccacgggcgagauuggggccauugcacuggacuucaagccgggcaccaguggcucccccauaaucaaccgcgagggcaagguagugggcuuguacgggaacggcguagugacuaagaacggcggcuacgugagcgggaucgcgcagaccaacgcggagccugacggccccacgcccgaguuagaagaggagauguucaaaaagcggaacuuaaccauuauggaccuacacccagggagcgggaagacccgcaaauaccuucccgccaucguccgugaggccaucaaaaggcggcugcgcaccuugauccuggcgccgacgcgggugguggccgcugagauggaggaagcccugaagggcuuacccaucagguaucagacgaccgccaccaaguccgagcauaccgggcgggagaucguggaccugaugugccacgccaccuucaccaugcgcuugcucagcccagugagagugccgaacuacaaccugaucguuauggacgaagcacauuucaccgacccggcuuccaucgccgcccggggauacaucagcacgcggguugggaugggagaggccgcugccauuucgaugacagcuacgccgcccggcaccgccgacgccuucccccaaagcaacgcuccgauccaggacgaggagcgcgacauccccgagcgguccuggaacagcgggaacgaguggaucacggacuucgccggaaagacagucugguucguccccuccaucaaggcugggaacgacaucgcgaacugccugcgcaagaacgggaagaaggugauccaauugucccgcaagaccuuugacaccgaauaccagaaaacgaagcugaacgacugggacuucguggucaccaccgacaucuccgagaugggggcuaacuucaaagcggaccgggugaucgauccccgccggugccugaaaccggucauccugaccgacggccccgaacguguaauacuugccggccccaugcccgugacgguagccagcgcagcccagcggcgugggcgggucggccgaaacucccagaaggagaacgaccaguacaucuuuaccgggcagccacugaacaacgacgaggaccaugcccacuggaccgaggccaagaugcuuuuagacaacaucaacacccccgagggcaucauccccgcccuguucgagccugagcgggagaagucggccgcgaucgacggggaguaccgccucaagggugagucccggaagaccuucguggagcucaugcgccggggagaccucccgguguggcucgcgcacaaggucgccagcgagggcauaaaguauacggaucgcaagugguguuucgacggcgagcggaacaaccagauccuggaggagaacauggacguggagaucuggaccaaggagggggagaagaaaaagcugcgcccccggugguuagacgcgcgcaccuacuccgacccccuggcccucaaggaauuuaaggacuuugcugccgguaggaagucgaucgcacucgacuuagucaccgagauaggucgcguucccucccaucuggcccaccgcacgcggaacgcccucgacaaucuggugaugcugcacaccagcgagcacgggggacgcgcuuaccggcaugcagucgaagaacucccggagaccauggagacccugcugcuccuuggucugaugauccuccugacuggcggggccaugcuuuuccucaucaguggcaagggaaucgggaaaaccuccaucggccuuaucugcgugguggccuccagugggauguuauggauggccgacguuccgcuccaguggauugcgagcgccaucgugcuggaguucuucaugaugguacugcucauccccgaaccggagaagcagagaacaccccaggacaaccagcuggccuauguagugaucggcauccugacccuggccgccaucgucgcggcuaacgagaugggucugcuggagacgaccaagcgggaccucggcauguccaaggagcccggcgucgugagccccaccuccuacuuagauguggaccugcacccggccagcgccuggacccucuaugcggucgcuaccaccgucaucacgcccaugcugcgccacacgauagagaacuccacggccaacguuagccuggccgcgaucgcgaaccaggcaguaguacucauggggcuagauaaggguuggcccaucuccaagauggaccugggcgugccccuccuggcccugggcugcuacagucaggucaauccacucaccuugaccgcagccgugcugcuccugguaacucacuacgcgaucauuggccccgggcuucaagcaaaggccacacgggaagcgcaaaagcgcaccgcagcggguaucaugaagaaccccaccgucgacggcaucaugacuaucgaccucgacccagugauauacgacuccaaguuugagaaacaguugggacaggugaugcugcucguccuaugcgccgugcaguuacuccugaugcggacaagcugggccuucugcgaggcccugacguuagcgaccggaccgaucaccacgcucugggagggcucccccggcaaauucuggaacacuaccaucgcggucagcauggccaacaucuuccgcggauccuaucuggcgggcgccgggcuggcguuuucgauuaugaagagugucgguacugggaagcgaggcacugggagccagggggagacccugggcgagaaauggaagaagaaacugaaccaguugagccgcaaagaguucgaccuguacaagaaauccgggauaaccgaaguggacaggacagaggccaaggagggccugaagcgcggggaaaucacacaccacgccgugagccggggcuccgcaaagcuccaaugguucguagagcgcaacauggucauacccgaggggcgggugauagaccugggguguggccgaggaggcuggagcuauuacugcgccggacugaagaaggugacggaggugcgaggauacaccaagggagguccaggucacgaggaaccgguucccauguccaccuacggguggaauaucgucaagcucauguccggaaaggauguguucuaccuacccccagagaagugcgacacccugcugugcgauauaggugagucuagcccgucgcccacgguggaggagagccgcacaauucggguccucaaaaugguggaaccguggcugaagaacaaccaguucuguaucaaggugcuaaaccccuacaugccgaccgugaucgagcaccucgagcggcuacagcgcaagcacggcggcaugcugguucggaaccccuuaucgcgaaacucaacccacgagauguacuggaucuccaacgggacgggcaacaucgugaguuccgucaacauggugagccggcugcuucugaaccgcuucacgaugacccaccggcgaccgacgaucgagaaggacguggaccucggggcgggcacgcggcacgucaacgcagagcccgaaacaccuaacauggaugucaucggcgagcgcauccggcgcauuaaggaggagcacaguuccaccuggcacuacgacgacgagaaccccuacaaaaccugggcuuaucauggguccuaugaggucaaagcgacaggcucagccagcagcaugaucaacgguguggugaaacuucucaccaagcccugggaugucgugccgauggucacgcagauggcaaugacagacacgacucccuucggccaacaacggguuuucaaggagaagguugacacccgcacuccccggcccaugccggggacccgcaaggugauggagauuaccgccgaauggcuguggcggacgcugggccgcaacaagcggcccaggcucugcacucgggaggaguucauaaagaaggucagaaccaacgcggccaugggcgcgguuuucaccgaggagaaccagugggacagcgcccgcgccgcagucgaagaugaggaguucuggaagcuggucgaccgggagcgcgaacuucacaagcucggaaagugcggaaguugcgucuacaacaugauggggaagcgcgagaagaaguugggcgaguuugggaaggccaaaggcagcagggcgauaugguacauguggcucggcgcacgguaucucgaguucgaggcucugggguuccugaacgaggaccacugguucucccgcgagaacagccacuccggcguggaaggggagggacuccacaaacugggcuacauccugagagacaucagcaagaucccggguggcgccauguacgccgaugacacggcggggugggacacccgcauaacggaggacgaccuccacaacgaggagaagauaacccagcagauggacccugagcaccggcagcuggccaacgcgaucuucaaguuaaccuaccagaacaaggucguaaagguacagcgcccgacccccaaggguacuguuauggauaucaucucccggaaggaucagcgcgggagcggccagguggggacuuacgggcucaauaccuucaccaauauggaggcccagcuaauccggcagauggagggcgagggggugcugagcaaagccgaccuggaaaacccccacuuacuggagaagaaggucacccaaugguuagagacgaagggaguugagcgacugaagaggauggcuaucagcggugacgacugcguuguuaagccuaucgaugaccgcuucgccaacgcccugcucgcgcugaaugacaugggaaagguccguaaagacaucccucaguggcagcccuccaagggcuggcacgacuggcagcaggucccauucuguagccaccacuuccacgaacugaucaugaaggacgggcgcaagcucgucgugcccugccgaccgcaggacgagcugaucggacgcgcccguaucagucagggugcggguuggagccugcgcgagacagccugccucgggaaggccuacgcacaaaugugggcgcugauguauuuccaccggagggaccugcgacucgccuccaacgccaucugcagcgccgugcccguacacugggugcccaccuccagaaccacauggagcauacaugcccaccaccaguggaugaccacagaggauaugcugaccguguggaaccgcgucuggauugaggacaaccccuggauggaggacaagacgccggugacaacgugggaagauguacccuaccuggguaaacgggaggaccaguggugcggcagccugaucggguuaacgucccgcgcgacgugggcucagaacauccugaccgccauccagcagguccggagccucauugggaacgaggaguuccuagacuacaugcccaguaugaaacgcuuccggaaggaggaggagagcgagggggcuaucugguag

SEQ ID NO: 26171 - RNA, 9873 nt, Artificial Sequence
  derived and/or modified CDS sequence (opt11) from DENV-3__JQ920478__SS-prME
accagccugugccucaugaugaugcugccagcgacuuuggccuuccaccucaccagccgggacggggagccgagaaugauuguggggaagaaugaacggggcaagagucugcuguucaagacagccagugggauuaacaugugcacacucaucgccauggacuugggcgagaugugcgacgacaccgugaccuacaaaugucccuugauaaccgagguggagcccgaagacaucgacugcuggugcaaccuuaccagcaccugggugaccuacgggaccuguaaccaagccggcgagcaccggcgcgacaagcggaguguggcgcuggcgccccacgugggcaugggguuagacacccgcacccagacguggaugagcgcggaaggcgccuggcgccagguugagaagguggagaccugggcguucagacaccccggguucaccauccucgcccuguuccucgcacacuacaucgggacuucucucacgcagaagguggugaucuuuauacugcugaugcuaguuacgccuucgaugaccaugcggugcguuggggugggcaaccgagacuucgucgaaggccuguccggggcaaccugggucgacgucguucuugagcacggcgggugcgugacuaccauggccaagaauaagccuacacuugacaucgaacuucagaaaaccgaggccacgcaacuggccacacuccggaagcuguguaucgagggcaaaaucaccaacguuaccacggacagccgcugccccacgcagggcgaggcaauccugcccgaggagcaggaccagaauuacgucugcaagcacaccuauguugaccgcggguggggcaacggguguggguuguucgggaagggcucccuggugaccugcgccaaguuucaaugcuuagaaagcaucgagggcaaggcuguccagcacgaaaaccucaaauacacggucauuaucacggugcacaccggugaccagcaccaggugggcaacgagacccagggggugacggccgaaauuacgccccaggcguccacggucgaagcgauccugccggaguauggcacccuggggcucgaaugcagcccccggaccggccuggacuucaacgagaugauccuguuaacaaugaaaaacaaggccuggauggugcaccggcagugguucuucgaccucccccugcccuggacuuccggggccacuaccgaaacgccaacuuggaacaagaaggagcuucuggugaccuucaaaaaugcccacgccaaaaagcaggagguaguugugcuggggucccaggagggcgcgaugcacacggcccucaccggggcaaccgagauccaaaccagcagaggcaccagcaucuucgccggccaucugaagugucgucugaaaauggacaaguuagaauugaagggaauguccuacgcaaugugccucaacgcguucguccucaagaaggagguaagcgagacgcaacacggaaccaucuugaucaagguggaguacaagggggaagacgcccccugcaagauucccuucagcaccgaagacggccaggggaaagcccacaacggucgccugaucaccgccaacccaaucgucacgaagaaggaggaacccgugaacaucgaggccgagcccccguucggcgagucaaacaucgugauagggaucggggauaaggcgcugaaaaucaacugguacaagaagggcagcuccaucggcaagauguucgaggccacggcccgcggggcccgcagaauggcaauccuaggcgauacugccugggacuucggcagcgucgggggcguucugaacucccuggggaagauggugcaucagaucuucggcucggccuacacggcccucuucuccggggucucguggaucaugaaaauuggcaucggagugcugcugacguggauugggcucaacuccaaaaacacgagcauguccuucucgugcaucgugaucggcaucaucacccuguaccugggggccguagugcaagcugauaugggcugcgugauaaacuggaaggggaaagagcucaagugcgguuccggcauauucgucaccaacgagguacacacauggaccgaacaguacaaauuccaagccgauucgcccaagcgccuggccaccgccaucgccggggcgugggagaacggugugugugggauccgcuccacaacccggauggagaaccugcucuggaaacagaucgccaacgagcugaacuacauacugugggagaauaacaucaaacuuaccauaguggugggcgacguaaucggggugcuagagcagggcaaacgcacccugacgccucagcccauggaacucaaguacagcuggaagacuuggggcaaggccaagaucgugaccgcugagacucagaacuccucuuucaucaucgaugggccgaacaccccagagugcccuuccgcguugcgugccuggaacgugugggagguagaagacuacggauuuggcguguucacgaccaacaucuggcuaaagcuccgggagaaauacacccagcucugcgaccaccggcugaugagcgccgcugugaaggacgagcgagcaguccaugcugacaugggcuacuggauagagagccagaagaauggguccuggaaauuagagaaggccagccuaauugaggugaagaccugcaccuggcccaagucccauacccugugguccaacggggugcucgaguccgauaugauaauaccgaagucacuggcgggcccaaucucgcaacacaacuaccgacccggauaccacacccagaccgcaggacccuggcaccuggggaaauuggagcuggacuucaacuacugcgagggaaccacagucgugaucaccgaaaacugcggcacgagggggccaagccugaggaccacgacagugucgggcaagcucauucaugaguggugcugccgauccugcacccugcccccgcuucgguacaugggggaggacgguugcugguaugguauggaaauucgcccgaucaaugagaaagaggagaauauggucaagucccucgugagugcgggauccggcaagaccgacaacuucacgauggggguuuuaugccuugcgauccucuuugaagagguaaugcgggggaaguuugggaagaagcacaugaucgccggcgcccuguucaccuucguacugcuccucuccgggcagaucaccuggcgcgacauggcccacaccuugaucaugaucggcuccaacgccagcgaccggaugggcaugggcguaacguaucucgcgcugaucgccacguucaagauccagcccuuccuggcccucggcuucuucuugcgaaaacugacgucccgggagaaucuccuacuaggagucgggcuugcuauggcuacuacgcugcagcugccagaggauaucgagcagauggcuaacggcauagcccucggccucauggcauugaagcucaucacccaauuugagaccuaccaguuguggacggcccugaucagccuaaugugcuccaauacaauauucacccugaccguggcguggcguaccgccacgcugauccucgcugugauuucccugcuaccagucugucagucauccagcaugcguaagacagauuggcucccgaugacuguagccgccaugggcguaccacccuuaccccuguucaucuucucccucaaggacacccuuaagcgccgcucauggccacugaacgagggggucauggcugugggccucgucucaauccuggccagcagcuuuuugagaaacgauguaccuauggccgggccccucguggccggagggcugcucaucgcuugcuacgucaucacgggaaccagcgccgaccuuaccguggaaaaggccgccgacgugaccugggaggaggaggccgagcagacaggugucucacacaaccucaugaucaccguggacgacgacgggaccaugcgcaucaaagacgacgagaccgagaauauccucaccgugcugcugaagacggcccuucucauugucagcgguaucuuccccuacuccauaccagcgacucugcugguguggcacaccuggcagaagcaaacccagcggagcgggguguuaugggacguccccagcccgcccgaaacgcagaaggccgagcuugaagagggggucuaccguaucaaacagcaggguaucuucgguaagacccaggugggcgucgggguccagaaggagggcguguuccacacgauguggcacgucacccgcggggccgugcugacgcacaacgggaagcgccucgagccgaacugggcuaacgugaagaaggaccugauuagcuauggcgggggcuggaagcuguccgcucaguggcaaaagggagaagaggugcagguaauagccguggagcccggcaaaaaccccaagaacuuccagacgaugcccgggauuuuccagacuaccacgggcgagaucggcgccaucgcccuggacuucaagccggggaccagcgggagccccaucauuaaccgggaggggaaagucgugggucucuauggcaacgggguagugaccaagaacggcggauacgugagcggcauagcgcagaccaacgcagagccggacgggccuacgcccgagcuugaagaagagauguucaagaaacgaaaccugaccauuauggaccuccacccagguuccggcaagacccguaaguaucuccccgcuaucguucgcgaggcuaucaaacggcgccugcggacccuaauccuggccccgacgcgugucguggcagcggagauggaggaagcccugaaggggcuccccauccgguaccaaaccacagccaccaaguccgagcacacgggccgagagauaguggaccucaugugccacgcgacuuucacuaugcgguuacucucucccguucgcguccccaacuauaaccugaucgugauggacgaagcccacuuuacagauccggcgucuaucgcagcacggggguacaucaguacccgcgucggaaugggugaggccgcggcgaucuuuaugaccgccacucccccaggcaccgccgacgccuucccccaguccaacgcuccgauccaagacgaggagagagacauccccgagcgaagcuggaauagcgggaacgaguggaucacggacuucgccggaaagaccgugugguucgugccaagcaucaaggccggcaaugacaucgcuaacugccugcguaagaacggaaagaagguuauucagcuuucccggaaaaccuucgacaccgaauaccagaagaccaagcugaacgauugggauuucguggucaccacggacauaagcgagaugggcgccaauuucaaagcagaucgcguuaucgacccccggaggugccugaagcccgugauccucacugacgggcccgaacgggugauccuggcgggccccaugcccgucacgguggccuccgccgcgcagcgucguggccgagucgggagaaacagucagaaagagaacgaccaguauaucuucacgggccaacccuugaacaaugacgaggaucacgcucauuggaccgaagccaagauguuacuggauaacaucaauaccccagaggggaucauccccgcccuauucgagcccgagcgggagaaguccgccgcuaucgacggcgaguaccgucucaaaggggagagccgaaaaaccuucguugagcugaugcggagaggcgaccugccggugugguuagcccacaaaguggccagcgaagguaucaaguauacggaccggaaguggugcuucgauggggagcgcaacaaucagauccuggaggaaaacauggacguagagaucuggacgaaggagggagagaagaagaaacuacggccccgcuggcuggacgcgcggacauacucagauccgcuugcccucaaggaauuuaaggacuuugcugccggucguaaguccauugcacuugaccuggugaccgagaucggaaggguccccagccaccuggcccaucggacuaggaaugcccucgacaaccuggugaugcuccacaccucugagcacggcgggcgggcguaccgccacgccguggaggaguuaccugagacgauggagacccuucuccuccugggccugaugauccuccuuaccggcggggccaugcuguuccucaucagcgggaaggggaucgggaagaccagcaucgguuugaucugcgucguggccagcucgggcaugcuguggauggcugacguaccgcuacaguggaucgcgucggcuauaguccuggaguucuucaugauggugcugcuaauccccgagcccgagaagcagcggacgccgcaggacaaccaguuggccuacgugguuauugggauacuaacccucgcagccaucguggcggccaacgaaaugggcuuacucgagacgaccaagcgcgacuugggaauguccaaggagcccgguguggucucccccacuucguaccuggauguagaucugcacccggccuccgccuggacccuauacgcuguggcaacgacggugaucacccccaugcuacggcauaccaucgagaacagcacagccaaugugagucuggccgcuaucgcaaaccaggccgucguccucaugggccuugacaagggauggcccaucucuaaaauggaucugggcgugccucuccuggcgcuggggugcuacagccaggugaacccgcucacccugaccgcugccguccugcuucugguuacccacuacgcgaucaucggcccggggcugcaagccaaagcgacgcgcgaggcacagaagaggacugccgcaggcaucaugaagaacccaaccguggacgguaucaugaccaucgacuuggaccccgucaucuacgacucgaaguucgagaagcagcugggccagguuaugcuacucgugcugugcgccguccagcugcuccuaaugcgcacguccugggcauucugcgaggcccugacccuugcgaccggcccgauuaccacgcugugggagggguccccaggcaaguucuggaacaccaccaucgcgguguccauggcuaacaucuuccggggcagcuaccucgccggggcgggccucgcguucuccaucaugaaauccguggggaccggcaagcgcgggacgggaucccagggcgagaccuugggggagaaguggaagaagaagcugaaccaauugagucguaaagaguucgaccuguacaagaaauccggcaucaccgagguugaccgaacugaagccaaggaaggucugaaacggggcgagauuacacaccacgccgugucccguggguccgccaagcuccaaugguucguggagcggaacauggucaucccugagggccgcgucaucgaucugggcugcgggagagguggcuggaguuacuacugcgccggccugaagaaagugacggagguccgcggguacaccaaaggcggcccggggcacgaggagccugugcccaugagcaccuacggguggaacauugugaagcucaugucugggaaggacguguucuaccucccgccugagaagugcgacacgcugcugugugacauaggagagagcuccccgucgcccacgguggaggagaguaggaccauacgcgugcucaagaugguggaacccuggcugaagaacaaccaguuuuguaucaaaguguugaaccccuauaugcccaccgugaucgagcaucucgagcgccugcagcggaagcauggagggaugcuuguccgcaacccccucagccggaacucuacccacgagauguacuggaucagcaacggcacggggaacaucgugucaucugugaacauggucucccgauugcuguuaaauagguucaccaugacacaccgucgccccacaaucgagaaggacguugaccucggcgcggggacgcgccacgugaaugcggagccagagacgccaaacauggacgucauaggcgagagaauuaggcggaucaaggaagaacauagcuccaccuggcacuacgacgacgaaaacccguauaagaccugggccuaccacggcagcuacgaggugaaggccacugggagcgccagcagcaugaucaauggcgucguaaaacugcugaccaagcccugggaccugguccccauggugacacagauggcgaugaccgauaccacgcccuuugggcagcagcgaguguuuaaggagaagguggacacccggacgccgcgacccaugccggguacucggaaggucauggagaucacggccgagugguuguggcgcacccucggacggaacaagcgcccucggcuguguaccagggaagaguucaucaagaaggugcgcacgaacgccgccaugggcgcgguguucaccgaagagaaccagugggacuccgcacgugcugccgucgaagacgaagaguucuggaagcugguagacagggagcgggagcuccacaagcuggggaaaugcgggucgugcguuuacaacaugauggguaagagggagaaaaagcugggggaauuuggcaaagccaaggggucgagagcgaucugguacauguggcucggggcccgguaccuggaguucgaggcccugggcuuucucaacgaggaccacugguucagccgagagaacucccacucuggggucgaaggcgagggacuacauaagcugggcuauauccucagggauaucuccaagaucccgggcggcgccauguaugccgacgacaccgcagguugggauacccggaucacggaagacgacuugcacaaugaggagaagaucacacagcagauggaccccgagcaccgccaacuggccaacgccaucuucaagcucaccuaccagaacaaaguugucaagguccaacggccgacgcccaaagggacggugauggacaucaucucucgcaaggaccagcggggcuccggacagguaggcaccuacggucucaauacuuucaccaacauggaggcccaacugauccgccaaauggagggggaggguguccucucgaaggccgaccuugagaacccccaccuccuggagaagaaggucacacaguggcuggagacgaaggggguagagcggcugaagcggauggcgaucuccggcgacgacuguguagugaagcccaucgacgaccgguucgccaacgcucuccuugcccuaaaugacauggguaagguccguaaggacauuccgcaguggcagcccagcaagggauggcaugacuggcagcagguuccuuucuguucccaccauuuccacgagcucauaaugaaggacggccggaagcuggugguacccugccguccacaggacgagcugaucgggagagcgcggauuagccagggagcgggguggucccuccgggagacggccuguuuggguaaggccuacgcccagaugugggcauuaauguacuuccaccggagagaccuccgccuggcuagcaaugccaucugcucggccguuccgguucacugggugcccaccucgcgcaccacguggagcauccacgcccaccaccaguggaugacgaccgaagacaugcugacugucuggaaucguguuuggaucgaggacaaccccuggauggaggacaagacgcccgugaccaccugggaggacgucccguaccucgggaagcgcgaagaucaguggugcggcagccugaucgggcugacgucgcgugcuacgugggcccagaacauucucacugccauccagcagguccgaucccugauugguaacgaggaguuucuggacuauaugccuagcaugaagagguuccggaaagaggaggaguccgagggcgcgaucugguaa

SEQ ID NO: 26172 - RNA, 9873 nt, Artificial Sequence
  derived and/or modified CDS sequence (opt11) from DENV-3__JQ920480__SS-prME
accagccugugccucaugaugauguuaccugccacccuggccuuucaccucaccagccgcgacggggagccacggaugauagugggcaagaacgagcgcgggaaaucacugcuauucaagaccgcgucagggaucaacaugugcacccucaucgccauggaucugggggaaaugugcgaugauaccgugaccuacaagugcccuuugauaaccgagguggagcccgaggacaucgacuguuggugcaaccucaccagcacaugggugaccuacgggaccugcaaccaggccggcgagcaccggcgggacaagcgguccguggcccuggcgccgcacgugggcaugggccuggacacucgcacccagacuuggaugagcgcggagggcgcauggcggcaggucgagaaggucgagaccugggccuuccgccaccccggguucaccauccucgccuuguuccuugcgcacuacaucggcaccuccuugacgcagaaagucgugauuuucauccugcucaugcuggucacccccagcaugaccaugcggugcgugggggugggaaaccgugacuucguagagggcuuguccggggccaccuggguggacguuguccuugagcacggcgggugugugacaaccauggccaaaaacaagcccacccuagacaucgagcugcaaaagaccgaggccacucaacuggccacacuccgaaagcuuuguauugagggcaagaucacuaacguaaccacggacagccgcugucccacccagggagaggcaauccuucccgaggagcaggaccagaacuacgucuguaaacacaccuacguggaccggggguggggcaacgggugcggccucuucgggaagggcucccuggugaccugugccaaguuucagugccuggagagcaucgagggcaaggccguccagcacgagaaccucaaguacacggugaucauuacagugcacaccggggaccagcaccaagugggcaacgagacccagggagucacggccgagaucacgccccaggccucaaccguagaggcgauccugccagacuacggcacucuggggcucgagugcucacccaggaccggacuugacuucaacgaaaugauccugcucacgaugaagaacaaagccuggauggugcaccggcagugguuccuggaccugccguugcccuggacuuccggcgccacuaccgagacgccgaccuggaacaagaaggagcuccuggugacauucaagaacgcccacgccaagaagcaggaggucgucguucucggcagccaggagggcgcaaugcacacggcccugacuggugccacugaaauccagaccuccggcgggaccagcauauucgccggccaccugaagugccgcuugaagauggacaagcuggaacugaagggaauguccuacgcaaugugccucaaugcguuuguccugaagaaggaggugucagagacacagcacgggaccaucuuaaucaagguggaguauaagggcgaggacgcuccuugcaagaucccuuucagcacggaagacgggcagggcaaggcccacaacggccggcugaucaccgcgaaucccaucguaacgaagaaggaggagcccgugaauaucgaggcggagccgccguucggcgaguccaacaucgucaucggcauuggggacaaggcccugaagaucaacugguacaagaaggggagcuccaucgggaagauguuugaggcuaccgcccgcggcgcccgucgcauggcuauucugggggacaccgcuugggauuucgggagcgucggcgggguguuaaacucccucggcaaaauggugcaucagaucuucgggagcgccuauacagccuuauuuuccggcgucagcuggaucaugaaaauaggcaucggggugcuacucacguggaucggccugaacaguaagaacaccagcauguccuucagcugcauuguuauuggaaucaucacccuguaccucggcgccgucgugcaggcggacauggggugcgugaucaacuggaaggguaaagagcugaaaugcgguuccggaaucuucgucaccaacgagguacacaccuggaccgagcaguacaaguuccaggccgacagucccaagcggcuggccacggccaucgccggugcgugggagaacggggucugcggcauucgcagcaccacgcggauggagaaccuccuguggaaacaaaucgccaacgagcugaacuacauucuuugggagaacaacaucaagcugaccaucgucgugggggacgugaucggcguccuggagcagggcaagcggacacucacaccucagccgauggagcugaaauacagcuggaagacgugggggaaggccaagaucgugaccgccgagacccagaacagcagcuucaucaucgacggcccgaacacccccgagugcccuuccgcgcugcgcgccuggaacgugugggagguugaggacuacggguucggcguguucaccaccaacaucuggcucaaacugcgggaaaaauacacacagcugugcgaccaccgccugaugagcgccgccgugaaagaugaacgggccguccacgcggacaugggcuacuggaucgagagccagaagaacgaguccuggaagcuggaaaaggccagccugaucgagguaaagacaugcaccuggcccaagucccacacguuguggagcaacgggguucuggagucggacaugaucauucccaagagccuggccggccccaucucccaacauaacuaccgccccggguaccacacccagacggcuggaccguggcaccuggggaaguuggagcuagacuucaacuacugcgagggcaccacggucgucaucaccgagaacuguggcacccgggggccaagccuucgcaccacgaccguguccggcaagcugauccacgaguggugcugccggagcugcacccugccgccccugcguuacaugggugaggacggaugcugguacggcauggagauccggccuaucaacgagaaggaagagaacauggucaagucccuggugagcgccggcaguggcaagaccgacaacuucacgauggggguccugugccucgcgauccuguucgaggaggucaugagaggcaaguucggcaaaaagcacaugaucgccggcgcccuguucauguucguccuccugcugagcgggcagaucacauggcgggacauggugcacacccuaaucaugauagguucaaacgcuagcgacaggaugggaaugggagucaccuaccuggcccugaucgcaacguucaagauacagcccuuccucgcccuaggcuucuuccugaggaagcucaccucccgagagaaccugcuguugggcgugggcuuagccauggccaccacacugcagcuccccgaggauaucgagcagauggcgaacggcaucgcccuggggcugauggcgcucaagcugaucacgcaguucgaaacauaucagcuauggacugcccucaucucacugaugugcagcaacaccaucuucacgcugaccguggccuggcggaccgcgacgcuuauccuggccgucaucucccugcuccccgugugucagagcaguagcaugcgcaagacggacuggcugccuaugaccguggccgccaugggcgugccgccccucccccucuuuaucuucucacugaaggauacccugaagcggcgcuccuggccgcucaacgagggggugauggccguuggccuaguguccaucuuggcgagcuccuucuugcgcaacgacguacccauggccgggccgcuggucgccggcggcuuacuaaucgccugcuaugugaucaccggcacaagcgccgaccugacgguggaaaaggccgccgacgucaccugggaagaggaagccgaacagaccggcgugucccacaaccugaugaucacgguggacgacgaugggaccaugaggaucaaggacgacgagaccgaaaacauccuuaccguguugcugaagacagccuugcugaucgugaguggcaucuuccccuacucaaucccggccacguugcucguguggcacaccuggcagaagcagacacagcgcagcgggguacugugggacgugcccagcccucccgagacgcagaaggcggagcuggaggagggcguguaucggaucaagcagcagggcaucuucgggaagacccagguggggguggggguucagaaagagggcgucuuccauaccauguggcaugugaccaggggagcggugcuaacucacaacggcaagcggcuggagccgaacugggccaacgucaagaaggaucugaucagcuacggcggcggguggaagcuuuccgcccaguggcagaagggggaggagguccaggucaucgcagucgaaccagggaagaaccccaaaaacuuucagacuaugcccggcaucuuucagaccaccaccggcgagaucggagccaucgcccuagauuucaaaccggggacgucaggcucccccaucaucaaccgcgaggggaaaguggugggccuguacggcaacgggguugucacaaagaacggcggguacgugagcgggaucgcccagaccaacgccgagcccgacggcccgacccccgagcuggaggaggagauguucaagaagagaaaccugacgaucauggaccuccaccccggcagcggaaagacucguaaguaucugccugcgaucguccgggaagcaaucaagcgucggcuccgcacccugauccuggcuccgacccgugugguggccgccgagauggaggaagcguugaaggggcugcccauccgcuaccagacgaccgccaccaagagugaacacaccggacgggagaucgucgaccuaaugugccacgccacguuuaccaugcgccuacugucaccagugcgaguucccaacuacaaccugaucgucauggacgaggcccacuuuacugauccugcuuccauugcggcccgagguuacaucagcacucgcguggggaugggggaagccgccgcuaucuucaugacggccacgccgcccggcacggcugacgccuucccucagaguaacgccccgauccaagacgaggaacgcgacaucccggagaggaguuggaacagcgguaacgaguggaucaccgacuucgcugggaagacggugugguucguccccuccaucaaggccggcaacgacaucgccaacugccuccgcaagaacggcaaaaaggucauccagcugucgaggaagacuuucgacaccgaauaccagaagaccaagcugaacgacugggacuucguggucacgaccgacaucagcgagaugggcgcgaacuucaaggccgaccgggugaucgacccgcgacgcugccucaaaccggugauccuuaccgacgggcccgaacgcgucauucuugcgggcccaaugcccgugacggucgccuccgccgcccagagaaggggccggguugggcgcaacagccagaaggagaacgaccaauacaucuucacgggccagccgcucaacaacgacgaggaccacgcccacuggaccgaggcaaaaaugcuguuggacaacaucaacacgccugagggaaucauccccgcgcucuucgagcccgaaagggaaaaguccgccgccaucgacggcgaguaccgccugaagggggagagccggaaaacuuucguggagcugaugcgccgcggcgaccucccgguguggcuggcgcacaaggucgccagugaggguaucaaguacacggaccgcaaaugguguuucgacggggagcggaacaaccagauacuggaagagaacauggacguugagauuuggacgaaggaaggcgagaagaagaaacuccgcccccgguggcuagacgccagaacauacuccgacccucuggcccucaaggaguucaaggacuucgccgcggggcggaagucgaucgcccuggaccuggucaccgagauaggcagggugccaagccaucucgcccaucgaacccgcaacgcccuggacaaucuagugaugcuccacacguccgaacacggagggagggccuacaggcacgcggucgaggagcugccggagaccauggagacccugcucuugcugggccucaugaucuuacugaccgggggcgcuaugcuguuccugaucagcgggaaaggcaucggaaagacgagcauaggguugaucugcgugguggccuccagcggaaugcucuggauggccgacgucccccugcaguggauagccuccgcgauuguucuugaguucuucaugaugguguugcugauccccgagccggagaagcagcguacgccgcaggacaaccagcuggccuaugucgugaucgggauucucacucuggccgccaucguugccgcgaacgagaugggccugcucgagaccacuaagcgggaucuggggaugagcaaggaacccggagucguuucccccacaagcuauuuagacguggaccuccauccggccuccgccuggacccuguacgccgucgcgaccacugugaucacacccaugcugcgccacaccaucgagaacagcaccgccaacgugucccucgcugcaaucgccaaccaagcgguggugcugaugggcuuagacaagggguggcccaucuccaagauggaccucggcgugccccugcuggcucucgggugcuauucccaggucaacccgcugacccugaccgccgccgugcuccugcuggugacccacuacgcgauaaucggucccgggcuccaagcgaaagccacccgggaggcccagaagcgcacagccgccggcaucaugaaaaaccccaccgucgacggcaucaugacaaucgaccuggaucccgugauuuaugacagcaaguucgagaagcagcugggccaggugaugcuccuuguucugugcgcgguacaguuauuauugaugcggaccuccugggccuucugcgaggccuuaacucuagcaaccggcccgaucaccacccugugggaggggucgccagggaaguucuggaacacaaccaucgcaguguccauggccaacaucuuccgcggcagcuaccuugccggggccgguuuagccuucaguaucaugaaguccgucggaacugggaagcgggggacaggcucucagggugagacucugggagagaaguggaagaagaagcuaaaccagcugucucgcaaagaguucgaccuguauaagaaguccggcaucacggaaguggacagaaccgaggcaaaagagggucugaagcgcggcgagauuacucaucacgcugugucccgggggagcgccaagcugcaaugguucguggagcguaacauggugauccccgagggccgggucaucgacuugggcugcggucgcggcgggugguccuauuacugcgccggccucaagaaggucaccgaggugcggggguacacaaagggcgggcccgggcaugaggagcccgugcccaugagcaccuacggcuggaacaucgucaagcugauguccgggaaggacgucuucuaccugccgcccgaaaagugcgacacccugcucugcgauaucggcgaaagcuccccgucgcccaccgucgaggagucccgcacgauccggguccugaagauggucgagcccuggcugaagaacaaccaauucugcaucaaggugcucaaccccuacaugccaaccgucauugagcacuuagagcgccugcaacgcaagcacgggggcaugcucguccggaacccccugagccgaaauuccacccacgagauguacuggaucagcaacggcaccgggaacaucguaagcucagucaacauggugagucggcugcuccugaaccgauucacuaugacccaucggcgccccaccauagaaaaggauguggaccugggcgccggaacccgacacgucaacgcggagcccgagacgccgaacauggacguaaucggcgagcguauccgacggaucaaggaggagcauucguccacguggcacuacgaugacgagaauccauacaagacaugggcuuaucauggaaguuacgaggucaaggcgacaggguccgccucgagcaugaucaacggcguugugaagcuccugacgaagcccugggacgucgugccgauggugacccagauggccaugacagacaccacgcccuuuggacagcagcgggucuuuaaggagaagguggacacgagaacgccccgaccgaugccgggcacccgcaaggugauggagaucaccgcggaguggcuguggcggacccucgggcguaacaagcggccgcgcuugugcaccagggaggaguucaucaaaaagguccguaccaacgccgccaugggagccgucuucacugaggagaaccaaugggauuccgcgcgcgcagccguggaagacgaggaguucuggaagcuugucgaucgggagcgugaacuccacaagcugggcaagugugggagcugcguauacaacaugaugggcaagcgggagaagaagcugggggaguucggcaaggcaaaggggucccgcgccauaugguacauguggcucggcgcgcgguacuuagaauucgaggcccugggcuuucucaacgaggaccacugguuuagccgcgagaauagccacagcgggguggaaggcgagggguugcacaagcucggcuacauccuccgggacaucuccaagauccccgggggcgcgauguacgccgacgacacagcgggaugggacacccguaucaccgaagacgacuugcacaacgaggagaaaaucacacaacagauggaccccgagcaccgucagcuugcgaaugccauauucaagcucaccuaccagaacaagguugugaaggugcagcgcccuacccccaaggggaccgucauggacaucaucagccggaaggaccagagaggcuccggccaagugggaacguacggccugaacacauucacuaacauggaagcccaguugauccggcagauggagggggagggcguucucucuaaagccgaccuggagaacccucaucuccucgagaagaaagucacccaguggcuggagacaaaggguguggagcggcugaagagaauggccauuuccggcgacgacuguguggucaagcccaucgacgaccgcuucgcgaacgcccuccuggccuugaacgacauggggaagguaaggaaggacauuccgcaguggcaacccucuaagggcuggcaugauuggcagcagguccccuucugcagccaccacuuucacgagcucaucaugaaggacggcaggaaacuggucguccccugccggccgcaggacgaacugaucgggcgcgcccggaucagccaaggcgccgggugguccuugcgcgagacggcgugccugggcaaggccuacgcccagaugugggcccugauguacuuccauagacgggaccuccgccuggcguccaacgcuauuugcuccgcaguccccguucauugggugccuaccucgcggaccaccugguccauccaugcccaccaccaguggaugacgaccgaggauaugcugaccguguggaauagggucuggaucgaggacaaucccuggauggaagacaagaccccggugaccaccugggaggacguacccuaccucgggaagcgggaagaccaguggugcgguagccuuaucggccugaccagccgagccaccugggcacagaacauccucacggcuauccagcagguccggucacugaucgggaacgaggaguuccuggacuacaugccaagcaugaaacguuuccggaaggaggaggaaucggagggcgccaucugguga

SEQ ID NO: 26173 - RNA, 9873 nt, Artificial Sequence
  derived and/or modified CDS sequence (opt11) from DENV-3__JQ920479__SS-prME
accucccugugccugaugaugaugcuccccgccacacuggccuuucauuugaccagccgggacggggagccccggaugaucguggggaagaacgagaggggcaagagccugcuguucaagaccgccaguggaaucaacaugugcacccucaucgcuauggaucugggggagaugugcgacgauaccgugacuuacaagugcccccugaucaccgagguggagcccgaggacaucgacugcuggugcaacuuaacaagcaccugggugacguaugggacaugcaaccaggccggcgagcaccgucgcgacaagcgauccguggcccuggcgccccacguaggcauggggcuggacaccaggacgcagacguggaugagcgcggagggcgccuggcggcaggucgagaaaguggagacaugggccuuuaggcaucccggcuucaccauccucgcccuguucuuagcgcacuauaucggaaccucccugacgcagaaaguugugaucuucaucuugcuuaugcucguaacccccagcaugaccaugcggugugucgggguuggcaaccgggacuucguagaggggcuuuccggugccaccuggguggacgugguccucgagcacggcgggugcgugacgacaauggccaagaauaagcccacguuggacaucgagcugcagaagaccgaggccacgcaacuggcuacccuccggaagcugugcaucgagggcaaaaucacaaacguaaccacugacagcagaugccccacccagggcgaggcgaucuuacccgaggagcaggaccagaacuacgucugcaagcacacguauguggaccgggguuggggcaaugggugcggccuauucggcaagggcucguuagucacaugcgcgaaauuucagugccuggaaagcaucgaggguaaggcuguccagcaugagaacuuaaaguauacggucaucaucaccgugcacaccggggaccagcaccaggucggcaacgagacccagggggugacggcugagaucacgccccaggcguccacgguagaggcgauccugccggaguauggcacccugggccucgagugcagcccccguaccggacuggacuucaaugagaugauccugcucacgaugaaaaacaaggcauggauggugcaccggcagugguuucuggaccugccgcucccguggacaaguggcgccacaaccgagacccccacguggaacaagaaagaacugcugguaaccuucaaaaacgcccaugccaagaagcaggaggugguggugcucggaucacaggagggcgcgaugcacaccgcguuaacgggggccaccgaaauccaaaccuccggagggaccagcaucuucgcuggccaccugaagugccgucucaagauggacaagcuggaacugaaggguauguccuacgccaugugccucaaugcuuucguccugaagaaggaggugagcgagacccagcacggaaccauccugaucaagguggaguacaagggcgaggacgcccccugcaagaucccguucucaaccgaggacgggcaaggcaaggcccacaacggucgguugaucaccgccaaccccauugucacgaaaaaggaagaaccugugaacaucgaggcggagcccccguuuggggaguccaacaucgugaucggcauuggagacaaggcacucaagaucaauugguauaagaagggcaguuccaucgggaaaauguucgaggcaaccgccaggggcgcucggcgcauggcgauccugggcgacaccgccugggacuucggguccguuggcgguguauugaacucccucggaaagauggugcaucagauuuucgggucggccuacaccgcccuguuuuccggcgucagcuggauuaugaagaucggaaucgggguguugcugacguggaucggccuaaauucuaagaacaccucaauguccuucagcuguaucgugaucgggaucaucacccuauaccucggcgccguagugcaagcggacauggggugcguaaucaacuggaagggcaaagaacugaagugcgguuccgggaucuuugucaccaacgagguucacacguggaccgagcaguauaaauuccaggcugacuccccaaagcggcuggcaaccgcaaucgcuggcgcgugggaaaacggcguguguggcauccgcuccaccacccggauggagaaccuccuguggaagcaaauugcuaacgaguugaacuacauuuuaugggagaauaacaucaagcugaccauagucgugggggacgugaucggcguccuggagcagggcaagagaacucucacuccccagcccauggaguugaaauacaguuggaaaacgugggggaaggccaaaaucgugaccgccgagacccaaaacuccagcuucaucaucgauggcccgaauacccccgagugccccucugcgcugcgcgcauggaacgugugggagguugaagauuacggguucggcguuuuuacgaccaacaucuggcuuaaguugcgagaaaaauacacccagcugugcgaccaccgccucaugagcgccgcugugaaggacgagcgggccguccaugcggacaugggcuacuggaucgaaucucagaagaacgaguccuggaagcuggagaaggcuucacugaucgaggugaagaccuguaccuggccgaagucccacacucucuggagcaacgggguacuggaguccgacaugauaaucccuaagagccuggccggccccaucucccagcauaauuaccgucccggcuaccacacccagaccgccgguccguggcaucucgggaagcucgagcuggacuuuaacuacugcgaggguaccacugucgugauuacugagaauugcggcauccgggggcccagccuccgcaccaccacgguuuccggcaaacugauccacgaauggugcugccggaguuguacccuaccuccccugcgcuacaugggggaggacggcugcugguaugggauggagauccggccgaucaaugagaaggaggagaauaugguuaagucccuagucagcgccgggagcggcaagaccgauaacuucaccaugggggugcuuugccucgcgauccuguucgaggaggugaugcgcggcaaguucggaaagaagcacaugauagccggggcucuguuuauguuugugcuccugcugagcggacagaucacguggcgggacauggugcacacccucaucaugauuggcuccaacgccagcgaccggaugggcauggggguaacauaccuugcucuaaucgcgaccuucaaaauccagcccuuccucgcccugggguucuuccuacggaaacucacgucccgugagaaccuacugcugggggugggccuggccauggccaccacccuucaacuccccgaagacauugagcagauggcaaacggcauagccuuagggcugauggcccucaaguugaucacgcaguucgagacguaccaguuguggacagcccucaucucgcugaugugcagcaauacgaucuucacccugacgguugccuggcggaccgcgacccucauucucgccgugaucucccuguuacccgucugccagaguucgagcaugcguaagaccgacuggcuaccgaugacuguggccgccaugggcgugccgccacucccccucuuuauauucucacugaaggacacccugaaacggagaagcuggccgcugaacgagggggucauggccguaggucugguguccauccuggcgagcuccuucuugcgcaaugacgugcccauggccgggccccuaguugccggcggccuacugaucgcaugcuacgugaucaccgggaccagcgccgaccuaacgguggaaaaagcggccgauguaaccugggaggaggaagccgaacagaccggcgugucccacaaccugaugauaaccguggacgaugaugggacgaugagaaucaaggacgacgagaccgagaacauucucacagugcugcugaagacagcccuccugaucgugagcggaaucuuccccuacucaauccccgccacccuguuaguguggcauacguggcagaagcaaacacagcgcagcggagucuuaugggacgugcccaguccgcccgagacucaaaaggcugagcuggaggaaggcguguaucggauuaagcaacaggguaucuucgggaagacccaggucggcguggggguucagaaggaaggcguauuucacacgauguggcaugugacccgcggggccgugcuaacccacaaugggaagagguuagaaccgaacugggccaacgucaagaaggaccugauuagcuacggcgggggcuggaagcuauccgcucaguggcagaagggggaggagguacagguuaucgcuguugagccaggcaagaaccccaagaacuuccaaaccaugcccgggaucuuccaaacgacaaccggcgaaauuggcgccauagcucucgauuucaagccgggcaccagcggcucgcccaucaucaaccgcgaggggaagguggugggccuguacggcaacggggucgugacgaaaaacggcgguuacguguccggcaucgcccagaccaacgccgagccagacgggccgaccccggaacuggaagaggaaauguucaaaaagaggaaccucacgauaauggaucugcaccccggcagugguaagacacguaaguacuuaccugcgaucguccgggaggccauaaagcgccgguuacgcacccugauccucgccccaacccgggugguggcggccgagauggaggaggcgcucaagggccugcccauccgcuaccaaaccacggccacaaagagcgagcauaccggccgggagaucgucgaucugaugugccacgcgaccuucacgaugcgacuccugucucccguccggguacccaacuacaaccugaucgucauggacgaagcucacuuuaccgacccggcguccaucgcggcucgcggguacaucucgacccgggugggaaugggugaagccgccgcgauauucaugacggccacuccgccgggcaccgccgacgccuucccccagaguaacgccccuauccaggacgaggagagggacauucccgagcggucguggaacuccggcaacgaguggaucacugacuucgcugggaagacggugugguucgucccaagcaucaaggccggcaaugacaucgcgaacugccuacgcaagaacggaaagaagguuauucaacugucacgcaagacguuugacaccgaauaccagaagaccaaguugaacgacugggacuuuguggucacaacagacaucagcgagaugggagccaauuucaaggcagaucgggugaucgacccacguaggugccucaagccgguuauccugaccgacgggcccgagcgcgucauucuggcggggcccaugcccguuaccguggccuccgccgcccagcggcgcggccgagucgggcguaacagccaaaaggagaacgaccaauauaucuucaccggccagccgcucaacaacgacgaggaucacgcccacuggacggaggcgaaaaugcuuuuggacaacaucaacacacccgagggcaucauccccgcacucuucgaacccgagcgagagaagagugcugcuaucgacggcgaguaucgccugaaaggggaaagccggaagaccuucguggaacugaugaggcggggugaucucccggugugguuggcgcacaaaguugcguccgagggcaucaaguacaccgaucgcaaguggugcuucgacggggaacggaacaaccagauccucgaggagaacauggacguggagauuuggacgaaggagggcgagaagaagaagcuccgcccccgauggcuugaugcccgcacguacucugauccccuggcccucaaggaguucaaggauuucgcugcgggccggaaguccaucgcccuggaccucguuaccgagaucggccguguucccagccaccucgcgcaccgcacccggaacgcauuggauaaucuggugaugcugcacacuagcgaacacggcggucgcgccuaccggcacgccguagaggagcugccggagacgauggagacacugcuccugcugggucucaugaucuuacucaccgggggcgccaugcuguuucucauuucugggaagggcauuggcaagacaagcaucggacugaucugcgugguggccuccagcggcaugcuguggauggccgacguuccucugcaguggaucgcgagcgccaucgugcuggaguucuucaugauggugcugcugauucccgagccggagaagcagcgcacgccccaggacaaucagcuggcuuacguagugauugggauccuuacccuagccgccaucguggccgcgaacgagaugggucugcucgagacgaccaagcgggaccuggggaugagcaaggagccgggcgucgugagucccacgagcuaccuggacguagaccuccauccggccuccgccuggaccuuguacgccgucgcgaccaccguuauuacccccaugcuccgccacaccaucgaaaacagcaccgcgaacgugucccuagccgcuauagccaaccaggccguugugcucaugggccuggauaaaggguggcccauuagcaagauggaccuaggagugccgcugcuggcucucggcugcuacucucaggucaacccgcugacccugacggccgccgugcuccugcuggugacccacuacgccaucaucggcccugggcuccaggcgaaagccacccgggaggcccagaagcguaccgccgccggcaucaugaagaacccgacggucgacggcaucaugacaaucgauuuggacccugugaucuacgacaguaaauucgagaagcaguugggccagguuaugcucuuaguccugugcgcggugcagcuccuacugaugcggacuucgugggccuucugcgaggcccucacccuggccacgggcccgauaaccaccuuaugggaagggagcccgggaaaauucuggaauaccacgauugcgguguccauggcaaacaucuuccgcggcagcuaccucgcuggcgccggauuagccuuuuccaucaugaaguccgucgggaccggcaagcgggggacuggcucccaaggcgagacuuuaggugagaaguggaagaagaaacucaaccagcugucucgcaaggaguucgaccuguacaagaaauccggcaucacggagguggaucggacggaggcgaaggagggucucaagaggggcgagaucacccaccacgcuguaucccgggggagcgcgaagcugcagugguucgucgagaggaauaugguuauccccgagggccgcgugaucgaccugggcuguggacgcgguggaugguccuacuacagcgcagggcugaagaaagucaccgaggugcggggcuauaccaaaggcgggcccgggcacgaagaaccggugcccauguccacguacggguggaacaucgucaaacugaugagcggaaaggacguguucuaccuaccacccgagaagugugauacccugcucugcgacaucggcgagucgagccccagccccaccguggaggaaagccgcaccauccgaguccugaagaugguggagcccuggcugaaaaacaaccaguucugcaucaaggugcucaaccccuacaugccgacggucaucgagcaccuggagcgccugcagcguaagcaugggggcaugcucgugcggaaccccuuauccagaaauuccacccacgaaauguacuggaucuccaacggaaccgguaacaucgugucguccguuaacauggucagccggcugcucuugaaccgcuucaccaugacacacagacgucccacgaucgaaaaggacgucgaccugggcgcugggacucggcacgucaacgcggagcccgagaccccgaacauggaugugaucggcgagcgcauccggcggaucaaggaggagcacuccagcacguggcacuacgaugacgagaaccccuacaagaccugggccuaccacggcuccuacgaggucaaggccacgggaagcgccagcuccaugauaaauggcguggugaaacuuuugacaaagcccugggacgucgugccuaugguuacgcagauggcuaugaccgacaccacacccuucgggcagcagcgagucuucaaggagaagguggauacgcgcacgccucggcccaugccgggaacccgcaaggugauggagauuaccgcugaguggcuguggcggacgcuuggucgcaacaagcgcccccgccugugcaccagagaggaguucaucaaaaaggucaggacaaacgccgcaaugggggccguguuuaccgaggagaaccagugggacagugcacgcgccgcagucgaggacgaggaguucuggaagcuggucgaucgggagcgcgagcuccauaagcugggcaagugcgguuccugcguuuacaacaugaugggcaagagggagaagaagcucggcgaguuuggcaaggccaaggggagccgcgccauaugguacauguggcucggagcgcgguaccuggaguucgaggcccugggcuuccucaacgaggaccacugguucucucgcgagaacagccacagcgggguggagggggagggacuccacaagcugggcuacauucuccgggauauaagcaagauacccgggggcgccauguacgccgacgacacagccggcugggauacccguaucaccgaggaugaucugcacaaugaagagaagaucacccaacagauggacccugagcaccggcaauuagcgaacgcuaucuucaaacucacguaucagaacaaggucgugaaagugcagcgcccgaccccuaagggaaccgucauggacauaaucucgcggaaggaccagagaggauccggccaagugggcaccuacggccucaacacguucaccaacauggaggcccagcugauccggcagauggagggggaaggcguguuguccaaggccgaccuggagaacccccaccuccucgagaagaaagucacccaguggcuagagaccaagggggucgagcgccugaagcggauggcuaucagcggcgacgacugcgugguuaagccaaucgacgacagguucgccaacgcccuccucgcccugaacgacauggggaaggugcggaaggacaucccgcaauggcagcccuccaagggcuggcacgacuggcagcagguccccuucuguucgcaccacuuccacgaacucaucaugaaagacgggcgcaaauuaguagugccgugccggccccaggacgagcugaucggacgcgcccggauaucccagggcgccggguggucgcuccgcgagacggcaugccugggaaaagccuacgcccagaugugggcacugauguacuuccaccgccgggaccuccgacuggcguccaaugccaucugcagcgccgugcccguccacugggugcccacgucccguaccacuuggagcauccacgcccaccaccaguggaugaccacggaggauaugcugacaguguggaaccgcgucuggauagaggacaaccccuggauggaggacaagaccccgguaaccacgugggaggaugugcccuacuuggguaagagagaggaucaguggugcggcagccugaucggccugaccucuagagccaccugggcccagaacauccuaaccgccauccagcagguccggagccugaucggcaacgaggaguuccuggacuacaugccaucuaugaagcgcuucagaaaagaggaagagagcgagggcgcaauaugguga

SEQ ID NO: 26174 - RNA, 9873 nt, Artificial Sequence
  derived and/or modified CDS sequence (opt11) from DENV-3__KU216208__SS-prME
acgagccugugccucaugaugauccugcccgcggcucuggcguuccaccucaccagccgugauggggaaccgcggaugaucguggggaaaaacgaaaggggcaagagccugcuguuuaagaccgccuccgggaucaacaugugcaccuuaaucgccauggaccugggcgaaaugugcgacgacaccgugaccuacaagugcccucauaucacagaaguggaacccgaggacaucgacugcuggugcaaccugacuagcaccugggucaccuacggcacgugcaaccaggccggcgaacaccggcgcgacaagcgguccguggcccucgcgccccaugugggcaugggguuagacacccgcacccagaccuggaugucggcagagggcgccuggcgccagguggagaagguggagacgugggccuuacgccacccgggguucaccauccucgcguuauuccuagcccacuacaucgggaccucucucacacagaaagucgugaucuucauacugcugaugcucgucaccccaagcaugaccaugcggugcgugggggugggcaaucgcgauuucgucgagggauuauccggggccacauggaucgauguugugcuggagcacggcgggugcgucaccacgauggccaagaauaagccgacccucgauaucgaguuacagaagaccgaggccacacaauuagcuacacuccggaagcugugcaucgagggaaagauaaccaauaucaccaccgacucccgcugccccacucagggcgaggccguucugccggaggaacaggaccagaacuacgugugcaagcacgcuuauguugaccgggggugggguaacgggugcggccucuucggcaagggaucccugguuacgugcgccaaguuccagugcuuggaacccaucgagggcaagguaguacaguaugagaauuugaaguacacggugauaauuaccgugcacacgggggaccagcaccaggucgguaacgagacgcagggggugaccgccgagaucacgccccaggcgagcacgaccgaagccauucugccugaguacggcacccuagggcucgagugcuccccgcgcaccggccuggacuucaaugaaaugauccugcugaccaugaagaauaaggccuggaugguccaccggcagugguuuuucgaccugccccugcccuggacgagcggcgccaccaccgaaacccccacguggaaccgcaaggagcuucugguuacguucaagaacgcucacgcaaagaagcaagagguggucguccuuggcucccaggagggggccaugcacaccgcucuuaccggugccacggagauccagaacucaggaggcaccuccaucuucgccggucaucuaaagugccgucugaaaauggacaaacucgagcugaagggaaugagcuacgcgaugugcaccaacacuuuugugcugaagaaggagguuuccgaaacgcagcacgggaccauucuaaucaagguggaguauaagggcgaggacgccccauguaagauccccuucagcaccgaagacggccagggcaaggcgcacaacggccgccugauaacggccaacccaguggucacgaagaaggaggagcccgugaacaucgaagcggagccucccuucggggagagcaacaucguuaucgguaucggggacaaugcacugaagauuaauugguacaagaagggcuccagcaucgggaagauguucgaggccaccgcccgaggcgcccgcaggauggcuauccuuggcgacaccgccugggacuucggguccgucggcggaguguuaaacagccugggcaaaaugguucaccaaaucuucggguccgccuauaccgcccuguucaguggcgucuccugggucaugaagaucggcaucgguguacuccugacguggauuggccugaacucuaaaaacaccaguaugagcuucuccugcaucgcuaucggaaucaucacucuauaccugggcgcggucgugcaggccgacauggggugcguggucaacuggaagggaaaggagcugaagugcggcagcgggauuuucguuacuaaugaagugcacacauggaccgagcaauacaaguuccaagccgacuccccgaagcgccuggcaaccgccaucgccggcgccugggagaacggagucugcggcauccgcagcaccacgcggauggagaaccugcuguggaagcagaucgcaaacgaacucaauuacauucugugggagaacaacaucaaacugacagucguggucggagacaccaucggcgugcuagagcaaggcaagcgcaccuuaacgccccagccgauggagcuaaaguacuccuggaagaccuggggaaaagccaagauuguuaccgcggagacccagaacuccuccuucaucauugaugguccuaacacgcccgaguguccgagcgccucccgggcauggaaugucugggagguggaggauuacggguucggaguuuucacgaccaacaucuggcucaaguuaagagaagucuacacccagaugugcgaccaccgucugaugucggcggcggugaaggacgagagagcgguucacgcagacaugggauacuggauagagagccagaagaacgguuccuggaagcucgagaaagcaagccuuaucgaggucaagaccuguacguggccgaagucucacacacuguggucaaacggcgugcucgagucagacaugaucaucccgaaauccuuggccgggcccauuagccagcacaacuaccggcccgguuaucacacccagacagcgggccccuggcacuugggcaagcucgagcuugacuuuaacuauugcgagggcacgaccguggucauuaccgagaacugcggcacccguggccccagcuugcggacuaccaccguaagcgggaaacucauccacgaauggugcugccgcagcugcacccugcccccguuacgguacaugggcgaggacggcugcugguacggcauggaaauucgccccaucucugagaaggaggagaauauggugaaaagccucgucuccgcgggcagcgggaagguggacaacuucacgaugggggugcuaugccuggcuauccuuuuugaagaggucaugcgggggaaguucggcaagaagcacaugaucgcggguguguucuucaccuucgugcuucugcucuccggccagaucaccuggcgcgacauggcucacacccugaucaugauagguagcaaugccuccgaccgcaugggcaugggaguuacguaccuggcgcuuaucgcgaccuuuaagauucagcccuuccuagcccugggguucuuucucaggaagcuaaccagccgggagaaccugcuacugggugucggacuggccauggcgaccacucuccagcuuccggaggacaucgagcagauggccaacgggaucgcgcugggccucauggccuuaaaauugaucacgcaguucgagaccuaccaacucuggacggcccugaucucacugacgugcucgaauacgaucuucacacucaccguggcguggcgcacagcaacccugaucuuagccggagucagccuccugcccguaugccaguccagcuccaugagaaagaccgacuggcugccaaugaccguggcagccaugggcgucccacccuuaccgcuguucaucuucagucuuaaggacacucucaagcgccgcuccuggcccuugaacgagggugugauggcggucggccucgugucuauccucgccucaagccuacugcggaacgacguccccauggccggaccgcucgucgcagggggccucuuaauagcgugcuacgugauaaccgguaccuccgcggaccucaccguugagaaggcagccgacguuacgugggaggaagaggcugagcagaccggcgugucccauaaccugaugauaaccguggacgacgacgggaccaugaggaucaaggacgaugagacagagaacauucugacuguccuguugaaaaccgcccugcuuauaguguccggcaucuuuccguacagcauacccgcgaccuuacuggucuggcacaccuggcagaagcagacgcagcgguccgggguccucugggacgugccaaguccgcccgagacccagaaggccgaacuggaggagggcguguaccgcaucaagcagcaggggauccuugggaagacacaagugggggucggagugcaaaaagagggcguguuccacaccauguggcacgugacgcggggcgcaguuuuaacccauaauggaaagagacuggagccuaacugggccuccgucaagaaagauuugaucagcuacggcggggguuggcggcucuccgcucaguggcagaagggggaggagguccaggugaucgcagucgagcccggcaagaaccccaagaacuuccagaccaugcccggcacauuccagacgaccaccggggagaucggcgccaucgcccuggacuucaaacccgguaccucaggcagcccuaucauuaaccgcgagggcaaggucguggggcuguacggcaacgguguggugacgaagaauggcggguauguauccggcaucgcccagaccaacgcggagccggauggcccaacccccgaacucgaggaagagauguucaagaagcggaaccuuaccaucauggaccuacaccccgggagcgggaaaacgcggaaguaccugccugccaucguccgggaggccaucaaacgccggcuccgcaccuugauccuggccccaacccgggugguugccgcugagauggaggaggcgcuuaaggggcugccuauucgauaccagaccacggccacgaaguccgagcacacgggccgugaaaucgucgaccugaugugccacgccaccuuuacgaugcgucuucuuagcccugugcgcgugccgaauuacaaccugaucauuauggacgaggcccauuuuaccgaccccgcguccauugccgcccgcggguacaucucgacccggguggguaugggcgaggccgcugccaucuucaugaccgccacgccgccggggaccgccgacgccuucccgcaguccaaugcgcccauccaggacgaggagcgcgacauccccgagcguagcuggaacuccggcaacgaguggauaacugacuucgcugggaagaccguaugguucgugcccucaaucaaggccgguaacgacaucgccaauugccuccgcaagaacgggaagaaaguuauccagcugucccgcaagacguucgagacggaguaccagaagaccaagcugaacgacugggacuuuguggugaccacggacaucagcgaaaugggcgccaacuucaaggcggaccgggucaucgauccgcgccggugucucaaacccgugauucuuacggauggcccugagcgcgugauucuagccgggcccaugccugucacagccgcguccgccgcgcaaagacgcggacgggugggacgcaacccccaaaaggagaaugaucaauacaucuucacaggccagccccucaacaacgacgaagaccacgcccacuggaccgaggccaaaaugcuucucgauaacaucaacacacccgaagggaucauccccgcccuauucgaacccgaacgagagaagagugcggcgaucgacggcgaguaccgccugaagggcgagagucggaagaccuucguggaauuaaugcgccgcggcgaccuccccgucuggcuagccuacaagguggccagcgagggcaucaaguacacugaccgcaagugguguuucgacggccagcggaauaaccagauccuggaggagaacauggauguugaaaucuggacuaaagagggagagaagaagaagcuccgcccccgguggcuggacgcccgcacguacucggacccgcuggcgcucaaggaguucaaggacuuugccgccggucgcaagaguaucgcccuggaucuggugaccgagaucgggcggguccccucccaucuugcccacaggacccgcaacgcgcuagacaacuuggucaugcuccauaccagcgagcauggcgggcgcgccuaucggcaugccguggaggagcuucccgagacaauggagacccugcuccugcugggccucaugauccuccugaccgggggcgcgaugcuguuccugaucagcgguaaggggaucggcaagacauccaucgggcugaucugugugauagccagcuccggcaugcucuggauggcugagauaccgcugcaguggaucgccucggcaaucgugcucgaguucuucaugauggugcuccugauccccgagccggagaagcagcgcacgccucaggacaaucagcuugcguauguggucaucgggauccucacccuugccgcgaucaucgccgccaacgagauggggcugcucgaaacuaccaagcgggaccuggguauguccaaggagccggggguggugagccccacgaguuaucuggacguugaccuccacccugccucagcauggacccuguacgccguagcaaccaccgugaucacgcccaugcugcgucacaccaucgagaacagcacggccaaugucagccucgcugcgaucgcgaaucaagccguggugcugaugggacuggacaaggguuggcccaucuccaaaauggaccugggcgucccccuguuagcccucgggugcuacagccaagugaacccccugaccuuaacugccgcggugcuccugcugaucacccauuacgcaauaaucggccccggccuucaggccaaggccacccgggaggcucagaagcgcaccgcugcggggauuaugaaaaacccgacggucgacggcaucaucaccauagaccuggacccggugauauacgauuccaaauucgagaagcagcucggccaggugaugcuccugguccuaugcgccgugcagcuccugcugaugcggaccagcugggcccucugcgaagcgcuuacgcuagccacgggccccaucaccacucugugggagggcagccccgggaaguucuggaacacaacgaucgcggucagcauggcuaacaucuuuaggggcuccuaccuggccggggcgggccuggccuuuucaaucaugaagucagucgggaccggcaagcggggaaccgggagccagggagaaacccucggggagaaguggaagaagaaacugaaccagcugagcaggaaagaguucgaccucuacaagaaauccggcauuaccgaggucgaccggacggaggcgaaggaggggcugaagaggggcgagaccacccaccacgccgugagccggggaagcgcuaagcugcagugguucgucgagcgcaacauggugaucccggagggucggguuaucgaccuaggcugcggucguggcggguggagcuacuauugcgcgggcuugaagaaggucaccgaggugcgggguuacaccaagggcgggcccgggcacgaggaaccggugcccauggccaccuacggcuggaauauaguuaaacucaugucagggaaggauguguucuaccuaccgccggagaagugcgacacccuccugugcgacauuggugagagcuccccaagccccacaguggaagaaucccgcacgauccgcguacuaaagaugguagagccguggcucaagaacaaccaguucugcaucaaagugcugaaccccuacaugccagccgucaucgaacaccuggagcgucuccagcgcaagcauggcggcaugcuggugcggaacccccugagccgcaacuccacgcaugagauguacuggaucaguaacggcaccggcaauauuguguccucagucaacauggugucccgguuacuacugaaccgguucacgaugacacaccggcgcccaaccaucgagaaggacguggaccucggcgccggcacccggcacgucaaugcugagcccgagacccccaacauggacgugaucggggagcgcaucaagcggaucaaagaggagcauaacagcacuuggcacuacgacgaugagaacccguacaagacaugggcguaucacggaucauacgaggucaaggccaccgggagcgccucgagcaugaucaacggcgucguuaagcugcugacgaaaccaugggacguugugccuauggugacacagauggccaugaccgacaccaccccguucgggcaacagagggucuucaaagaaaagguggacacucggaccccgcgcccuaugcccggcaccaggaaagugauggaaauaaccgcggaauggcucuggcgcacgcuaggccggaacaaacgcccgcggcuguguacccgcgaggaguucaccaagaagguuagaaccaacgccgccaugggggcaguguuuacggaagagaaccagugggacagugcuaaggcggccguggaagaugaggaguucuggaagcucgucgaucgggagcgcgagcuacacaagcugggcaagugcggaucauguguguacaacaugauggggaagagggagaaaaagcucggggaguucgguaaggccaaaggcagccgggccauuugguacauguggcugggggcucgguaccuggaguucgaggcgcuaggauuccugaaugaagaccacugguuuucccgcgagaacagcuacuccggcgucgaaggcgaaggguuacacaagcucgguuacauccugcgggacaucagcaagaucccgggcggggccauguaugccgacgauaccgccggcugggacacccggaucaccgaggacgaccugcacaacgaggagaagaucacgcagcagauggaucccgagcaucgguuacuggcuaacgcgauauucaagcugaccuaccaaaacaaggucgugaaggugcaacgacccacgccgacggggaccguuauggacaucauaucccggaaggaccagcgcgguagcggacagguggggacguacggccucaacacuuuuacuaacauggaggcccagcucguucgacaaauggagggggaggguguccuguccaaggccgaccucgagaacccacaccucccggagaagaagauuacccaguggcuugagacgaaggggguggaacgcuugaagcggauggccauaagcggcgacgacugcguggucaaacccaucgacgacagguucgccaacgcgcuccuggcccucaacgacaugggcaaggugagaaaagacauaccccaguggcaaccgucuaaaggguggcacgacuggcagcagguccccuucugcagccaccacuuccacgaacuuaucaugaaggacggccgcaagcuaguaguccccugccggccccaggacgagcucaucggucgcgcccguauaagucaaggcgccggguggagccugcgagagacugcgugucuaggcaaggccuacgcccagauguggucccucauguacuuucacagacgagaccugcgccuugccagcaacgccauuugcagugcggugccgguccacuggguaccuaccagccggaccacguggucgauccacgcacaccaccaguggaugaccacggaggacaugcucaccguguggaaccgcgucuggaucgaggacaaccccuggauggaggauaagacgcccgugaccacaugggagaaugugccuuaccugggcaaacgggaagaccaguggugcggcucgcuaaucggcuugaccucacgcgccacgugggcccaaaacauuccaaccgccauccagcagguccggucgcugauagggaacgaggaguucuuggacuacaugcccagcaugaagcgguuccggaaggaggaggaguccgagggcgcgaucugguga

SEQ ID NO: 26175 - RNA, 9873 nt, Artificial Sequence
  derived and/or modified CDS sequence (opt11) from DENV-3__GU370053__SS-prME
acaagccucugccucaugaugauccugcccgccgcucuggcguuccaccucacaagccgggacggggaaccccgaaugaucguggguaagaacgagcgaggaaagagccugcuuuucaaaacggccuccgggaucaacaugugcacccucauagccauggaucugggcgaaaugugcgaugacaccgugaccuacaagugcccccacaucacggagguugagcccgaggacauagacugcuggugcaaccugacgaguacguggguuaccuacgggacgugcaaucaggccggcgagcaccgacgcgacaagaggagugucgcucucgcgccccacguggguaugggucuugacacccgcacccagaccuggauguccgccgagggcgccuggcgccagguggagaaaguugagacgugggcccugcggcauccgggguucaccauccucgcucuguuccuagcccacuacaucggcaccucccucacccagaaggugguuaucuucauccugcugauguuagucacgcccagcaugaccaugaggugcgugggggugggcaaccgcgacuucgucgagggccugagcggggcuaccuggguggacguggugcuggagcacgggggaugcgugacuacgauggccaagaacaagccuacccucgacaucgaacuccagaaaacggaggccacccagcuggcgacucuccggaaguugugcauagagggcaaaaucaccaacaucaccaccgauagccgcugcccgacgcagggcgaggccgugcugccggaggagcaagaccagaacuauguguguaagcacaccuacguggacagagguuggggcaaugggugcggccucuucggcaagggcucccuagugaccugcgcuaaauuccagugucuggaaccuaucgaggguaaggucgugcaguacgagaacuuaaaauauaccgugaucaucacgguccacaccggggaccagcaccaagugggcaacgagacccagggggugaccgccgagauuacaccgcaggcaagcaccaccgaagcgauccugcccgaguacggcacccucggccuugagugcucuccgcgcaccggccuggacuucaacgagaugauucugcucacaaugaagaauaaggccuggauggugcaccgacaaugguucuucgaccuaccccugcccugggccucaggcgccaccaccgaaaccccgacguggaaccgcaaggagcuccuggugacuuucaagaacgcccacgcgaagaagcaggaggucgugguccuagggucccaggagggcgcgaugcacacggcccucacgggugccacggaaauucaaaauuccggcgggaccuccauauucgcaggacaccugaagugccgacugaagauggacaagcucgagcugaagggcauguccuacgcgaugugcaccaauaccuuuguguuaaagaaggagguguccgagacgcagcacgggacgauucucaucaaaguggaguacaagggcgaggacgccccguguaagauccccuucucgaccgaggacggccagggcaaggcacacaauggccgcuuaauaacagcgaacccggucgugacgaaaaaggaggagcccgucaacaucgaggcggagccacccuucggggaaagcaauaucgucaucgguaucggggacaacgcacuuaaaaucaacugguauaaaaagggcuccagcaucgggaaaauguucgaagccaccgcccgcggcgcccgcagaauggcgauccugggcgauaccgccugggacuucggguccguaggaggggugcuuaacagcuuaggcaaaaugguccaccagauuuuuggguccgccuacaccgcucuguucagcggcgucucaugggugaugaagaucggcauagggguccuccugacguggaucggucugaacagcaagaacaccucaaugagcuucucgugcaucgccaucgggaucaucacacucuacuugggcgcggugguucaggccgacauggggugcgucaucaacuggaagggcaaggaacugaaaugcggcagcggaaucuuugugaccaacgaagugcacacauggaccgagcaguacaaguuccaagccgacucccccaagcgccucgcgaccgccaucgcuggcgccugggagaacggggugugcggcauccgaagcacgacgagaauggagaaccugcuguggaagcagauagccaacgagcucaacuacauccucugggagaacaacaucaaguuaaccguggucgucggcgauaccauuggcguacucgagcagggcaaacgcacgcugacgccucagccuauggagcugaaguacuccuggaagaccuggggcaaggccaagaucguaaccgcagagauccagaacucgucguucaucaucgacggccccaacacucccgagugcccuucggcgucccgcgccuggaacguaugggagguggaggacuacggauucggcguauucacgaccaacaucuggcucaaacugcgcgagguuuacacccagcugugcgaccaccgguugaugagcgccgcugugaaggacgagcgcgcuguucaugccgacauggguuauuggauugagucacagaagaacgggucauggaagcuggagaaggcuagccugaucgagguuaagaccuguaccuggcccaagucccacacacuuuggagcaacggcgugcuggaguccgacaugaucauccccaagagccucgccgggcccaucucccagcacaacuaccggccuggauaccacacccagaccgcagggcccuggcaccucggcaagcuggagcuggauuucaacuacugcgagggcaccacgguggugaucaccgagagcugcgggacccggggcccgucccuccggacaacgaccguuuccgggaagcugauccacgaguggugcugccgcuccugcacccuaccaccgcuuagauacaugggcgaggacgggugcugguacggcauggagauccgcccuaucucggagaaggaagagaacauggugaagagucucguuagcgcgggcuccgggaagguggauaacuucaccaugggcgugcucugccucgccauccuguacgaggaggugaugcgagggaaguucgggaagaaacacaugaucgccggggucuucuuuacauucguauuacuccugagcggccagauaacauggcgcgacauggcacacacccugaucaugauuggcuccaacgccagcgaccgaauggggaugggcguuaccuaccucgcgcuaaucgccacguucaagauccagcccuuccuggcccuaggguucuuccugcgcaagcugacgagccgggaaaaccuccugcugggaguaggccucgccauggcgacuacccugcaacugcccgaggacaucgagcaaauggccaauggcaucgcucucggacugauggcccugaagcucaucacccaguucgaaaccuaccagcuguggaccgcccuugugucuuuaaccugcagcaacacgaucuucaccuugaccgucgcguggcgcacagccaccuuaauacucgcgggggugucccuacugccggucugccagagcuccucaaugagaaagacggacuggcuuccgauggcuguggcggccaugggugugccgccucuaccacucuucaucuuuagccucaaggacacucucaagcgucgcagcuggccccugaacgagggugugauggccguuggccucguguccauccuggcgagcuccuugcuccgcaacgacguccccauggccgggccccugguggccgguggccugcucaucgcguguuacguuaucaccgggaccagcgccgaccugaccgucgaaaaggccgccgaugugaccugggaggaggaggccgaacagaccggugugucccacaaccugaugauaacggucgacgacgacgggaccaugcguaucaaagacgacgaaacggagaacauacucaccgugcugcugaaaacggcacuccugaucguuagcggaaucuucccguacuccaucccugccacgcuacuggucuggcacaccuggcaaaagcagacgcagcggagcggggugcugugggacguccccuccccacccgagacccagaaggccgagcuggaggagggggucuaucgaaucaagcaacagggcaucuucggaaagacucaggugggcguggggguacaaaaggaaggugucuuccacaccauguggcaugugaccagaggggcaguccucacccacaacgggaagcgccuggagcccaacugggcuuccgucaagaaggacuuaaucuccuacggcgggggcuggcgccucagcgcccaguggcaaaagggugaagaggugcaagucaucgcgguagagcccggcaagaaccccaaaaacuuccagacgaugccaggcaccuuccagaccacuacgggggagaucggcgcaaucgcccuggacuuuaaaccggggacgagcggcucccccaucauuaaucgcgaggggaaggugguggggcuguacggcaaugggguggugacuaaaaacggggguuacgucucggguauugcgcagaccaaugccgagcccgacggcccuacucccgaacuggaggaggaaauguuuaagaagcggaaucuaaccaucauggauuugcaccccgggucagguaagacccgaaaguaccugccggccaucgugcgcgaggccaucaagcgcagacuucggacgcugaucuuagcccccacgaggguggucgcggccgaaauggaggaggcccucaaaggccugcccauccgguaucagaccaccgccaccaagagcgagcacacgggucgggaaauuguggaccugaugugccacgccaccuucaccaugcgucuccuguccccagugcggguccccaacuacaaccucaucgugauggacgaagcgcacuucaccgaccccgccuccaucgcagccaggggguacaucuccacgcgggugggcaugggugaggcggcggccaucuucaugacggcaacgccgcccgggaccgcugacgccuucccgcagagcaacgccccgauccaggaugaagaacgcgauauacccgagcgguccuggaacagcgguaaugaguggaucacugacuucgccgggaaaaccgucugguucguucccuccaucaaggccggcaacgacauugccaacugccuacgcaaaaacgggaagaaggugauucaguugagucgcaaaacauucgacaccgaguaccagaaaacgaaacugaaugacugggauuucgucgugacuaccgacaucuccgagaugggggccaacuucaaggccgaccgggugaucgacccgcgccggugucucaagccaguuauccugaccgacggccccgagcgagucauacuggccgggcccaugccggugacggcagccagcgccgcccagcggaggggccgggucgggcguaacccccagaaggagaacgaucaguacaucuucacgggucagccgcucaauaaugacgaggaccacgcgcacuggaccgaggcgaagaugcuucuagacaauaucaacacccccgaggggaucauuccggccuuguucgagcccgaacgagagaagucagccgccauugacggagaguaccgccugaagggcgaaagccggaaaaccuucguggagcugaugcgccgcggggaccuccccgucugguuagcccacaaaguugcuagcgaggguaucaaauacacggaccggaaauggugcuucgacggccagcggaacaaccagauccuggaggagaacauggacguggagaucuggacaaaggagggcgagaagaagaagcuacgaccucgaugguuagaugcgcgcacauacagcgacccgcuggcccucaaagaguucaaggacuucgccgcaggccgcaaguccaucgcccuggaccuggugaccgagaucgggcgggugccuagucaucucgcgcaccgcacgcggaaugcccuggacaaucuggugaugcuccacaccuccgagcacggcggccgagccuaccggcacgccgucgaggagcuccccgagacgauggagacccugcugcuguuaggccucaugauacuccugaccggaggggccaugcuguuccugaucagugggaaagggauaggcaagacgagcauagggcugauaugcgugaucgcgucgagcggcaugcuauggauggccgaggugccgcugcaguggauagccuccgccaucguccuggaguuuuucaugauggugcucuugaucccugagcccgagaagcagcgcacgccucaagacaaccagcuggccuacguagugaucgggauccucacccuggcggccauuaucgcagccaaugagaugggccugcuggagaccaccaagcgggaccugggcaugagcaaggagccugggguggugucccccaccagcuaccuggaugucgaccuccaccccgcgagcgccuggacucuguacgccguggcgacgaccgugaucacccccaugcugcggcauaccauagagaacagcaccgccaacgucucccucgcggcuaucgccaaccaggccguggugcuaaugggucuggacaagggguggccgauaagcaagauggacuuaggcgucccccugcuggccuuagggugcuacucccaagugaacccgcugacccuaaccgcggccguccuccugcugaucacccauuacgcuauuaucggcccuggccuccaggcuaaggcgacgcgugaggcccagaagaggaccgccgccgguaucaugaagaaucccacggucgacggcaucaugaccaucgauuuagacccugugauauacgacagcaaguucgagaagcagcucggccaagugaugcuccugguccugugcgcagugcagcucuuauugaugcggacuuccugggcccucugcgaagcccugacgcuggccaccggcccaaucaccacgcuuugggagggcagcccggggaaguucuggaacaccacuaucgccguguccauggccaacaucuuucggggcagcuaucuggccggugccggccuggccuucucgaucaugaagucggucgggacugguaagcgggguacggggagccagggcgagacacucggggagaaauggaaaaagaagcugaaccagcugucccgcaaggaguuugaccucuauaagaaaucuggcauaaccgagguggaccggaccgaagcaaaggaggggcugaagaggggcgagaccacccaccacgccgucucccguggcagcgcgaagcugcagugguucgucgaaaggaauaugguggugccggaaggucgggucaucgaccucggcuguggccgcggcggaugguccuacuacugcgccggucugaagaaggugaccgagguccggggcuauaccaagggagggcccgggcacgaggagccaguccccaugagcaccuauggcuggaacaucgugaagcugauguccgggaaggacguauucuaccuaccacccgaaaaaugcgacacccugcugugcgacauuggcgagagcuccccgagccccacagucgaggagucccgcaccauccgggugcugaagaugguggagcccuggcucaaaaacaaccaguucugcaucaagguccugaacccuuacaugcccacggugaucgagcaccuugagaggcuucagcgcaagcacggcgguauguuaguucggaauccucugagccgcaacuccacgcacgagauguacuggaucagcaacgggacggggaacaucgucucaagcgugaacauggugucgcgacuccuauuaaaccgcuuuaccaugacccaucggcgcccaacaaucgagaaggacguugaccucggcgccggcacgcggcacgugaacgcggagcccgagaccccgaacauggacgucauuggggaacgcauuaagcggaucaaggaggagcacaacagcaccuggcacuacgacgacgagaacccguacaagacgugggccuaccacggcaguuacgaggugaaggccaccgggagcgcgagcucuaugaucaacggcguggucaaacuucugaccaagcccugggacgugguacccauggucacgcagauggcaaugacggauacgacccccuucgggcagcagcgcguguucaaagagaagguggacacccggacgccgagacccaugcccggcaccaggaaggucauggaaaucacagccgaguggcucuggagaacgcugggccgaaacaagcgcccccgguuaugcacgagggaggaguucaccaaaaagguccgcaccaacgccgcuaugggcgcuguguuuacggaagagaaccagugggauagcgcaaaggcagccguugaggacgaggaguucuggaaacucguagaccgggaacgcgagcugcacaagcuggggaaguguggguccugcguguacaacaugaugggcaagcgggagaagaagcucggcgaguucggcaaggcgaagggcagccgcgccaucugguacauguggcugggagcccgguacuuggaguucgaggccuugggcuuccugaacgaggaccacugguucucaagagagaacagcuacuccgggguggaaggugagggacugcacaaacucggcuacauccugcgugauauaucuaaaaucccgggcggggccauguacgccgacgacaccgccggcugggacacucgcaucaccgaggaugaucugcacaacgaggagaagaucauccagcaaauggaccccgagcaccggcagcucgccaacgccauuuucaagcucaccuaucaaaacaagguggugaagguccagcgccccacgccgaccgggaccguaauggauaucaucucccggaaggaccagcgcggcagcggccagguagggaccuacggacugaacaccuucacgaacauggaggcgcagcucguccggcagauggagggugagggagugcugaccaaggccgaccuggagaacccgcacuugccggagaagaagauuacgcaguggcucgagaccaaggggguggagagacugaagcggauggcgaucagcggcgacgauugcguggugaagcccauagacgaucguuuugccaaugcgcuccuggcccugaacgacauggguaagguacggaaagacaucccccaguggcaaccgagccgcggauggcacgauuggcaacaggucccuuucuguagucaucacuuccaugagcucauaaugaaggauggccggaaacugguugugcccugccgcccgcaggaugagcugaucgggcgggcccgcaucucacagggugccgguuggucccuccgcgagacggccugccugggcaaggcauacgcccaaauguggagccugauguacuuccaccguagggaccugcggcuggccuccaacgccaucugcagcgcagucccggugcacugggugcccacgagucgcaccaccuggagcauccaugcgcaccaccaguggaugaccacugaggauaugcuaaccgucuggaaccguguauggaucgaggaaaacccguggauggaggacaaaacccccgucacgaccugggagaacgucccguaccucggcaaacgcgaggaucaguggugcgggagucucaucggccugacuucccgggcaacaugggcccagaacauccucacugcgauccagcagguccgcagccugaucgggaacgaggaguuccuggauuacaugcccuccaugaagcgauuccgcaaggaggaggaaagcgagggcgccaucugguag

SEQ ID NO: 26176 - RNA, 9873 nt, Artificial Sequence
  derived and/or modified CDS sequence (opt11) from DENV-3__JQ411814__SS-prME
accagccuaugucuaaugaugauccugcccgccgcgcuugccuuccaucucacgucucgggacggcgaaccgcgcaugaucgucgggaagaacgagcgagguaagagccugcuuuuuaagacugcaagcgggaucaauaugugcacccucaucgccauggaccuuggggagaugugcgacgacaccgugaccuauaagugcccccacaucaccgagguggagccugaagacaucgacugcugguguaaccuaacgagcaccuggguuacguaugggaccugcaaccaggccggcgaacaucggcgcgauaagaggucaguggccuuggcgccccacguuggcauggggcuggacacccgcacgcagaccuggaugucugcggagggcgcguggagacagguggagaagguggagacgugggcccuccgccaucccggguucacuauccucgcuuuguuccuggcccacuacaucggaacaucccuaacccaaaagguugugaucuuuauucuccugaugcucgucacgccgucgaugaccaugcggugcgucgggaucggaaaccgcgacuucguagagggccucuccggggccaccugggucgauguggugcucgaacauggcggaugcgucaccaccauggcuaagaacaagccgacucucgacaucgagcugcagaagaccgaggccacccaacucgccacgcuccggaaacugugcaucgagggaaaaauuacgaacauuacuacggacucccggugccccacgcagggggaggccguacugcccgaggaacaagaucagaacuacgugugcaagcacaccuacgucgaucggggguggggcaacgggugcggccucuucgggaagggcucccuggugaccugcgcuaaguuccagugccuggagcccaucgaaggcaagguaguacaguacgagaacuugaaguauaccgugaucauaacggugcacaccggggaccagcaucaggucggcaaugaaacgcagggagugaccgccgagaucacgccccaggccuccaccacugaggcgauccuaccugaguacggcacccuggggcucgagugcuccccgcgcaccggccuggacuucaaugagaugauucugcucacgaugaagaacaaggccuggaugguccaccgacagugguucuucgaucugccccugcccuggaccagcggcgccaccaccgagacgccgaccuggaaccgcaaggagcuacuggugacauucaagaaugcccacgccaaaaagcaagagguagucgugcuggggucccaggagggagcaaugcacacggccuugacgggugccacggagauccagaacagcggagggacauccauuuucgccggucaucugaagugccgguugaagauggacaagcucgagcugaagggaaugagcuacgcaaugugcacuaacacguucguacuaaagaaggaggucagcgagacccagcacgggacuauccucaucaagguugaguauaagggggaggacgcgcccugcaagauuccguucagcacugaggacggucagggcaaggcccacaacggccgccugaucaccgccaacccaguaguuaccaaaaaggaggagcccgugaacaucgaggcugagccacccuucggggaaagcaauaucgugaucggcaucggggacaacgcgcuuaagaucaacugguacaagaaaggcuccagcaucgggaaaauguucgaggccacggcccggggugcacgccggauggccauccugggcgacaccgcgugggauuucggcuccgucggugggguccucaacucacugggcaagauggugcaccagaucuucgggucagcguacacggcccuguucagcggagucuccugggugaugaaaaucggaaucggggugcucuuaacguggaucggacugaacaguaagaauaccaguaugagcuucuccuguauagccauagggauaaucacccucuaccugggcgccgucgugcaggcggauauggggugcgugauaaauuggaagggcaaggagcugaaauguggcagcgggaucuucgugacgaaugaggugcacacauggaccgaacaguacaaauuccaggccgacagccccaagaggcucgccaccgccauagcuggagcgugggagaacggggugugcggcauuagguccacuacccggauggagaaccuacuguggaagcagauagccaacgaguuaaacuauauccugugggagaauaacaucaaacuuacggucguugugggggacaccaucggcgucuuggaacagggcaagcggacguugacgccccagccgauggaacugaaguacuccuggaagaccuggggcaaggccaagaucgugaccgcggagacgcaaaauagcaguuucauuaucgacggucccaacacccccgagugcccgagcgcgagccgggccuggaacgugugggaggucgaggacuauggguucggcguguucacgaccaacauauggcucaaguuacgagacgucuacacgcaacugugugaccaccgucuuaugagcgccgccgucaaggacgagcgagccgugcacgccgacaugggcuacuggaucgagagccagaagaacggguccuggaaacuugaaaaggccagccugaucgaggucaagacuugcaccuggcccaagucccacacccucugguccaauggcgugcuggaguccgacaugaucauucccaagucgcuagcuggacccaucucccagcauaauuauagaccaggcuaccauacacagacggcaggcccauggcaccuugggaagcuggagcuggacuucaacuacugcgaaggaaccacagugguaauaacugagaacuguggaacgcgcggcccuagccuccggaccaccaccgucuccgggaagcugauccacgaguggugcugccgcagcugcacgcugccgccgcuccgcuauaugggugaggacgggugcugguauggaauggagauacgccccaucuccgagaaggaggagaacauggucaagagccugguaucugccggcaguggcaaggucgauaacuucaccaugggcgugcugugucucgcaauccuguucgaggaggugaugcggggcaaguucgguaagaagcauaugaucgccggcguuuuguucacguucgugcuccuguuguccggacagaucacguggcgcgacauggcacacaccuugaucaugauaggcucaaaugcguccgaccggaugggcauggggguuaccuaucuggcucugaucgcaacauucaaaauccagccuuuccucgcccugggguucuuccugagaaagcucaccucccgugagaaccugcuucuuggcgucggccuggcgauggcuacgacccugcagcuccccgaggacaucgagcagauggcgaaugggauugcacugggccugauggcucucaaacugauuacgcaauuugagacauaccagcuguggacggcacucgugaguuugaccugcucgaacaccauccugacccucacgguggccuggcgcacggcgacucugauccuagccggggucucacuccuuccggugugccaguccagcuccaugcggaagaccgauugguugcccaugacggucgcagcuaugggcguuccgccacuuccccuguuuaucuucagccugaaggacacccucaagcgccgcuccuggccccugaacgagggagugauggccgucggcuuggucucgauccucgcguccagcuugcugcggaaugacgugcccauggcgggcccacucgucgccgggggccuucucauugcuugcuacguaauaaccgggaccuccgcggacuugacggucgagaaggcggccgaugucaccugggaggaggaggccgagcagaccggcgugucucacaacuuaaugaucaccgucgacgacgacgggaccaugcgcaucaaggacgacgaaacugagaacauccuuaccguacuccugaagaccgccuugcucauuguuuccggcaucuuuccguacucaaucccggccacgcuccuaguguggcacacguggcagaagcagacccagcggagcggagucuuaugggaugugcccucaccacccgaaacccagaaggcggagcuggaggagggaguguaccgcaucaagcagcaaggcauucuuggcaagacacaggucggcgugggagugcagaaggagggugucuuccacacgauguggcacgucacucggggcgccguguugacccacaaugggaaacgccuggagccaaacugggcguccgucaaaaaggaccugaucagcuacggagggggcuggcgacucuccgcacaauggcagaaaggggaggaagugcaagugaucgccgucgagcccggcaagaaccccaagaacuuucaaaccaugcccggcacauuccagacuaccacgggggagaucggcgcaaucgcucucgacuucaagcccggcacaagcggcuccccuaucauuaacagggagggcaagguggugggucuguacgggaacggugucguuacaaagaacgggggauacguguccggcauugcgcagaccaacgccgagccggacggaccuacuccugaguuggaggaggagauguucaagaagagaaaccugacuaucauggaccugcaccccggaagcggcaagaccaggaaguaccucccugcgaucguccgggaggccaucaagcgccggcuccggacccugauccucgcucccacccgggugguugccgccgaaauggaggaagcgcugaagggacugccaauccgcuaccagacgacugccaccaaauccgagcacacgggucgggagaucguagaccucaugugccacgccacguuuaccaugcgccuccugagcccggugcgcgugcccaauuauaaccugaucauaauggacgaggcccauuucaccgaccccgccuccaucgcugcccgcggguauaucagcacccgagucggcaugggcgaagccgcugcgaucuucaugacagcaacaccgcccgggacugccgacgccuucccgcaguccaacgcccccauccaggaugaggagcgcgauaucccggagcgcaguuggaacuccggcaacgaguggaucaccgacuucgcagggaagacugugugguucgugcccagcauaaaggccggcaacgauaucgccaacugccucagaaagaaugggaagaaggucauccaacugucccggaagaccuucgacaccgaguaccagaagaccaaacuuaacgauugggacuucguugugacuaccgacaucucugagaugggagcgaacuucaaggccgaccggguaaucgacccgcgccggugccucaagcccguaauucuuaccgacggaccugagagggugauccuugcgggccccaugccgguuaccgcggccuccgccgcacagcgccgcggccgugucgggcguaauccccagaaggagaacgaccaguacaucuuuaccggccagccucucaacaacgaugaagaucaugcgcacuggacagaggccaagaugcuauuggacaauauuaacacccccgaggggaucaucccggcccucuucgagcccgagcgggaaaaguccgccgcgaucgacggcgaguaccgccuaaagggcgagagccggaagaccuuuguagagcugaugcgccgcggggaccugccggucuggcucgcccacaagguugccagcgagggcaucaaauacaccgaccgcaaauggugcuucgacgggcaacggaacaaccagauccuggaagaaaacauggauguggagauauggacuaaggagggcgagaagaagaagcuccgcccacgguggcuggacgcccgcaccuacuccgacccguuggccuuaaaggaguucaaggauuucgcugccggcagaaagagcauagcccuggaccuggugaccgagauugggcgggugccuucccaccucgcccaccgcacccggaacgcacuggauaaccuggucaugcuccacaccagcgagcacgggggcagggcuuaccgucacgccgucgaggagcuuccagagaccauggagacucuacuccugcuuggcuuaaugauccugcugacagggggcgcgaugcuguuccugaucagcggcaaggggauuggcaagaccuccauugggcugaucugcgugaucgccagcuccgguaugcuguggauggcugagaucccgcuucaguggauagcgagugcgaucguccuggaguucuucaugauggugcucuugaucccggaacccgagaagcagcgcacuccacaggacaaccagcuggcauacguggucaucgggauccucacccuagccgcaauuaucgccgccaacgagaugggcuugcucgagaccaccaagcgagaccucggcaugucaaaggagccggggguggugagccccacuuccuaccuggacgucgacuugcauccagccagugcuuggacccuguacgcaguggcgacaacggugauaacuccgauguugcgucacaccaucgaaaauuccacggccaacgucucacucgccgcuaucgcgaaucaggccgugguguuaaugggccuggacaaggguuggccgaucuccaaaauggauuuaggcguaccacugcuugcccucggcugcuauucucaagugaacccgcugacgcuaaccgcagcaguacuccuguugaucacccauuacgcgaucauaggacccggccuccaggccaaggccacgcgugaagcgcagaagcgcacugccgcagggaucaugaagaacccgaccguagacggcaucaugaccaucgaccuugaccccgugaucuacgacaguaaauucgaaaagcagcugggccaggugauguuacucguucuuugcgcugugcaguuauugcugaugcggaccagcugggcucucugugaggcccugacucuggcgacuggcccaaucaccacacucugggaaggcucccccggcaaguucuggaacaccaccaucgcaguguccauggccaacaucuuccgcgggucauaccucgccggggccggccuagcguuuagcauuaugaaguccgucgguaccggcaagcggggcacugggucacagggagagacucuuggugagaaguggaaaaagaagcugaaccaguuaucccgcaaggaguucgaccuguacaagaaauccggcaucacggagguugaccggacagaagccaaggaggggcugaaaaggggcgagaucacucaccacgcggugagccggggguccgccaaacuucagugguucgucgagcgcaacauggugaucccugaagggcgggugaucgaucucggcuguggucggggcggguggagcuacuauugcgccggacugaagaaggucacagaggugagagguuacaccaaaggggguccgggccacgaagaacccgugcccauguccaccuacggauggaauaucguaaagcugaugagcgggaaggacguauucuaccugccgccggagaaaugcgacacccuccugugugacaucggcgaauccagccccucccccaccguggaggagagccgcacgauccgcguccugaagaugguggagccuuggcucaagaauaaucaguucugcaucaaaguauuaaaucccuacaugccgaccgugauugagcaccuggagcggcuucaacgcaagcauggcggaauguuaguacggaacccccugucccgaaacagcacacacgagauguacuggaucucuaacggcaccggcaauaucgugagcuccgucaacauggugagccgacucuuguuaaaccgcuuuacgaugacccaccggcgaccgacaaucgaaaaggacguggaccucggcgcggggaccagacacgucaacgccgagcccgagacgcccaacauggacguaauuggggagcgaauuaagcggaucaaagaggaacacaacuccaccuggcacuacgaugacgagaacccuuacaagaccugggccuaccacgggagcuaugagguaaaggccacggggucugccagcagcaugauuaacggcguuguaaaacugcugacgaagcccugggaugucguuccuauggugacccaaauggcgaugaccgacaccacgcccuucgggcaacaacguguuuucaaagaaaaaguggauacccggacuccccgccccaugcccggaacucggaaaguuaugggcaucacggccgaguggcucuggaggaccuuagggcguaacaagcgcccccggcugugcacccgcgaggaguucaccaaaaagguccgcacgaacgccgccaugggcgcgguguucaccgaggagaaccaaugggacuccgccaaagcagccguggaggaugaggaauuuuggaagcucgucgaccgggagcgcgaacugcacaagcuggguaagugcggcagcugugucuacaacaugauggggaagcgggaaaagaaauugggugaguucggcaaggccaagggcucccgggcgaucugguacauguggcugggcgcccgcuaccuggaguuugaagcgcucgguuuccucaacgaggaccauugguuuucacgcgacaacuccuacucuggcguggagggagaggggcugcacaagcucggcuacauccugcgggacaucuccaaaauccccggcggugccauguacgcggacgacacggccggaugggacaccaggaucacugaggacgaccugcacaaugaggaaaagaucacccagcagauggaccccgaacaccgucagcucgccaacgcaauuuucaaacugaccuaccagaacaagguggugaagguucaacgccccacccccacggggacgguuauggacaucaucucacguaaggaccagcggggaagcggccaagugggcacguacgggcugaacacauuuacaaacauggagguccagcucguccggcagauggagggcgagggcgugcugucgaaggccgaccuggaaaacccacaccuccccgaaaagaagauaacgcaguggcuagaaaccaaggggguggagcggcugaaacggauggccaucucuggagacgauugcgucgugaagccgaucgaugaccgcuucgcgaacgcccuccuagccuugaacgacauggguaaggugcgaaaggacaucccacaauggcagccuagcaagggcuggcacgacuggcaacagguaccauucugcucccaccacuuccacgagcuuaucaugaaagaugggcgcaaguuagugguacccugucggccccaggaugagcugaucggcagagcccggauaagccagggugcgggauggucacuccgcgagacggcuugucugggcaaggccuaugcccagauguggagccugauguauuuccaccgacgggaccucagacuggccaguaacgccauauguagcgcagucccggugcauugggugcccaccucccggaccaccuggagcauacacgcccaccaccaguggaugacgacugaagauaugcuuacggucuggaaccgcguguggauagaggacaaccccuggauggaggacaagaccccagugaccacuugggaaaaugucccuuaccucgggaagagggaagaccaauggugcgggucgcuaaucggacucacgucucgcgccaccugggcgcagaacauccccacagcgauccagcagguccguagccuuaucgguaaugaggaguuccuugacuauaugcccuccaugaaacgguucaggaaggaggaggagucggagggagccauaugguga

SEQ ID NO: 26177 - RNA, 9873 nt, Artificial Sequence
  derived and/or modified CDS sequence (opt11) from DENV-3__KM190937__SS-prME
accucacugugccucaugaugaugcuucccgcuacccuagccuuccaccucaccagccgggacggcgagcccagaaugaucgugggcaaaaacgagcgaggaaagagcuugcuguucaagacugccuccgggaucaacaugugcacucucaucgccauggacuuaggggaaaugugcgaugacaccguuacguacaagugcccccacaucaccgagguggagccggaggacaucgacugcugguguaaucucaccagcaccugggugaccuacgggaccugcaaucaggccggcgagcaccgacgagacaagcggaguguggccaucgcgccucauguugggaugggguuagauacccgaacccagacuuggaugagcgcggagggugccuggcgccaaguagagaagguggagaccugggcucugcgccacccaggguuuaccauccuggcccucuuccuggcacacuacaucggcaccucccugacucagaaggucgugauuuucauccuccugaugcuggucacucccucuaugaccaugcggugcgucggggugggaaaucgcgacuucgucgagggccucagcggggcgaccugggucgacguuguccuggaacauggcggaugcgugacgaccauggccaaaaacaagcccacccuggacaucgagcuccagaagacagaagccacucaacuggcaacccugcgaaagcuaugcauagaaggcaagauaaccaacaucaccacagacagccgcugucccacgcaaggcgaggcgauucugccagaggagcaagaccagaacuacgugugcaagcacaccuacgucgaucggggguggggcaacgguugcggccuguucgggaagggcucccucgugaccugcgcaaaguuccagugccuugaguccaucgaaggcaaggugguccagcacgagaaccugaaguauacaguuaucaucacagugcauaccggggaccagcaucaaguuggcaacgagaugcaagggguuaccgccgagaucacaccgcaagccuccaccgcggaagucauccuccccgaguacggcacccuaggccuggaaugcagcccccgcaccgggcucgacuucaacgagaugaucuccuugaccaugaagaauaaagcguggaugguccaccgacagugguucuucgaccugccguugcccuggacgagcggagccaccgcagaaacccccaccuggaaucgcaaggagcuccuggugacauucaaaaacgcccacgccaagaagcaggaggucguagugcucgggagccaggaaggcgccaugcacacagcccugaccggugcgaccgagauccagacgagcggcgguaccuccauauuugccggacacuugaagugccggcucaagauggacaaacuggagcugaagggcauguccuaugccaugugccucuccuccuucgugcugaagaaggagguguccgaaacacagcacgggacgaucuugaucaaaguggaguacaagggcgaggaugcgccuugcaagauuccguuuaguacggaggacgggcagggcaaagcucacaacggccgcuuaaucaccgcuaauccugucgugacgaagaaagaggaaccggugaacauugaggccgagcccccguucggagagucaaauaucgucauaggcaucggggacaaagcgcugaagauaaacugguacaagaaaggcuccagcaucgguaaaauguucgaggccacagcgcggggugccagaagaauggcuauccugggagacacagccugggacuuugggucagugggcggggugcucaacagccucggcaagaugguacaccagaucuuuggguccgccuacacagcacuguucggcggcguuagcuggaugaugaagaucgggaucggcgugcugcuaacuuggaucggccugaacagcaaaaauacgagcaugaguuucagcugcaucgccauaggcaucaucacgcuguaccucggggcagucgugcaggcggacaugggcugugugaucaacuggaaaggcaaggagcugaagugcggcuccggcauauuugugaccaacgagguccauaccuggacugaacaguacaaguuccaggcagacagccccaagcgccuugccaccgccaucgcuggugcgugggagaacggcgugugcgggauccgcuccacgacccgaauggagaaccuccuguggaagcagaucgccaaugaacugaacuacauccucugggaaaacaauauaaaacugacagucgugguaggcgacaucacgggcguccucgaacaagggaagcgcacucucacgccacagccaauggaguuaaaguacuccuggaagaccugggggaaggccaagaucguuacagcggagacgcagaacuccucguucaucaucgacgggccgaguacuccagagugccccuccgcgucccgggcguggaacgucugggaggucgaggacuauggguucggcguguucacuacgaacaucuggcugaaacugcgcgagguguacacucagcugugcgaucaccgucuuauguccgccgccgucaaggacgagcgcgccgugcacgcggauaugggguacuggauugagagccagaagaacggauccuggaagcucgaaaaagcgagcuucauugaggugaagacgugcaccuggcccaagagucacacucuauggaguaacggcguccuggaguccgacaugaucauccccaaaagccucgccggccccauuucacaacacaaccaccggccugguuaccacacgcaaaccgccggcccguggcauuugggcaaacuggaacucgacuucaacuacugcgaagguacuacuguggugauaagcgaaaacugcggcacgagagggcccucccuucggacuaccaccguuucuggcaagcugauccacgaauggugcugccgauccuguacacuaccgccccuacgguacaugggggaagacggcugcugguacggcauggagauccgccccaucaacgagaaggaagagaacauggucaaaucucuggccagugcaggguccggcaagguggacaauuucaccauggggguccucugccuggcgauuuuauucgaggaagugaugcggggcaaguucgggaagauccacaugauagccgggguacucuucacuuucgucuugcugcugagcggacagauaacguggcgcgacauggcucauacgcucaucaugauagggucuaaugccagcgaccggaugggcaugggcgugaccuaucuggcgcucauagcuaccuucaagauccagccauuccuggcccugggcuucuuccucagaaagcugaccucccgagagaaccuacuccuggggguggggcuggccauggcggccacccuccgccugccugaggacaucgaacagauggccaacggaaucgccuugggguuaauggcccugaagcucauaacucaguucgagaccuaccagcucuggaccgcgcuggucagccugacguguuccaacacaaucuucaccuuaaccguggccuggcguacggccacgcugauucuugccggcaucagccugcugccugugugccaaucuucuucuaugcgcaaaacugauuggcugccgaugaccguggccgcgaugggggcccaaccccugccccuguucaucuucagccugaaggacacgcucaaacggagauccuggccccugaacgagggcgugauggccgucggacugguuucaaucuuggccuccagccuguugcguaaugaugugccgauggccgggccccucguagcgggcgggcugcugaucgcgugcuacgugaucacugguaccuccgccgaccucaccguggagaaggccgccgacguaacgugggaggaggaagcugaacagaccgggguaagccauaaccugauggugaccgucgacgacgacggcaccaugaggaucaaagacgacgagacggaaaacauccugaccgugcuccuuaaaacugcgcugcucauagucuccggcaucuucccuuauagcauucccgccacccugcuggucuggcacaccuggcagaaacagacucagcgcucaggggugcucugggacgugccguccccucccgaaacccagaaagcagagcuggaagagggcgucuaccggauaaaacaacaggggauuuuuggcaagacucaagugggugugggcgugcagaaggagggcguguuccacaccauguggcacgugacgcgcggggcuguccugacccacaacgggaagcgccucgagcccaacugggccagugugaagaaggaucugauauccuaugggggcggguggcgacugagcgcucaguggcaaaagggagaggaggugcaggucaucgcuguugagcccggcaagaaccccaagaacuuucagaccaugcccgggaucuuucaaacuaccaccggagagaucggggccaucgccuuggacuuuaagcccgguacauccggcucgccgauaaucaaccgggagggcaaggucguagggcuguacgggaacggcguaguaaccaagaacgggggcuacguuuccggcaucgcccagacgaacgccgaacccgacgggcccaccccggagcuggaggaggagauguucaagaaacgcaaccugacuauuauggacuugcaccccggcucugguaagacccggaaguaccuccccgcgauagugcgcgaagccaucaagcggcgccuucggacccucauacuggcgcccaccagaguggucgccgccgagauggaggaggccuugaaggggcucccgaucagguaccaaacaaccgccaccaaguccgaacacaccgggcgcgagaucguggaucugaugugccaugcgaccuucacgaugcgauugcucaguccuguaagagucccaaacuauaacuuaaucauuauggacgaggcccauuucacagaccccgccagcauagccgcacggggcuauaucagcacccgcguaggcaugggagaggcagccgccauuuucaugaccgccacgccgcccggcacagcggacgcauucccccagucuaacgcccccauccaggacgaggagcgugacauaccagaacgaagcuggaacuccgguaacgaguggauuaccgacuucguuggcaaaaccguaugguucgugcccagcauuaaggccgggaaugacaucgcuaacugccuucgaaagaacgguaagaaagucauccagcucucccggaagaccuucgacacugaguaccagaaaacuaaacugaaugacugggacuucgucgugacaaccgacaucucagaaaugggcgcgaauuuuaaagccgaccgcgugaucgacccuaggcgaugccugaagcccgucauucuuacggacgggccggagagggugauccuggccggccccaugccugugaccgucgccuccgccgcucagcgccggggucgcgugggacgcaacccacagaaggagaacgaucaauacaucuucaugggccagccgcugaacaaugacgaggaccacgcccacuggacggaggccaagaugcuccuggacaauaucaauacucccgagggaauaauccccgcucuuuucgaacccgagcgcgaaaaguccgcggccaucgacggcgaguaccgccucaaaggagagucccgcaaaacguucguggagcugaugcggaggggugaccugccgguuuggcucgcgcauaagguggccagcgaggggaucaaguacaccgaccggaaauggugcuuugauggcgagagaaacaaccagauacuggaggagaacauggacguugagaucuggaccaaggagggcgagaagaaaaagcugagaccacgcugguuagacgcccgcaccuauagcgacccccuggcgcuuaaggaguuuaaggacuucgcugccgggcguaagucuaucgcccuggaucuggugaccgagauuggccgcguuccuagccaccuugcccaccggacgcgaaacgcacucgacaaucucgucaugcugcauaccucugagcacgggggccgcgcguaccgccacgccguugaggaacucccggagaccauggaaacccugcuuuugcuggggcugaugauccuacugacgggcggugccaugcuguucuuaauaucggggaaaggcaucgguaagaccuccaucggccugaucugcgugaucgcuucuuccggcauguuguggauggcggauguccccuuacaauggaucgcaagugccaucgugcuggaguucuucaugauggugcuacucauucccgagccagaaaagcagcgaacaccccaggacaaccagcuggccuacgucgucaucgggauucugacccucgccgcgaucguggccgccaacgagaugggccugcuggaaacgaccaaaagggaccucggcaugucaaaggagcccggggucgugagccccaccuccuaccuggauguugaccuucacccggcgagcgcauggacccuuuacgccgucgccacgaccgugaucacccccaugcugcggcacaccaucgaaaauuccacggcgaacgugagccuagccgcaaucgccaaccaggccgucgugcucaugggccuggacaagggcuggccuaucuccaagauggaccuaggggugccccugcuggcccugggguguuacagccaggucaacccgcucacccuggccgcggccguccuguuacuugugacucacuaugccaucaucggccccggccugcaggccaaggccacccgcgaagcgcagaagcggacggccgccggcaucaugaagaacccaaccguagaugggaucaugaccauagaucucgacccaguaaucuacgauuccaaguucgagaagcagcugggccaggugaugcuguuagucuugugcgcuguccaauugcuccucaugcggacuucaugggcucugugcgaggugcuuaccuuggccaccgggccaauuaccacccugugggaggggucccccggcaaauucuggaacacaaccaucgccgucagcauggcaaauaucuuccgggggucuuaccucgccggugccgggcuggcauucuccauaaugaaaagcguggguacgggcaagcgggggaccgguucucagggcgagacgcuuggagagaaauggaagaagaaacucaaccagcugagccggaaagaguucgaccuguacaagaaguccgggaucaccgagguggaccgaaccgaagccaaggaaggucuaaagaggggcgaaaucacccaccacgccgucagcagagggagugccaagcuacagugguucguggaacggaacaugguaauccccgagggccgcgucaucgaccugggguguggccggggcggguggagcuacuacugugcggggcucaagaaggugacggaggugcgcggauacacuaaaggcggccccgggcacgaggagccgguccccaugucgaccuacggguggaacaucgugaagcugaugagcggcaaagacgucuucuaccucccgcccgaaaagugcgauacgcucuuaugcgacaucggcgaguccagccccucgcccacuguggaagagagccggacuauacgggugcucaagaugguggagcccuggcugaagaauaaucaguucugcauuaagguucucaaccccuauaugccgacggugauagaacaccuggagcgccugcagcgaaaacaugggggaaugcucgucagaaauccccuuucccggaauagcacgcaugaaauguacuggaucuccaacgggaccggcaauauugucagcuccgucaacauggugagccgccuccuccugaacagauucaccaugacccaccgacggcccacgaucgagaaggacguagaccuuggcgcagggacccgccacguaaaugccgagcccgagacgccgaauauggacguuauuggcgagcggauaaagcgcaucaaggaggaacacagcuccaccuggcacuacgacgacgagaaccccuacaagacaugggcguaccacgguagcuaugagguuaaggcaacaggauccgcgucgucuaugaucaacggcgucgucaagcuccuuacuaagccuugggacgucgugccgauggucacacagauggccaugaccgacaccacgcccuuuggccagcaacggguuuucaaagagaaggucgacacgagaacgccccggccaaugccaggcacccgcaaggucauggagaucaccgcagaguggcuguggagaacccucgggcgaaacaagcggccccgcuugugcacaagagaggaguucacaaagaaggugcggacaaacgcagcuaugggugccguguucaccgaggagaaccaaugggacagcgcccgagcggccguggaggacgaggaguucuggaaacucguggaucgggagcgcgaacugcacaagcuggggaagugcgguucuugcguguacaauaugauggggaaaagggagaagaaacugggcgaauuuggcaaggcgaaggggagccgagccaucugguacauguggcucggcgccagauaucucgaguucgaggcccugggguuccucaaugaggaccacugguuuuccagggagaacucuuauuccggcguugaaggggaggguuugcacaagcugggcuacauccugagagacaucagcaagaucccuggcggugcuauguacgcggaugacaccgcugggugggauacccgcaucacggaggacgaccugcacaacgaggagaagaucacucagcagauggacccagagcaccggcagcuggccaaugccaucuucaagcucaccuaccagaacaagguggugaagguccagcgcccgaccccaaaaggcacggugauggauauaaucucgcggaaagaccagagaggcuccggccaggugggcaccuauggacuuaacacuuuuacuaacauggaagcccagcugauacggcagauggagggcgaggggguccucucuaaagcugaccuggagaacccccacccccuggagaagaagaucacgcaguggcucgagaccaaggggguugagcgccugaagcguauggcuaucagcggggacgacuguguggucaagccgauugacgaccgcuucgccaacgcccuacucgcccugaaugacauggguaaggugcggaaggacaucccgcaguggcagcccuccaagggauggcacgauuggcagcaggucccuuucugcucucaccacuuccacgagcugauaaugaaagacgggcgcaaacucgucgugccuugccggccccaggaugaguugaucggccgcgcucgcaucagucagggggccggcuggucucugcgggagacggcgugccucggcaaagccuacgcucagaugugggcucugauguacuuccaucgccgggauuuacgucucgcaagcaaugcuaucuguuccgccgugcccguacacuggguccccacuucccguaccacgugguccauccacgcgcaccaccaguggaugaccaccgaggacaugcugaccguguggaaccgcguuuggauagaggacaacccguggauggaggacaagacgcccgugacgaccugggaggacgugcccuacuuagggaagagggaggaccaguggugcggcagucucauaggacucacuucccgugccacgugggcccagaacauccugacggccauccagcaaguuaggagcuugaucggcaaugaggaguuccuggacuauaugccauccaugaagcgcuucaggaaggaagaggagagcgagggcgccauaugguga

SEQ ID NO: 26178 - RNA, 9873 nt, Artificial Sequence
  derived and/or modified CDS sequence (opt11) from DENV-3__JQ920487__SS-prME
accagucugugccucaugaugaugcugcccgccacucuggccuuccaucucaccagcagagauggcgaaccacggaugaucguugggaaaaacgaacgcggcaaaucccuacuguucaaaaccgccagcgggaucaacaugugcacccugaucgcuauggaucuaggcgagaugugcgacgacaccgucacuuacaaaugcccguuaauuaccgaaguugagcccgaggacaucgacugcugguguaaccucacuuccaccugggucaccuaugggaccugcaaccaagccggcgagcaccgaagagauaaacgcucgguggcccuggcgccccaugugggcauggggcuggacacccgcacucagacuuggaugagcgcggagggagccuggcgucagguugagaaagucgagacaugggcauuccgccaccccggguucaccauccuugcccuguuccuugcgcauuacaucgguacuucucugacgcagaaaguugucaucuucauccugcugaugcucgucacccccagcaugaccaugcggugcgugggagugggcaacagagauuucgucgagggccuguccggggcaaccuggguggacgugguccuggaacacggcgggugcgugacgaccauggccaaaaacaaacccacccucgacaucgagcugcagaagacugaggccacgcaguuggccacccuccgaaagcuauguauagaggguaagaucaccaauguaaccaccgacucccgcugccccacccagggggaagcgauccuuccugaggaacaggaucagaauuacgucugcaagcacaccuauguagaccggggguggggcaacgggugcggccucuucgguaaaggcucgcuggugaccugcgccaaauuccagugccuggaaucgauagaggggaaggccguccagcaugagaaccucaaguacacggugauaaucaccgugcacaccggggaccagcaccaggucgguaacgagacgcagggugugacggcagagaucacgccacaggccucgacaguagaggcgauacugcccgaguacggcacccuggggcuugagugcagcccacgcaccggccuggauuuuaacgagaugaucuuacuuacgaugaagaacaaggccuggauggugcaccgucagugguucuucgaucuaccgcuaccauggaccagcggcgcgaccaccgagacacccacguggaauaagaaggaguuacuggugaccuucaaaaacgcccacgcuaagaagcaggagguaguugugcuaggcagccaggagggcgcuaugcacacggcccucacgggggccaccgagauccagaccuccggagggaccuccauuuucgccggccaccugaaaugucgccuaaagauggacaagcucgagcugaagggcaugaguuacgcgaugugucucaacgcguuuguccucaagaaagaagugagcgagacucagcacgggaccauucugauaaaaguggaauauaagggcgaagacgccccuugcaagaucccguucagcaccgaggauggccagggcaaagcccacaacggucgauugaucaccgccaacccuauagucacgaagaaggaggagccagugaacaucgaggcggagccuccguuuggagagucgaacaucgugaucggcaucggggacaaggcccugaagaucaauugguacaagaagggcagcagcaucgggaagauguuugaagcgaccgccaggggcgcacggcgcauggcuauccucggugacaccgcgugggauuucggaagcgugggcgggguucugaacucccugggcaagauggugcaccagaucuucgggagcgccuacaccgcucucuucuccggcguaagcuggaucaugaagaucggcaucggggugcugcuaacuuggaucggcuuaaacuccaagaacaccagcauguccuucagcugcaucgucauugggaucaucacccucuaccugggggccgucgugcaggcugacaugggcugcgugaucaacuggaagggcaaggaguuaaagugcgguagcgggaucuucgucacuaacgaagugcacacauggaccgaacaauauaaguuucaggccgauucgccgaagcggcucgcaacagccaucgcgggcgcgugggagaacggcgugugcgguauucgcucaacuacccgaauggagaaccugcucuggaagcagaucgcuaacgaauuaaacuacauucugugggagaacaacaucaaguuaaccgucguggugggggacgucaucggcgugcuagagcaggggaagcggacucugacgccacagcccauggagcucaaguacagcuggaaaacguggggaaaggccaaaauaguuaccgccgaaacucagaacuccagcuuuaucauugaugggccgaacacccccgagugccccuccgcgucacgcgcuuggaauguaugggaggucgaagacuacggguucggcguuuucacuaccaacaucugguugaagcuacgggagauguacacccagcucugugaccaccgcuugaugucagccgccguuaaggacgaacgggccgugcacgcggacaugggcuacuggaucgaaucccagaagaacgguagcuggaagcuggagaaagcaucccugauagagguuaagacuugcaccuggcccaagagccacacucuguggucgaauggcguccuggagagugacaugaucauccccaaaucccucgccgggccuaucagccaacacaacuaccgacccggcuaccacacccagacugccgggccguggcaccugggcaaacuugaacucgacuucaacuauugcgaggggacaacgguggugauaaccgagaacugcggcacccggggccccucccugcgcaccacuacagucagcgguaagcugauccaugaguggugcugccgcuccugcacauugccgccgcuccgcuacaugggugaagacgggugcugguacggcauggagauccggccgaucaaugagaaggaggagaauauggucaagagccuugugucggcaggaagcgggaaggcggauaacuucaccaugggcgugcuguguuuagccauuuuguucgaggagguuaugcgggggaaguucgggaaaaagcacaugaucgccggggcccucuucaccuucgugcugcuguuaaguggccagaucacauggcgagacauggcccacacccugaucaugaucggaagcaaugccuccgauaggauggggaugggcguaaccuacuuggcauugauagccacguuuaagauucagcccuuucuggcccugggguucuuucuuagaaagcugaccagccgcgagaaccugcuucugggggugggccuggccauggcuaccaccuuacagcugcccgaggacaucgagcagauggccaacgguauagcccucggccucauggcccuuaagcucauuacgcaguucgaaacuuaccagcuauggacagcgcucgucucccugaugugcuccaacaccaucuucacgcucaccgucgcauggcguaccgccacacugauccuggccgugaucagccuucuucccgugugccaguccucguccaugcgaaagacggacuggcugccgaugacuguugccgcgauggggguaccgccccucccccuuuucaucuucagccucaaagacacccuaaagcggcgauccuggccgcuuaacgagggagucauggccguggggcucgugaguauccucgccuccucuuuccuacggaacgauguucccauggccggcccccugguugccggagggcugcugaucgcgugcuacgugaucaccggcacuagcgccgaccugaccgucgagaaggcagccgacgugaccugggaggaggaggcggaacagaccggggugagccacaaccucaugaucacggucgacgacgacggcacgaugcggaucaaggaugacgagaccgaaaacauccuuaccgugcugcucaaaaccgcucuacugaucgugucagggaucuucccguauagcaucccugccacguuacugguguggcacaccuggcagaagcagacccagcgcaguggcgugcugugggacguuccuagcccacccgagacacagaaggccgaacucgaggagggggucuaccggaucaaacagcaggguauuuucggcaagacccaggugggggugggcguccagaaagagggcguguuucacacuauguggcacgugacacgcggcgccguucugacacacaaugguaaacgguuagagccuaauugggcgaacgugaaaaaggaucugauuuccuacggcggcggguggaaacuaucagcccaguggcagaagggagaagaggugcaagucaucgcgguggaaccagggaagaacccuaagaacuuccagaccaugcccggcaucuuccaaaccaccacgggcgagauaggggcuaucgcucuggacuuuaagccgggcacaucugggucccccaucaucaaccgcgaggguaaggugguaggccuguaugggaacgggguggugacuaagaacggaggcuacguaagcgggauugcgcagaccaacgcagagcccgacggcccaacccccgaacucgaggaggagauguucaagaagcggaaccugacgauuauggaucuacacccuggcagugggaagacccgcaaguaucuccccgccaucguacgggaagccaucaagcgucgguugcgcacccugauucucgcaccgacccgggugguugcggccgagauggaggaggcccugaagggucugcccauccgcuaccagacgaccgccaccaagagcgagcacaccggucgggaaauuguggacuuaaugugccaugcuacguucaccaugaggcugcuauccccugugagaguccccaauuauaaucucauagugauggaugaagcgcacuucaccgauccggccagcaucgccgcucgcggauauaucuccacccgggucgggaugggcgaagcugccgcaaucuuuaugacggccacaccacccggcaccgcugacgccuucccucagagcaacgccccgauacaggacgaggagcgcgacauccccgagcgguccuggaacucagggaacgaguggaucacggacuucgccggcaagacgguaugguucgugcccuccauaaaagccggcaacgacaucgcaaauugccuccggaaaaacgggaaaaaggugauccagcugagccgcaaaacauuugacacggaguaccagaagaccaagcucaacgacugggacuucguugugacgaccgauaucuccgaaaugggggcgaacuucaaagccgaccggguuaucgacccccgccguugccucaagccggucauccugaccgacggcccggaacgcgugauccucgccggcccgaugccugugacggucgccagcgcugcgcaacggcgggggcgggugggccgcaauccgcagaaagaaaaugaccaguacaucuucacggggcaaccccugaacaaugaugaggaccacgcacacuggaccgaggcuaagaugcuuuuagauaacaucaauacccccgagggcaucauccccgcucucuucgagccagagcgggagaaguccgcggcgauagacggugaguaucgcuuaaagggcgagucgcggaagaccuucgucgagcuaaugagacggggcgaccucccggucuggcuggcccacaaaguggccucugagggcaucaaguacaccgacaggaaguggugcuucgauggcgagcggaacaaccagauccucgaggagaacauggacguugagauauggacgaaggaaggggagaagaagaagcugcgccccagauggcuggacgcacguaccuacagcgacccccucgcguuaaaggaguucaaagacuucgcggccggacggaaguccaucgcccuggacuuaguuaccgaaaucggccgugugccgucgcaccuggcccaccguacccggaaugcccuagauaaucucgucaugcugcacacguccgagcacgggggccgcgccuaccgccacgccguggaggagcugccugagaccauggagacccuccugcuccucgggcucaugauuuuguuaacgggcggagccauguuguuucugaucagcgggaagggaauugggaagacgagcaucggccuaaucugcguugucgccucgucugggaugcuguggauggcggacgugccccugcaguggauugccucugccaucgugcucgaguuuuucaugauggucuugcugaucccggaacccgagaagcagcgcacgccccaagauaaccaguuggcguauguagugaucggcauccuuacucuggccgccauagucgccgccaaugaaaugggguuacuggagaccacgaagcgggaucuuggaaugagcaaggagcccggcguggugucgccgaccagcuaccuagauguggaccugcaccccgcuuccgcuuggaccuuguacgccguugcgacuacggugauaacacccaugcuccgccacaccaucgagaacaguaccgcaaacgucuccuuagccgcgaucgccaaucaagcugucguucugauggggcucgacaagggcuggccaaucagcaaaauggaccuggggguaccgcugcucgcccugggaugcuacucccagguaaauccucugacgcucaccgccgcggugcugcugcucgucacccacuaugccaucaucggcccagguuugcaggccaaagcgacccgggaggcccagaaacgcacggcugcagggaucaugaagaaccccaccguggacgggaucaugaccaucgaccuggacccggugaucuacgauagcaaguucgagaaacagcucggccaggucaugcugcugguccucugugccguacaacugcugcucaugcgaaccaguugggccuucugcgaggcgcugacgcuggcuaccggacccaucaccacccucugggaagggagccccggcaaguuuuggaacacgaccaucgccgucuccauggccaacauauuccgcgggagcuaccuggccggagcggggcuggccuucuccauuaugaaguccgugggcaccgggaagcggggcacaggcucgcagggggagacacugggcgagaaguggaagaagaagcucaaccagcuuagccggaaagaguucgaccuguacaagaaguccgggaucaccgagguggaccggaccgaggccaaagaaggccugaagcgcggggagaucacccaucacgcuguauccaggggcagugcuaagcugcagugguucguggagagaaacauggugaucccagaggggcgggucaucgaccucgggugcggacgcgggggcuggucguacuacugugcggggcugaagaagguaaccgaggugcggggcuacacgaagggcgggccgggccacgaggagcccgucccaaugagcaccuacggauggaacaucguuaaguuaauguccggaaaagacguauucuaccucccgccagagaagugcgacacccugcuaugcgacaucggugagagcagucccagcccuaccgucgaggagucccgcacuauccggguguugaagaugguggagccuuggcucaagaauaaccaguucugcauuaaaguccuuaaccccuacaugcccaccgugaucgaacaccuggaacgccuccaaagaaagcacggcggcaugcuuguccgaaacccacuguccaggaacuccacccacgaaauguacuggaucagcaaugggaccggaaacaucgucucaagcgugaauauggugucccggcuccugcucaaucgcuucacgaugacccaucggaggcccaccaucgaaaaggauguggaccucggagcuggaacccggcacgugaacgcugaacccgagacgcccaauauggacgucaucggcgaacgaaucagacgaaucaaggaagaacacagcucgaccuggcacuaugacgacgagaacccguacaagaccugggccuaccaugggagcuacgaggugaaggcgacuggguccgcuagcucuaugaucaacggggugguaaaguuguuaacgaagccgugggacguggugcccaugguuacgcagauggccaugaccgacaccacgcccuucggccagcaacgggucuucaaagagaagguagacacacgcacgccccgcccaaugcccgggacccguaaagugauggagaucacagccgaauggcucuggcggacgcuugggcgcaacaagcggccccgccugugcacccgugaggaguucaucaagaaggugcgcaccaacgccgcgaugggggcgguuuucacggaggagaaccagugggacagcgcccgcgccgccgucgaggacgaggaguucuggaaacucguggaccgugagcgcgagcugcacaagcucgggaagugcgguagcugcguguacaacaugaugggcaagcgggagaagaaacucggcgaguucgggaaggcgaagggcucgcgcgcgauaugguacauguggcugggcgcaagauaccucgaguucgaggcccucggcuuccugaacgaagaccacugguucucgcgcgagaacagucacaguggcgucgagggggagggccuacacaagcugggguacauccugcgggacaucuccaagaucccuggaggggccauguaugcggacgacaccgcugggugggacacccgcaucaccgaggacgaucugcauaacgaggagaagauuacgcagcagauggauccggaacaccggcagcucgcgaacgcaauuuucaagcugacguaucaaaacaaagugguuaagguccagcgcccaacccccaaggggaccgugauggacauuaucagccggaaagaccagcgagggucgggccagguaggcacguacgggcugaacacauucaccaauauggaagcccagcucauccggcagauggaaggcgagggaguacugagcaaggcggaccuagagaacccucaccuccuggagaagaaagugacucaguggcuggagacgaaaggcguggagcgcuugaagcggauggccaucuccggggacgacugugucguaaagccgauagacgaccguuucgccaacgcccugcucgcccucaaugacaugggcaaaguucguaaagacauaccccaguggcagcccagcaagggguggcacgacuggcaacagguccccuucugcucccaccacuuucaugaacugauuaugaaggacgggcgcaagcuagucgugccgugccgcccccaggaugagcucauagggcgggcgagaaucucucagggagcaggcuggucgcuccgcgagacggcuugccugggcaaggcuuacgcgcaaaugugggcucucauguacuuccaucgccgggacuuacgccuggccagcaaugcaauaugcucugccguacccgugcacugggugccaacgagccggaccaccugguccauucacgcccaccaccaguggaugacuacagaggacaugcucaccgucuggaacagggucuggaucgaggacaacccguggauggaagacaagacccccgugacgaccugggaagacguuccuuaccuggguaagcgagaggaccaguggugcggcagucugaucgggcucacaaguagggcaaccugggcccagaacauccuaaccgccauccagcaaguucggagccugaucggcaaugaagaguuccucgacuacaugccaagcaugaagcgcuuuaggaaggaggaggaguccgagggcgcuauaugguga

SEQ ID NO: 26179 - RNA, 9873 nt, Artificial Sequence
  derived and/or modified CDS sequence (opt11) from DENV-3__JQ920488__SS-prME
acuucgcugugucugaugaugauguuacccgcuacucuggccuuccaccucaccagccgagacggagaaccccggaugaucgugggcaaaaacgaacggggcaagagccugcuguucaagaccgccuccggcaucaacaugugcacauugaucgcgauggacuugggcgaaaugugcgacgacaccguaaccuacaagugcccccugaucacugaagucgaacccgaggacaucgacugcugguguaaccucaccagcaccuggguuacguacgggacuugcaaccaggcaggggagcaccgacgagacaagcgcuccguggcguuggcgccucacguaggcauggggcuggacacccgcacacagacguggaugagcgcggagggcgccuggcgccagguugaaaaggucgagaccugggcauuucgccaccccggauucacgauccucgcccucuuccuggcacacuacauuggcaccucccucacgcagaaagucgugaucuucaucuugcugaugcucgucacacccaguaugaccaugcggugcguggggguuggcaaccgcgacuucgucgagggccuuucgggagccaccuggguggaugugguccuggagcacggcggaugcguaacgacuauggccaaaaacaagcccacgcucgacaucgaacugcagaagacugaggcaacucagcuggccacacuccggaagcuguguaucgagggcaaaaucacaaacgugaccacggacagccgcugcccgacucagggcgaggcaauucugcccgaggagcaggaccaaaacuacgucuguaagcacaccuacguggaccggggguggggcaaugggugcggucucuucggcaaggggucccugguuaccugcgccaaguuccagugccuggagagcaucgaaggcaaggcuguccagcacgagaaccucaaguacacggugaucaucaccguacauacaggggaccagcaucagguuggcaacgagacccagggggugacggccgagauaacaccccaggccuccaccgucgaggcaauauugcccgaguacggcacccuggggcucgagugcagcccccgcaccggccuggacuucaacgaaaugauccugcucacgaugaagaauaaggccuggauggugcaccgacagugguucuuugaccuuccgcugccauggacguccggcgccaccacagagacgccuaccuggaacaagaaggaguuacuggugacuuuuaagaacgcucaugcuaagaagcaggaggucguggugcuggggagucaggagggggcaaugcacaccgcccucacgggugccaccgaaauccagacuucgggcgggaccagcaucuucgcuggccaucugaagugucggcuuaagauggacaagcucgagcugaagggcauguccuacgccaugugcuuaaacgcguuuguacucaagaaggagguuagcgagacgcagcacgggaccauucugaucaagguggaguacaagggcgaggacgcccccuguaagauucccuuuagcacugaggacgggcagggcaaggcacacaacggacggcuuaucaccgccaaccccaucgucacgaagaaggaggagcccgugaacauagaagcugagccaccguucggggaguccaacaucgugaucggcaucggggacaaagcccugaagaucaacugguacaagaaggggucauccaucgggaagauguuugaagccaccgccaggggcgcccggcgcauggcgauccucggcgacaccgcaugggacuucgggagcgucggcggggugcugaacucccugggcaagaugguacaccagaucuucggcagcgccuacaccgcccucuucuccggcgucagcuggaucaugaaaaucggcauagggguucuguugacguggaucggccucaacucuaaaaauacaagcauguccuucagcugcauugugaucgggaucaucacccuuuaccugggcgcugucgugcaggcggauauggggugcgugaucaacuggaaggggaaggagcucaagugcgguagcgggaucuucgugaccaacgaggugcacacguggaccgagcaauauaaguuccaggccgacagccccaagagguuggccaccgcaaucgcaggcgcgugggagaacggggugugcggcaucagguccaccacgaggauggagaaucuguuguggaagcagaucgccaacgaacugaacuacauccugugggagaauaauaucaagcucacuauuguuguaggcgaugugaucgggguccuggagcaggguaagcggacccugacgccccagcccauggagcucaaguacucauggaagacgugggggaaggccaagaucgugaccgccgagacccagaacuccagcuuuaucaucgacggcccuaacacccccgaguguccauccgcgcugcgcgcuuggaacgugugggaggucgaggacuauggguucggcguguuuacgacgaacaucugguuaaaacuucgagagaaguacacccagcugugugaccaccgucugaugagcgcagccgugaaggacgaacgagcgguccaugccgacaugggcuacuggaucgagagccagaagaacgaguccuggaaacuugagaaagcuagcuugaucgaggugaaaacaugcaccuggcccaagucucauacgcuauggagcaacgggguccuagaauccgacaugaucaucccaaagagccuggcgggcccuaucucccagcacaacuaccgcccgggguaccacacccagaccgccggcccguggcaccuggggaaacucgagcuggacuuuaacuacugcgaaggcaccacgguagugaucaccgagaacugcggcauccgggggcccucgcugcgcaccaccacaguguccggcaaacucauccacgaauggugcugccguagcuguacccugccgccccugcgcuacaugggggaggacgggugcugguacgggauggagaucaggccgaucaacgagaaggaagagaauauggucaaguccuuggugucugccggcuccggcaagaccgacaauuucaccauggggguacugugccuggcgauccucuucgaggagguaaugcgcggcaaguucgggaaaaagcacaugauagccggcgccuuguucacguucgugcuguuacugagcggucaaaucacauggcgggacauggcucacacccugaucaugaucggcuccaacgcaagcgaccgcaugggcauggggguaaccuaccucgcucuaaucgcaacauucaagauucagcccuuccuagcccucggcuucuuucugaggaagcugaccucccgugagaaucuccugcuggggguaggccuggccauggcuaccacccugcagcugcccgaagacaucgaacagauggcuaacgggaucgcccuuggguugauggcccugaaacuaaucacgcaguucgaaaccuaucaacucuggaccgcccugaucagccucauguguuccaacacgaucuucacgcugaccguggcguggcggaccgccacccugauccucgcugugaucucccuacugcccgucugccaaagcucaagcaugaggaagacggacuggcucccgaugaccguggccgccaugggugugccgccccugccccuguucaucuuuuccuugaaggacacccugaagcgacguagcuggccgcugaacgagggggucauggccgugggccucguuuccaucuuagcaagcuccuuccugcgcaacgacgugcccauggccgggccccucguggccggcgggcuacugaucgccugcuacgucaucaccgggacgucagccgaccucaccguggagaaggccgccgacguaaccugggaggaagaggccgagcagacuggcgucucccacaaccugaugaucacgguugaugacgacggcaccaugcguauaaaggacgacgagaccgagaacauccugaccgugcuccugaagacggccuuacucaucgucucgggcaucuuccccuacucgaucccggcgacucugcugguguggcacaccuggcagaagcagacccaacgcagcggcgugcucugggacgugccgagcccgccugagacccagaaggccgaguuagaggaaggcguguaccggaucaagcagcagggcaucuucgggaagacccaggugggugucggggugcaaaaggagggcguauuccacaccauguggcacgucacaagaggggccgugcugacucauaacggcaaacggcuugagccgaacugggcaaacgugaagaaggaccugauuagcuacggaggaggcuggaaguuaggggcgcaguggcagaagggcgaggagguccaagugauugccguggagccggggaagaaccccaagaacuuucagacgaugcccggaaucuuucagaccaccacuggcgaaaucggggccaucgcccuggacuucaagccgggcacguccgggucucccaucaucaacagggagggcaaggucgugggccucuauggcaacggcguggucaccaagaaugggggcuacguguccgggaucgcccagaccaacgcggagcccgacgguccgaccccggagcuggaggaagaaauguucaagaagcggaaucugacgaucauggaucuccaccccggcaguggaaagacccgcaaguaccuacccgcuaucgugcgggaagcuaucaagcgccggcugcguacgcucauccuggccccuaccagggucguggcagcggagauggaagaggcccugaagggccuccccaucagauaccaaacgaccgccaccaagagcgagcacaccgggcgggagaucguggacuugaugugccacgccacguucaccaugcgccugcucuccccaguccgggugcccaauuacaaccugaucgugauggaugaagcccacuuuaccgauccggcguccaucgccgcccgcggcuacaucucuacccgcgucgggaugggcgaagcagcggccauuuucaugacugcgacgccgcccggcacagccgacgccuucccccagagcaacgcuccgauccaggacgaggagcgcgacaucccugaacgguccuggaacagcggcaacgaguggaucaccgauuucgccggaaagacggugugguucgugcccuccaucaaggcagggaaugacaucgccaacugucugagaaagaauggcaagaaaguaauccaacucagcaggaaaacguucgacaccgaauaucagaagaccaagcugaacgacugggacuucguggugacgaccgacauuuccgagaugggugccaacuuuaaggcggaccgggucauugacccacggcggugccugaagccagugauccucaccgauggacccgagcgagugauucuggccggccccaugcccgucaccguggccucugcugcucagcggcgagggcgggugggccguaacucccagaaggagaacgaucaguauaucuuuacagggcagccgcuaaacaacgacgaggaccaugcgcacuggaccgaggccaaaaugcuccuggacaacaucaauacccccgagggcaucauccccgcccuguucgaaccagagcgggagaaguccgccgccaucgacggugaguaccgccuuaagggcgaaucccggaagaccuucgucgaacuuaugcgccggggcgaucuaccggucugguuagcccacaagguggccagcgagggaaucaaguacaccgacagaaaguggugcuuugauggagagcggaacaaccagauccuggaggagaacauggacguagagaucuggacgaaggagggggaaaagaagaagcugcgcccccgguggcucgacgcccgcaccuacucggacccccuggcacugaaagaguuuaaggacuucgcggccggcagaaagucuaucgcacuggaucugguaaccgagaucggccgcguccccucccaccuggcccaucgcacccggaacgcccucgacaaucuggugaugcugcacacgagcgagcacgguggccgcgcguaccggcacgccgucgaggagcucccggagaccauggagacucuacugcuucuggggcugaugauccuccuuaccgguggagccaugcuguuucucauuuccggcaagggcaucgggaaaacgagcauaggccugaucugcgucgucgccagcuccggcaugcuguggauggccgacgugcccuugcaguggauugcgagcgccauuguccuggaauuuuucaugauggugcuccucauccccgagccggagaagcagcgcacgccccaggacaaucaacuggccuacguggucaucggcauccugacacucgccgccaucguggcggcuaacgagaugggacugcuggagaccacgaaacgggaucucggcauguccaaggagcccggcguggucagccccaccuccuaccuggauguugaucugcauccggcuagcgccuggacccucuaugcgguggcuaccacgguaaucacgccgaugcugcgccauacaaucgagaacuccacggccaaugugagccuggccgccauugcgaaccaagccgugguacucauggggcuggacaaaggcuggcccaucuccaagauggaucugggggugccccuccuggcccugggcugcuacucccagguuaacccccucacgcugaccgccgccguccuccugcuggugacgcacuacgcgaucaucgggccgggccugcaggccaaggccacccgcgaggcccaaaagcgcacggcggcgggcaucaugaagaacccaaccguugaugguaucaugaccaucgaccucgaccccgugauauaugacuccaaguuugagaagcagcugggacaggugaugcugcuugugcugugugccguccagcugcuucugaugcggacaagcugggccuucugcgaggcccugacucuugcgaccgggccgaucaccacccugugggagggcuccccgggcaaguucuggaacacgacaaucgccgugucaauggccaacaucuuccgcgggaguuaccuggccggcgccgggcucgcguucagcaucaugaaguccgugggcaccgggaagcgcggcaccggcagccagggggagacguuaggcgagaaauggaagaagaaacugaaccagcucuccagaaaggaguucgaccuguacaagaaguccgggaucaccgaaguugaccggacugaggccaaggaaggucugaagcgcggggagauuacacaccaugccgugagccggggcuccgccaagcuccagugguucguggaacgcaacauggugauccccgagggucgggugaucgaccuggguugcggccgugggggauggagcuauuacugcgccgggcuaaagaaggugaccgagguacgaggcuacacgaagggcgggcccggccacgaggaacccgugcccaugagcaccuacggguggaacaucgugaagcucaugagcggcaaggacguguucuaccugccucccgagaaaugugacacccugcugugcgacauaggggaauccagcccuuccccaaccguggaggagagccgcacgaucagggugcucaagauggucgagccguggcuaaagaacaaucaguucugcaucaaggugcugaaucccuacaugccgaccgugaucgagcaccucgagcgccugcagcgcaagcacggcggcaugcugguccgcaaccccuuaucccgcaacagcacccaugagauguacuggaucucgaaugggaccgguaacaucgugagcagugugaacauggucagucgguuacugcuuaaucgcuucacgaugacucaccggcgccccaccaucgagaaggauguggaccugggggcggggaccagacacgugaacgcggaacccgagacgccgaacauggacgucaucggcgagcgcauacggcgcauaaaggaggagcacucuagcaccuggcacuacgacgacgagaaccccuacaagaccugggcauaucauggguccuaugaggugaaggccaccggcagcgcauccagcaugaucaacggggugguaaagcugcugacgaagcccugggacgugguaccuauggugacccaaauggccaugaccgacaccacgcccuucggccaacagcguguuuucaaggagaaagucgacacucggacgccucggccuaugccggggacccgcaaggugauggagaucaccgcugaguggcuguggcggacccugggccgcaacaagcggccccgcuuguguacgcgcgaggaguuuaucaagaaagugcgcacuaacgcggccaugggagcaguauucacggaggagaaucagugggauagcgcccgcgcagccgucgaggacgaggaguucuggaagcuggucgaccgggaacgcgagcugcacaagcuagggaagugcgguuccugcgucuacaacaugauggggaagcgggagaagaaacugggugaguucgggaaggccaaaggcagccgcgcgauuugguauauguggcugggagccagguauuuggaguucgaggccuugggguuccugaacgaggaccauugguucagucgcgagaauagccacuccggcguggagggggagggguuacacaagcugggguacauacugagggacauuagcaagauccccgggggcgccauguacgccgacgauaccgcggguugggacacccgaaucaccgaggaugaccuccacaacgaggagaaaaucacccagcaaauggaccccgagcaccggcagcuggcaaacgccaucuucaaguugaccuaucagaacaagguggucaagguccagcgcccgacaccgaagggcaccgugauggacaucaucucccgaaaagaccaacgcgggagcggccaggucggcacguacgggcucaacacuuucaccaacauggaagcgcagcugauccgacaaauggagggggagggugugcuguccaaggccgaccuagagaacccccaccuccuggagaagaaggugacccaguggcucgagaccaagggcgucgagcgccugaagcgcauggcgaucucgggggacgacugcguugugaagcccauugacgaccgcuucgccaaugcuuuacuugcccugaacgacaugggcaagguccggaaggacaucccgcaguggcagcccuccaagggcuggcacgacuggcagcagguccccuucugcagccaccacuuccaugagcugaucaugaaggacgggcgcaaacucguaguccccugccguccgcaggacgagcugaucggccgcgcccggaucucccaaggggcgggauggucgcugagggagacggccugccucgggaaggccuacgcccagaugugggcucugauguauuuccaccgccgggaccuucgccucgccuccaacgccauauguagcgccgugcccguacauuggguccccaccucccggaccacuuggucuauccacgcccaccaccaguggaugaccaccgaagacauguugaccguguggaaccggguguggaucgaggacaaccccuggauggaggacaaaaccccggucacgaccugggaggaugugcccuaccugggcaagcgggaggaccaauggugcggcagcuuaaucgggcugaccagccgcgcgaccugggcccagaacauccuaaccgccauacaacagguccggagccucaucggcaacgaagaguuucuggauuacaugcccuccaugaaacgcuuccggaaggaggaggagagcgagggggccauaugguga

SEQ ID NO: 26180 - RNA, 9873 nt, Artificial Sequence
  derived and/or modified CDS sequence (opt11) from DENV-3__JQ920489__SS-prME
accagccucugccucaugaugaugcugcccgccacgcuggccuuccaucucaccagccgggacggcgagccgcggaugaucguggggaagaacgagcggggcaagucgcugcuguucaaaaccgccagugggaucaacaugugcacccucaucgcuauggaccugggcgagaugugcgacgauaccgugaccuacaagugcccgcugauaacagagguggaaccagaggacaucgauugcuggugcaacuuaacauccaccugggugacuuacgggaccugcaaucaagccggcgagcaccgcagagacaagcgguccguggcccuggcuccccaugugggcaugggccuggacacccgcacccaaacguggaugucggcggagggcgccuggcgccagguggagaaggucgagaccugggcauuccgacacccaggguucaccauccucgcccucuuccucgcucauuacauuggcaccucccucacgcagaaggugguaauuuucauucuacuuaugcuuguuacgcccagcaugaccaugcguugcguaggggucggcaaucgcgacuucguggagggguuaaguggggcaaccuggguugacgugguccuagagcacggcgggugcguaacgaccauggccaagaacaagcccacucucgacaucgaguugcaaaagacagaggccacgcaguuggccacccuccggaaguugugcaucgaaggcaagaucaccaacaucaccacggacagccguugcccgacccaaggagaggcaauccuacccgaggagcaggaccagaacuacgugugcaagcauacguacgucgaccgcggguggggcaaugggugcgggcucuucgggaagggcucccucguaacgugcgcgaaguuccagugccuagagucgaucgaggggaaggcugugcaacacgagaaccugaaguacaccgucauuaucaccgugcacacuggggaccagcaucagguggguaacgagacucaggggguuaccgcggaaaucacgccccaagccuccaccguggaggcgauucugcccgaguacggcacccuggggcucgagugcaguccccgcacgggccuggacuucaacgagaugauccugcucacgaugaaaaacaaggccuggaugguccacaggcagugguuuuucgaccugccacugcccuggacuaguggggccaccaccgaaacgccuacuuggaacaagaaggagcugcuggugaccuucaaaaaugcccaugccaagaaacaggagguuguugugcuggggucgcaggagggggcgaugcacaccgcauuaacaggcgccaccgagauccaaacgucgggcgggaccuccaucuucgccggccaucugaagugucgccugaagauggacaaacuugagcugaaagguaugucguaugccaugugccugaaugcauucgugcucaagaaggaagucagcgagacgcagcacgggaccauccugaucaaaguggaguacaagggugaggacgcccccugcaagaucccauucagcaccgaggacgggcagggaaaggcccacaacggacggcugaucacggccaaccccauagugacgaaaaaagaggagcccgucaauauagaggcugagccgcccuucggggagaguaacaucguuaucggaaucggggacaaggccuugaagaucaauugguacaagaaaggcagcagcaucgggaagauguucgaggccaccgcgcgcggcgcucggcguauggcuauucucggcgacacagcaugggacuucgguagcgugggcgggguccugaacucccuuggaaaaaugguccaccaaaucuucgggagcgccuacaccgccuuguucuccggugugagcuggaucaugaagauaggcaucgggguccugcucacguggauaggccuuaauaguaagaacaccagcauguccuucagcugcaucguaauagggaucaucacucuguaccucggcgcaguggugcaggccgauauggggugcgugaucaacuggaaaggcaaggagcugaaaugcgguaguggaaucuucgugaccaacgaggugcacacguggaccgaacaguacaaauuccaggccgacagucccaaacggcuugccacugcuaucgccggcgcgugggagaacggggugugcggcauucgguccaccacccgcauggagaaccucuuauggaagcaaauagccaacgagcugaacuacauccugugggaaaauaauaucaagcucaccaucguuguaggggacgugaucggugugcuggaacaaggcaagcggacccugacaccccagcccauggagcugaaguacucauggaaaacgugggggaaggcaaaaauaguuacagccgagacccaaaacuccagcuucauaaucgacgggcccaauacgcccgagugccccucggccagucgcgccuggaacgucugggagguggaggacuauggcuucggcguguucacuaccaauaucuggcugaagcugcgggagaaguacacacagcucugcgaccaccgccuaaugucugcagccgugaaggacgaacgugcgguacaugcagauaugggcuacuggauugagucccagaaaaacggcagcuggaagcuggagaaggccucccucauugaggugaaaaccugcaccuggcccaagucgcacacgcuguggaguaacggagugcuagagagcgacaugaucaucccgaagucauuagccgggccaaucucccagcauaauuaccgccccggguaccacacccagacagccgggccguggcaccucggcaagcuggagcucgacuucaauuauugcgagggaacuacgguugucauaacugagaacugcggcauucguggacccucccugcgcaccacgacggugagcgggaaacugauucacgagugguguugucgguccugcacacugccgccucuccgcuacaugggcgaggacgggugcugguaugguauggaaauucggccgaucaacgagaaagaggaaaacaugguaaagagccuggucuccgccggcagcgggaagacggacaacuucaccauggggguccucugccuggcgauucucuuugaagaggugaugcgcgguaaguucgguaagaagcacaugaucgccggggcccucuucaccuucguccugcugcuauccggccagaucacuuggcgggacauggcccacacccuaaucaugauaggaagcaacgccuccgaccgcauggggauggggguaaccuaccuagcguugaucgccaccuuuaagauccagcccuuccucgcacuaggguucuucuuacggaaacuuaccucacgcgagaaccugcuacugggcgugggccuagccauggcgaccaccuuacaguuacccgaagacaucgagcagauggccaaugggaucgcacuggggcugauggcccugaaauugauaacgcaauucgagaccuaccaacucuggaccgcucugauuucgcugauguguuccaacaccaucuucacccucacagucgccuggagaaccgcuacccugaucuuagcuguuauuagccuccugcccgucugccaauccagcuccaugagaaagacggacuggcugcccaugaccgucgccgccaugggggucccccccuuaccccuguucauauucucccuaaaggauacccucaagaggcgaucuuggccgcuaaacgagggggugauggcggucgggcuggugucgaucuuagccuccagcuuucugcgcaaugacguaccaauggccggcccacugguggccgggggacuucugaucgccuguuacgugauaacaggcacguccgcugaucugacuguggagaaggcggccgaugucaccugggaggaagaggcagagcagaccggcgugucccacaaucucaugauaacgguugacgacgaugggaccaugcgaaucaaggacgacgaaacagagaacauauuaaccguccuacuaaagaccgcccugcugaucguuuccgggaucuuccccuacucaaucccagcgacccuccuaguuuggcacaccuggcagaagcagacccagcgcuccggcgugcuaugggacguaccaagcccgccagagacccagaaggccgagcucgaagagggggucuaccggaucaagcagcaggguauuuucgggaaaacccaagucggcgugggcguccaaaaggaagggguguuucauaccauguggcacguaacccgcggugccguuuuaacacauaacgggaagagacuggagccuaacugggccaacgucaagaaggaccuuaucuccuacggcggcggauggaagcugagcgcgcaguggcagaaaggugaggaggugcaggucaucgcaguggagcccgggaagaaccccaaaaacuuucagacgaugcccggcauuuuccagacgaccacuggcgagaucggcgcgaucgcccuagacuuuaaacccggaacgagcgggagccccaucauuaaucgcgagggaaagguggucggccuuuacgggaacggcguggugaccaagaacggcggguauguuagcggcauagcccaaacuaacgcggaacccgacggcccgacccccgagcucgaagaggagauguucaagaagcggaaucuuacuauuauggacuugcaccccggcuccgggaaaacccgcaaguaccuccccgcuauagugcgggaggccauaaagcgccggcugcgaacccugaucuuggcgccgacccgggugguagccgcggagauggaggaggccuuaaaggggcuucccauucgcuaccagacgaccgccacuaaguccgaacacaccgguagggagauagucgaucucaugugucaugcuacguucaccaugcgccuccugaguccugugcgcguuccgaauuauaacuuaauugucauggacgaggcucacuucaccgacccggccagcaucgccgcccgcggcuacauaucuacucgggucgggaugggcgaggccgcggccaucuucaugaccgccaccccgcccggcaccgccgacgccuucccccagagcaacgcgcccauccaggaugaagagcgcgauaucccggagcgguccuggaacagcgggaacgaauggaucaccgauuuugcaggaaagacggugugguuugucccuuccaucaaggcggggaacgacaucgccaauugccugcgcaagaacggaaagaaggugauccaguuaagcagaaaaacuuucgauacagaguaccagaagaccaagcucaacgacugggacuuuguuguuacgaccgacauuuccgagaugggugccaacuucaaggcggaccgcgugaucgacccccgccgcugccuaaagccggucauccugaccgauggccccgagcggguuauccucgccggcccgaugcccguaacagucgccagcgccgcgcagcggagaggaagagucggcagaaauucccagaaggagaacgaucaguacaucuucacuggacaaccgcuaaacaacgaugaggaccacgcgcacuggaccgaggccaagaugcuucucgacaauaucaacacgccugaggggauaauccccgcccuguuugagccggaaagggagaagucagccgcgauagacggggaguacagacuaaagggcgagucucggaaaaccuucguugagcugaugcggagaggagaucuaccggucuggcuggcccacaaggucgccagcgaggggauaaaauacacagaccgcaaguggugcuucgacggggagcggaacaaccagaucuuagaggagaacauggacguggaaaucuggacgagagagggagagaagaagaagcugcggccgcgaugguuggacgcgcggaccuacuccgacccgcucgcucuaaaggaguucaaggauuucgcggccggccguaagucgaucgcccuggauuuggucacugagaucggccgagugcccucccaccuggcgcaccggacccgcaaugcccucgacaaccuggucaugcugcauacuagcgagcacgggggccgggcguaccggcacgcgguggaggagcugccggagacuauggagacccuccugcugcucgggcuaaugauccugcucacugggggugcuauguuguuucuaaucagcgggaagggcaucgguaagacgucuaucggccucaucugcgucgucgcaagcuccgggaugcuguggauggccgaugucccccuucaguggaucgcuucagccaucguccucgaguucuucaugaugguccugcugauccccgaaccugagaaacagcggacuccucaggauaaccaacuggccuauguggugaucgguauccugacccuggcagccaucgucgcggccaacgagauggggcucuuagagaccacgaagcgcgaccugggcauguccaaggagcccgguguugugucuccgaccuccuaccucgacguugaccugcauccggccuccgcauggacgcuguaugcuguggccaccacggugaucacuccuaugcuccggcauaccaucgaaaacaguacagccaacgucagccuugcagccauugcgaaccaggccguggugcugaugggucucgacaagggguggcccauuuccaagauggaccuaggggucccccugcucgccuugggcuguuauagccaggugaauccacugacgcuuaccgcggccgugcuguuacuagucacgcauuacgcaauaaucgggccaggccugcaagcuaaggccacucgcgaagcccaaaagcggacggccgcugguauaaugaagaaccccacuguggacgggaucaugaccaucgacuuagacccuguaaucuacgacuccaaguucgaaaagcagcugggccaggucaugcuguuaguucucugugcggugcagcugcugcucaugcguacuagcugggccuucugcgaagcccuuacucuggcgacugggccgaucacaacccucugggagggcucgccuggcaaauucuggaacacgaccaucgccgucagcauggccaacaucuuccggggguccuaccucgccggcgccggacuagcguucucaaucaugaaaucaguaggcaccgggaaaagaggcaccgguagccagggggagacgcucggugagaaauggaagaagaaacugaaccagcugucaaggaaggaguucgaucucuauaagaaauccgggauaacugagguggaccguaucgaggccaaagagggccugaaacgcggggagauaacccaucacgccguuucgcgcggcuccgccaagcuucaaugguucguggagcguaauauggugaucccagagggucgcgucaucgaccucgggugcggacgcggaggauggucauacuacugcgccgggcugaagaaggugacugaagugcggggauacacuaagggcgggcccggccaugaggagccgguacccaugucgaccuacggguggaauaucgugaagcugaugagcggcaaggacguguucuaccugccacccgagaagugcgauacucugcugugcgacaucggggaguccagcccgucgcccacagucgaggagagccggaccauucgcguuuugaagaugguggagcccuggcucaagaacaaccaguucugcaucaagguucuaaacccguauaugccgacggugaucgagcacuuggagcgccuccagcggaagcauggcggcaugcugguucgcaacccccuguccagaaacagcacccacgagauguacuggaucuccaauggaacuggcaauaucgucagcuccgugaacaugguuagccgcuugcugcugaaccgguucaccaugacucaccgccggccuacgaucgagaaggacgucgaccucggugcggguacccgucacgugaacgccgagcccgagacccccaacaugaacgugauaggcgagcggaucagacggaucaaagaagagcacaguagcacuuggcacuacgacgacgaaaacccguauaagaccugggcguaccauggguccuacgagguuaaagcuaccggcucagccagcuccaugaucaacggagugguaaaacuacugaccaagccaugggacguugugccuauggucacgcagauggcgaugaccgacaccacucccuucggccagcagcguguguucaaggagaaaguggacacgcgaacgccccggcccaugccggggaccaggaaggucauggaaaucaccgccgaguggcuauggcgcacgcugggcagaaacaagcgcccccggcuaugcacccgagaggaguuuaucaagaaggugcgcaccaacgccgccaugggugcgguguucacugaggaaaaccagugggacagugcccgugccgcggucgaggacgaggaguucuggaaauugguugaccgcgagcgcgaguugcacaagcuugggaaaugcggcuccugcguguacaacaugaugggaaagcgcgagaagaaacucggggaguucggcaaagccaagggcagucgggccauaugguauauguggcugggcgcccgguacuuggaguucgaagcucucggguucuuaaaugaggaucacugguucagcagagagaauagccacucgggcguggagggagagggccugcacaagcugggguacauccugcgcgacaucagcaagauuccaggcggcgccauguacgccgacgacacggcggggugggacacccggauuacugaggacgaccugcacaacgaagagaagaucacgcaacagauggauccugagcaccgccagcucgcuaacgccauuuuuaaguuaacguaccagaacaaaguugugaagguucagagaccgacccccaagggcaccguaauggacaucaucagucgcaaagaccaacggggcagcgggcaggugggcaccuacggucugaacacguucacaaacauggaagcucagcucauccgacagauggagggagaggguguccucuccaaagccgacuuggagaacccacaccuucuggagaagaagguaacccaguggcuggagaccaagggcgucgagcgccucaagcguauggcgauuagcggggacgauugcgucgugaagcccaucgacgaccgguuugccaaugcccugcuggcacucaacgauaugggcaaagugcgcaaggacauuccgcaauggcagcccuccaagggcuggcacgacuggcaacaagucccuuucugcucacaccacuuccaugagcuaaucaugaaggaugggcggaaguuaguggucccgugccgcccucaagacgagcucaucggccgggcccgcauaucccaaggggcggguuggagccuaagggagacugccugccuugggaaggccuacgcccagaugugggcgcuaauguacuuccaccgccgagaccugcggcuggccuccaacgccauaugcagcgccguccccguucacuggguacccacgagccgcaccaccuggagcauccaugcccaucaccaguggaugaccacggaggacaugcucaccguguggaacaggguauggaucgaggauaacccguggauggaggacaagaccccaguuacgacuugggaggaugugcccuaccuuggcaagagggaggaucaguggugcggcagccugaucggguuaaccucccgugcgaccugggcccagaacauauugaccgccauccagcaagucaggagcuugaucgggaacgaggaguuucucgauuacaugcccuccaugaagcgguuucgcaaggaggaggagagcgagggugcaaucugguga

SEQ ID NO: 26181 - RNA, 9873 nt, Artificial Sequence
  derived and/or modified CDS sequence (opt11) from DENV-3__KF824902__SS-prME
acuagccugugccucaugaugaugcugcccgccacccucgccuuccaccucacgucccgcgacggcgagccgcggaugaucguggguaagaaugagcgcggcaagagccugcuguuuaagaccgcguccgggaucaacaugugcacccugauugccauggaucugggcgagaugugugacgacaccguuaccuacaagugcccccugaucgccgagguggaaccggaggacaucgacuguuggugcaaccuaaccagcacuuggguuacuuacgggacuugcaaccaggccggcgagcaccggcgcgacaagcgguccgucgcucuggcgccccacguuggaauggggcuggacacccggacccagacguggaugagcgccgaaggcgccuggcgucagguggagaaggucgagaccugggcccuccggcacccgggguucaccaucuuggcgcuguuccucgcccacuacaucggcaccucccugacccagaagguggugaucuucauccugcuuaugcuggucacccccuccauggccaugcggugugugggggugggcaaccgcgacuucgucgagggccuguccggggccaccuggguggacgugguccuugagcacggcgggugcgugaccacgauggccaagaacaagccgacgcuggacaucgagcuucagaagaccgaggcgacucagcucgccaccuugcggaagcugugcaucgaggguaagaucacgaacaucaccacggacagucgcugucccacccagggcgaagccauccucccggaggagcaagaccagaacuauguuuguaagcauacguaugucgaccguggguggggcaacgggugcggcuuauucggcaaggguucccugguaaccugcgccaaguuccaauguuuagagagcaucgagggcaaggugguucagcacgaaaaccugaaguacaccgucaccauaaccgugcacacgggggaccagcaccaggucgguaaugacacucagggggugaccgcagagauaacuccccaggcgagcaccguggaggccauccugccggaguacggcacccucgggcuggagugcucgccgcguaccggccuggacuucaacgagaugauacuccuuacaaugaagaacaaggcguggauggugcaccgucaaugguucuucgaccugccgcuccccuggacguccggcgcuaccaccgagacccccacguggaacagaaaggagcugcuugugaccuucaagaacgcccacgcgaagaagcaggagguaguggugcucggcucgcaagagggcgccaugcacaccgcacugacaggcgccacggagauccagaacuccggcgggaccuccaucuucgccggucaucuaaagugccggcucaagauggacaagcuggagcucaagggcauguccuacgcgaugugccucaacaccuuuguccugaagaaggaagugagcgagacccagcacgggacgauccugaucaagguggaauacaagggugaggacgcccccugcaagauaccguucagcaccgaggacgggcagggcaaggcccacaacggcaggcugauuaccgccaaccccgucguuaccaagaaggaggaacccguaaacaucgaggcggagcccccguucggcgagaguaacaucgucaucggaaucggggacaaggcccucaaaauuaacugguacaagaagggcagcuccaucggaaagauguuugaggccacagcccggggugcucgccggauggcgauacugggcgacaccgccugggacuucgggaguguaggcggggugcugaacagucucggcaaaaugguccaccagaucuucggguccgcauacaccgcgcuguucggcggcgucagcuggaucaugaagaucgguaucggcgugcugcucaccuggaucgggcugaacagcaagaacacauccaugagcuucucguguaucgugaucgguaucauuacccuguaccuagggaccguggugcaagcggacaugggcugcgucauaaacuggaagggcaaggaacuuaagugcgguagcggcaucuucgugaccaacgaggugcacacauggacggagcaauauaaguuccaggcagacucccccaagcggcuggccaccgccaucgccggggcgugggagaacggcgucugcggaauccgcagcaccacgcggauggagaaccuccuguggaagcagaucgcgaacgagcugaacuacauccucugggagaacaauaucaagcugaccgucgugguuggcgacauuaucggcguauuggaacaggggaaacgcgcccuuacaccccagcccauggagcugaaguacuccuggaagaccuggggcaaggccaaaaucguuacggccgagauccaaaacagcuccuucaucaucgacgggcccaacacccccgagugccccagcgcgucccgggccuggaacgucugggagguggaggacuacggcuucggcguauucacgaccaacaucuggcugaagcugagggaggucuacacgcagacgugcgaccaccggcugauguccgccgccaucaaggacgagcgcgcuguucacgcggacaugggguacuggauugaaagccagaagaacggcuccuggaagcuggagaaggccagcuucauugaggugaagaccugcacauggcccaagacccacacgcuuugguccaacgggguccucgagagcgacaugaucaucccgaagucacuugccggacccauuucgcagcacaaucaccggcccggguaccacacccagacggccggcccguggcaucucggcaaacuggagcuggacuucaauuacugugaggggaccacgguggugaucacggagaacugcggcacccgcgggcccucccuccggaccacgaccguaagcggcaaacugauccacgaguggugcugucgcuccugcacccugccgccacuccgguacaugggagaggauggcugcugguacggcauggagauucgcccgaucaacgagaaggaggagaacauggugaaaagccugguguccgccgggagcggcaaggucgacaacuucaccaugggggugcugugccucgccauccuguucgaggaggugaugcggggcaaguucgggaagaagcacaugaucgccggcguauuguucacuuucaugcuccugcuguccggccagaucacguggcgggacauggcccacacccucaucaugauagggagcaacgccuccgaccgcaugggcauggggguuaccuaccuggcccugaucgcgacguucaaaauucagcccuuccucgcucugggcuuuuuccugcgcaaguugacgucucgggagaaccugcugcugggcguggggcuggccauggccaccacccugcaguuacccgaagacauagagcaaauggccaacggcauugcccugggucuaauggcucucaagcugaucacgcaguucgagaccuaccagcucuggaccgcccucgucucccugaccugcagcaauacuaucuucacccugaccguggccuggcgcaccgcgacgcucauucuggcgggagugagccugcuccccgucugccaauccucuucuaugcggaagaccgacuggcuaccgguggccgucgccgccaugggggugccaccccugcccuuauucaucuucagccugaaggacaccuuaaagcgcaggucuuggccgcucaacgagggugugauggcggucggccuagugagcauccuagccucgagccuccugaggaacgacgugcccauggcagggccucuaguggccggcgggcuccugaucgccugcuacguuaucaccggcacguccgcggaccugaccguggagaaggccgccgacgucaccugggaggaggaggccgagcagacaggggugucgcacaaccucaugaucacggucgacgaugacggcaccaugcgcauaaaggacgacgagacugaaaacauccugaccguacugcuuaagaccgcccuacucauaguuuccggcaucuuccccuacagcaucccggcgacgcuccugguuuggcacaccuggcagaagcagacgcagcguuccggcguccugugggacgugcccagcccuccggagacccagaaggccgaauuggaggagggcguguaccguaucaagcagcaggggaucuucggcaagacccaggucggggugggcgugcagaaggagggcgucuuccacaccauguggcacgugaccagaggggccguuuuaacccacaauggcaagcgccuggagccgaacugggccuccgucaagaaggaccucaucagcuacgggggcggguggcggcuguccgcccaguggcaaaagggcgaagagguucaggugaucgccguggagcccggccgcaaccccaaaaacuuccagacgaugcccgggaucuuccagaccaccaccggcgaaaucggggcaaucgcccuggacuucaaaccggguacuagcggaucccccaucaucaaucgggaggguaagguggugggccuguacgggaauggcguugugaccaagaacggaggguacgucagcggcaucgcccaggccaacgccgagcccgaagggccgacccccgaacuggaggaggagauguuuaagaagcgcaacuugaccauuauggaccugcaccccggcagcggaaaaacgcggaaguaccuccccgcaaucguccgcgaggcaaucaagcggcgccugcggacacugauucuugccccuaccagaguaguggcggccgagauggaggaggcauuaaagggccugcccauaagguaccagaccacugccaccaaguccgagcacaccgggcgcgaaaucgucgugcuuaugugccacgcuaccuucacgaugcggcugcugagccccgugcguguccccaacuacaaccucaucaucauggaugaggcgcauuucacugacccggccagcaucgccgcccggggcuacauuagcacgcgggugggaaugggggaggccgccgccaucuucaugaccgccacgccacccggcacggccgaggcguucccccaguccaacgccccgauacaggaugaggaaagagacauacccgaacggucauggaacuccgggaacgaguggaucaccgacuucguuggcaagaccgugugguucgugcccagcauaaaggccgggaacgacauugccaauugccugcgcaagaacggcaagaaggugauccagcugucccggaagacuuucgacaccgaguaccaaaagaccaagcucaacgacugggacuucgucgucaccacagacaucagcgagaugggggcgaacuuuaaggccgaccgcgugauugacccacggcgaugccugaaaccggucauucugaccgacgggcccgagcgggugauucucgccggcccgaugcccgugaccgccgccagcgcggcgcagcgccgugggcgcguaggccggaacccgcagaaagagaacgaucaguacauauucauggggcagccccugaacaaugacgaggaccacgcccacuggaccgaggccaagaugcugcucgacaacauaaacacacccgaaggcauuauacccgcccuguucgagccggaacgcgagaaaagcgcggccaucgacggcgaauaccggcugaagggcgagucccgcaaaaccuucguggaacucaugcggcgcggagacuugccggucuggcuugcccacaagguggccagcgaagggaucaaauacaccgaccggaaguggugcuucgacggcgaacgcaauaaucagaucuuggaggaaaacauggacguugaaaucuggaccaaagagggcgaacggaagaagcugcgcccacgauggcuggacgcgcggaccuacagcgacccccucgcgcugaaggaguuuaaggacuucgccgccgggcgcaagagcaucgcccuggaucucguaaccgagaucggcagggugccuucccaccuggcgcauagaacccggaacgcgcuggacaaucucgugaugcuacacaccagcgagcacgggggccgagccuaccggcaugccguagaggaguuacccgagacaauggagacccuccugcugcucgggcugaugauccugcucaccggcggugccaugcuguuccugaucucggggaagggcaucgggaagaccuccauaggccucaucugcgugaucgugucgagugguaugcuguggauggcagacgucccgcugcaguggaucgcgagcgcgaucgugcucgaguucuucaugaugguacugcugaucccggaacccgagaagcagcggacaccccaggacaaucaacucgccuacguagugaucgguauccugacucuggcagccaucguggcugcuaacgagaugggccuccuggagaccacuaagagggaccuggggauguccaaggagcccggcgucgugagcccgaccucuuaucucgacguggacuuacacccagccagcgccuggacgcuguacgcgguagccaccacagugauaacccccaugcuccgucacacgaucgagaacuccaccgccaacguaagccuggccgccaucgcgaaucaggccgucgugcucaugggacucgacaagggcuggccuaucucgaagauggaccuagggguuccgcuuuuagcccugggcugcuacagccaggucaacccccugacccucaccgccgccgugcuguugcucgugacgcauuaugcgaucaucggcccagggcugcaggcaaaggccacacgggaagcccagaagcgcaccgcugcgggcauaaugaagaaucccaccgucgacgguaucaugacaaucgaccuggacccagugaucuacgacuccaaauucgagaagcagcugggccaggugaugcugcugguccucugcgccguccaacuguuacucaugcgaaccucuugggccuuaugugaggcccugacccucgcgaccggacccauuacgacucugugggaggggucccccggcaaguucuggaacaccaccaucgccgucuccauggcgaacaucuuccgcggguccuaccuggcaggcgccggacucgccuuuagcaucaugaaaagcgucggcacgggcaagcgggggaccggcagccagggggagaccuuaggggagaaguggaagaaaaagcugaaccaguuguccagacgggaguucgagcuguacaaaaagagcgggaucaccgagguggaccgcaccgaggccaaagagggccugaaacggggcgaaacuacgcaccacgccguuagccgaggauccgccaagcuccagugguucgucgagcggaacauggucauccccgaaggccgcgugaucgaucugggcuguggccgcgggggcuggagcuacuacugcgcaggccugaagaaggucaccgaggugcgcggguacaccaagggagggccgggucacgaggagcccgugccgauguccaccuacggguggaacaccguaaaacucaugagcggcaaggacguguucuaccuacccccggagaagugcgacacccuccuaugcgacaucggggagagcagccccucccccacgguggaggagagccggacgauccggguccucaagaugguugagccuuggcugaagaauaaccaauucugcaucaagguccugaacccuuacaugccaaccgucaucgagcaccucgagcgccugcagagaaagcacgggggaaugcuggugcgcaacccccucagucggaacagcacccaugagauguacuggaucuccaaugggaccgguaacaucgugucuuccgucaacauggugagccgacugcuccucaaucgguucacgaugacccacagacggccuacuaucgaaaaggacgucgaccucggcgcagggacacgccacgucaacgccgagccugagacgcccaauauggaugugaucggcgaacggauaaagcgcaucaaagaggagcauaguagcaccuggcacuacgacgacgagaaccccuacaagaccugggccuaccacgguuccuacgaggucaaagccaccggcagcgccuccucaaugaucaacgggguggugaaguuacucacgaagccgugggacgucgugcccauggugacacagauggcgaugaccgacaccacgcccuucggccagcagcgagucuucaaggagaaggucgauacccgcacaccccggccgaugccgggaacccgcaaggucauggaaaucacggccgaauggcuguggagaacccuagggcgaaacaagcgccccaggcucugcacccgcgaggaguucacuaagaagguuaggacgaacgcggccaugggcgcgguauucaccgaggagaaccagugggaaagcgcucgggcggcgguagaggacgaggaguucuggaaacuggucgggcgugagcgggaacuucacaagcucgggaagugcgggucaugcguguacaacaugaugggcaagcgggaaaagaagcugggcgaguuugggaaggccaagggaagccgagcgaucugguacauguggcuuggggcccgguaccucgaguucgaggcccugggcuuccugaacgaggaccacugguuuucccgggaaaauagcuacuccgggguggagggcgagggucuccacaagcugggcuacauucugcgggacaucagcaagauccccggcggggccauguacgcugacgacaccgcgggcugggacacccgcaucacggaggacgaccuccacaacgaagagaaaaucacgcagcagauggacccugaacaccggcaguuggccaaugcaaucuucaaacuuacuuaccagaacaaggucgugaaagugcagagacccaccccuaagggcaccgucauggacaucaucagccggaaggaucagcgaggcagcggccagguggggaccuacggcuuaaacaccuucaccaacauggaggcccagcugauccggcagauggagggggagggugugcugagcaaggccgaccucgagaacccccaucugcuggagaagaagaucacccaguggcucgagacgaagggcgucgaacgccugaagcggauggcgaucagcggggacgacuguguggugaagccgaucgacgaccgcuucgccaacgcacuuuuggcccuaaacgacaugggcaagguccggaaggauaucccccaguggcagcccucuaagggcuggcacgacuggcaacaggugcccuucugcagccaccacuuccacgagcugaucaugaaggacggccggaagcugguggucccgugccgcccacaggaugagcugauagggcgggcccgcauuucccagggugcgggcuggagucugaaggagaccgccugucuugggaaagccuaugcccagauguggucccugauguacuuucaccggcgcgaccugagacucgcaagcaacgcgaucugcuccgccgugcccguucacuggguccccacuucucgcacuacgugguccauucacgcgcaccaccaguggaugaccaccgaggacaugcugacuguguggaacagaguguggaucgaggacaacccguggauggaggacaagacgcccgucaccaccugggaagaugugccguacuugggcaagcgcgaagaucaguggugcgggagccuaaucggccugacuucgcgggccacaugggcucagaacauccugaccgcaauccaacagguucgcucccucauuggcgacgaggaguuuuuggacuacaugcccucgaugaagcgguuccgcaaggaggaggagucugagggcgccauaugguga

SEQ ID NO: 26182 - RNA, 9873 nt, Artificial Sequence
  derived and/or modified CDS sequence (opt11) from DENV-3__KF824903__SS-prME
acuucgcugugcuugaugaugaugcuucccgccacccuggccuuucaucuuacaagccgggacggcgagccacgaaugaucgugggcaagaacgagcggggcaaaucccugcuguuuaagaccgcgagcgggauaaauaugugcacucucauagccauggaccugggugagaugugugacgacacggugaccuacaaguguccccugaucgccgagguggagccugaggauauugauugcugguguaaccucaccagcaccugggugaccuaugggacgugcaaccaagccggcgagcaucggcgcgacaagcggucgguggcccuggcgccccacguggguaugggguuggacacccggacacaaacauggaugagcgccgagggcgcauggcggcagguggagaaggucgaaaccugggcccuccgccacccugguuuuaccauucucgcgcuguucuuggcccacuacaucgguaccucccugacacagaaaguggugauauucauauugcucaugcuggucacccccagcauggccaugcgaugcguaggagugggcaaucgugacuucgucgagggcuuauccggggcaaccugggucgauguaguccucgagcacggcgggugugugaccacaauggccaagaacaagccuacguuagacaucgagcugcagaagaccgaggcgacucagcuagccacccugcggaaacuguguaucgagggcaaaauaacuaacaucaccaccgacucgcgcugccccacccagggcgaggcaauccucccggaggagcaggaccaaaacuacgucugcaaacacacguacguggaucggggguggggcaacgggugcggccuguucggcaaaggaucccuagugaccugcgcgaaguuccagugucuggagagcauugagggcaagguugugcagcacgagaacuuaaaauacaccgugaccaucacggugcauaccggggaucagcaccaaguuggcaacgauacccaggguguaacagcggagaucacgccccaggcgucaaccguagaggccauccugccugaauacgguacccucggacuggagugcagcccccgcaccggccuggauuucaacgaaaugauccucuugaccaugaagaacaaagccuggauggugcaccggcagugguucuucgaccugccguugcccuggacguccggcgcgaccaccgaaacccccacguggaaccgcaaggagcugcugguuaccuucaagaacgcccacgcgaagaagcaggaagucguggugcuagguagccaggaaggggcgaugcacaccgcccugaccggggccacagagauccagaauucuggagggaccucaauuuucgccggccaccugaagugccgguuaaagauggacaagcuggagcugaagggaaugagcuacgccaugugccucaacacguucgucuuaaagaaagaaguuuccgagacccagcauggaacgauucuaauuaagguagaguauaaaggcgaggacgcuccgugcaagaucccguucagcaccgaagacggccaggggaaggcgcacaacgggcgccucaucacggccaaccccgucgugacaaagaaggaggaaccuguuaacauagaggcugagccaccguucggugaaucaaacauugucaucggcaucggugacaaagcccucaagauuaacugguacaagaagggcucuuccaucgggaagauguuugaagcuacggcccggggcgcccgccgaauggcgaucuuaggcgacaccgcaugggauuucgggagcgugggagggguacuaaacucccucggcaagaugguccaccagauuuucgggagcgccuacacggcgcuguucgggggcguguccuggaucaugaaaaucgggaucggcgugcugcucacuuggaucggguuaaacagcaagaacacguccaugucguuuuccuguaucguaaucggaauuaucacacucuaccuggguaccgugguccaggcggacaugggcugcguaaucaacuggaagggcaaggaguugaagugcgguucuggcaucuuugugaccaacgaaguacacacguggaccgagcaguauaaguuccaggcugacucccccaagagauuagcaaccgccauugccggcgccugggagaacggcguuugcgggauacgcagcacuacgcggauggaaaaccuccuguggaagcaaaucgcuaaugagcugaacuacauccucugggaaaauaacaucaaguuaacggugguggugggagacauaaucggcguucuagaacaggggaaacgcgccuuaacgccucagcccauggaauuaaaguauucauggaagaccuggggcaaggcuaagaucgugacggcagaaauccagaacucaucguuuaucauugauggucccaauacccccgaauguccgagcgcgucccgggccuggaacgucugggagguugaggacuauggcuucggaguguucaccacgaacauuuggcuaaaacuccgcgaggucuacacgcagaccugcgaccacaggcugauguccgcagcaaucaaggacgagcgcgcuguccaugcggacaugggcuacuggaucgagagccagaagaacggcagcuggaagcuggagaaggccagcuucauugagguaaagaccugcacguggcccaagucgcacacucucuggucaaacgggguccuugagagugacaugaucauccccaagagccuggccggucccauuucccagcacaaccacagacccggguaccacacgcaaaccgccggcccauggcaccuuggaaagcuagagcuagauuucaacuacugcgaggggaccaccgucgugaucaccgagaacugugguacacgcgggccaagcuugcggaccacgacggucucuggcaaguuaauucaugaguggugcugcaggucuuguacguuaccgccccuucgguacaugggggaagacggcugcugguacgguauggagauccggccgauuaaugagaaggaagagaacauggucaagucgcuggucucagccggguccgggaagguggacaacuucaccaugggcgugcuaugccuugcgauacuguucgaggagguaaugcggggcaaauucggcaaaaagcacaugaucgccggcguccuguucaccuucaugcuccugcugagcgggcagaucacguggcgagacauggcccacacccucaucaugaucgggucuaacgccagugaccggauggggaugggggucaccuaccuggcacuaaucgcuaccuucaaaauccaacccuuccuagcgcugggcuucuuccuuaggaaacucacgucccgggagaaccugcuucucggcguggggcuggcgauggccacuaccuugcaacuacccgaggacaucgaacaaauggccaacggcaucgcccuggggcugauggccuugaagcugaucacccaguucgagacguaccaacuauggaccgcccucguuagucugacaugcagcaacaccaucuucacucuaaccgucgccuggcgcaccgcaacccucauacuggccggcgucagucuguugcccgucugccagagcuccagcaugcggaagacggacuggcugccgguggcugucgcagcuaugggggugccgccgcucccccuauucaucuuuagucugaaggacacccugaagaggcgcaguuggccucucaacgagggcgugauggcggucggccuggugaguauccuugcgagcucacuccugaggaaugacgugccuauggccgggccccuggucgcuggcgggcuccugaucgccugcuacgugauaacuggcaccagcgcggaucucacuguggagaaggccgccgacgucaccugggaggaggaggccgaacagacggggguuucccacaaccucaugaucaccguagacgacgacgguacgaugcgaauaaaagacgaugagaccgagaauauccugacgguccuguuaaagaccgcccuucuuaucgugagcggaaucuuccccuacuccauccccgcgaccuuacuagucuggcacacguggcagaagcagacgcagcgcagcggggucuugugggacgugcccagcccgccagagacccagaaggccgagcuggaagaggggguguaccgcaucaaacagcaggggaucuucggcaaaacccagguuggggugggcguucaaaaggagggcgucuuucacacgauguggcacgucaccaggggggccgugcugacccacaauggcaagcgccuugagccaaacugggccagcguuaagaaggaccucauauccuacggagguggguggcggcugucggcgcaguggcagaagggcgaggaggugcaagugauugccguugaacccggccgcaaccccaagaacuuccagacgaugcccggaaucuuucaaacgaccaccggcgagauaggagccaucgcuuuagacuuuaagccuggcaccucuggcagccccauaaucaaccgggaggggaagguggugggucuuuaugggaacggagucgugacgaagaacggaggguaugugaguggcaucgcccaggcgaacgccgagccggaggguccaacgcccgagcuagaagaggagauguucaagaagcgcaaucugaccaucauggacuuacacccuggguccggaaaaacccggaaguaucucccugcaaucguccgcgaggcgauuaagcggcggcuuagaacgcuaauccucgccccgacacgcgugguggcggccgagauggaggaagcacuaaaaggguuacccauccgguaccagaccaccgccaccaaguccgagcauaccgggcgcgagaucgucgagugcaugugucacgcuaccuucaccaugcggcuccugucucccguacgcgucccgaauuacaaucucaucaucauggacgaggcgcacuucacggacccugcgucaaucgccgcacggggauacauuuccacccgcgugggcaugggggaggcggccgccaucuucaugacagccacuccgcccgggacggcggaggcguucccccagucgaacgccccgauccaagaugaagagcgcgacauccccgagcgguccuggaauagcggaaacgaguggauaacagacuuuguuggcaaaacugugugguucguccccuccauaaaggccgggaacgacaucgccaacugucuccgcaaaaacggcaaaaaggugauccagcugucgcggaagaccuucgacacggaguaucaaaagaccaaguugaacgacugggauuucguggucaccaccgacaucuccgagaugggcgccaacuucaaggccgaccgcguaaucgauccccgacgcugccuuaagccggugauacugacggacgggcccgagcgggucauccuggcgggcccaaugcccguaacagccgcgagcgcagcgcagcggcgggggcgagucggcagaaacccacagaaggagaacgaccaguacaucuucacagggcagccucugaauaacgacgaagaccacgcccacuggaccgaggccaaaaugcugcuggauaacaucaacacgccagagggcaucauccccgcccucuucgagccggagcgagagaaaagcgcggcgauagacggcgaguaccggcuaaaaggggagagccgcaagaccuucgucgaacuuaugcggcggggcgaucuccccgugugguuagcccacaagguggccucugaggggaucaaguacaccgaccggaagugguguuucgauggcgagaggaacaaccagauauuagaggagaacauggacgucgagaucuggacgaaagagggcgaaaggaagaaacuucgcccccgcuggcuggacgcgcggaccuacagcgacccccuggcacugaaagaguuuaaggacuucgcugccgggcgcaaauccauagcccuggaccucguaacggaaauuggccgcgucccgagccaccucgcccaccggacacggaacgcgcuggacaaccuggugaugcuccacaccuccgagcacgggggccgcgcguaucggcaugccguggaagaacuaccagaaacaauggagacguugcuccuacucggguuaaugauccuucuaacaggcggagccaugcuauuccugauaagcggaaagggaaucggcaagaccagcauaggccugauaugcgucauaguguccucugggaugcucuggauggccgaugugccgcuucaguggaucgcguccgcgaucguccuggaguucuucaugauggugcucuuaauaccggagcccgaaaagcagcgcacuccccaggacaaucaguuggccuacgugguaauuggcauccucacgcuggccgccaucguugcggccaacgagaugggcuugcucgagaccaccaagcgggaccuggggaugucuaaggagcccggcguggucuccccgaccagcuaccuggacguggacuugcaccccgccuccgcguggacgcuguacgcgguggccaccacugucauuacccccaugcugcgacacacgaucgagaacagcacugccaaugugucccucgccgccaucgcuaaccaggccguggucuugaugggccuggacaaaggcuggcccaucagcaagauggaccucggggugccacuguuggcccucggcugcuacagucaggugaacccccugacacugaccgcggccguacuccugcucgugacacacuacgcgauuaucggccccggccuccaggccaaagcuacacgggaggcucaaaagcgcaccgcugccggaauaaugaagaaccccaccguggaugguaucaugacgaucgaucuggauccggucauauacgacucaaaauucgagaagcaguuaggccaaguaaugcuucuggugcugugcgccguccaacuccugcugaugaggaccaguugggcgcucugcgaggcccugacccuggcgaccggccccaucacgacacucugggagggaagccccggcaaguucuggaacaccaccaucgcuguaucuauggccaauaucuuccgcgggucguauuuagccggcgccgggcuggcguucuccaucaugaagucaguaggcacaggaaagcgggggacaggcucccagggggagacccuuggugagaaguggaagaagaagcucaaccagcuaagccgcagagaauucgagcuauacaagaagagcgguaucacugaggucgaccgcacggaggccaaggagggccucaagcggggagaaaccacccaucaugccgugucccgcgggagugcgaagcuucaaugguucguggagcggaacauggugauaccugagggacgcgugaucgaucucggguguggcaggggggguugguccuacuacugcgcgggacugaagaaggugaccgaaguccguggcuacacuaaaggcggcccgggccacgaggagccuguccccaugagcacguacggguggaacaccguuaagcuaauguccggcaaggacgucuuuuaccugccgccagagaagugugauacccugcucugcgacaucggggagagcucucccagcccgaccguggaggagucccgcaccaucagagugcugaagaugguagaacccuggcuaaagaacaaccaguucugcaucaaggugcugaacccauauaugcccaccgugaucgaacaucuugaacggcuccagcgcaagcaugggggcaugcuuguucgcaacccccuuucccggaacuccacccacgagauguacuggauuagcaacggaaccggcaacaucguguccagcguuaacaugguaucccgauugcuguuaaaccgguucacgaugacccaccgccggcccaccaucgagaaagacgucgaccucggcgcggggacccgccacgugaaugcagagccagaaacccccaacauggacgucauaggugagcggauuaagcguauaaaggaggagcauagcuccaccuggcauuacgaugacgaaaaucccuacaagaccugggcguaccacgggucguacgaggugaaggccaccggauccgccucgagcaugauaaacgguguaguaaagcuuuuaacgaagccgugggacguggucccgauggugacccagauggcgaugaccgacaccacacccuuuggccagcaacggguuuucaaggagaaggucgacacccgcacgcccagacccaugccuggcaccagaaaagugauggagaucacagccgaauggcucuggcggacccucgggcggaauaaacgccccagacugugcacgcgggaggaauucacuaagaaggugcggacgaacgccgccaugggcgcugucuucaccgaggaaaaccagugggagucugcccgugcagccguggaggacgaggaguucuggaagcucgucggacgggagcgggaguugcacaagcucggcaaaugcggcagcuguguauacaauaugaugggcaagcgggagaagaagcuuggugaauucggaaaggcgaagggcucccgggcgaucugguacauguggcugggagcccgguauuuggaguucgaagcccucggguuccugaacgaggaucacugguuuagccgcgaaaauuccuacucggggguugaaggcgagggucugcauaagcucggguacauucugcgagauauaucuaagauccccggaggggccauguacgccgacgacaccgcgggcugggauacccgcauuacggaggacgaccugcacaaugaggaaaagaucacgcagcagauggacccagagcacagacagcuggccaacgcuauuuucaaacucaccuaccagaacaagguggucaaggugcagaggcccacccccaaaggcacggucauggacaucaucagccggaaggaccagcgcgguuccggccaggucgggacguacggucucaacaccuucaccaacauggaggcacagcucauccggcagauggagggggagggcgugcugagcaaggccgaccuggagaauccccaccuccuggagaaaaagauuacccaauggcuggagacuaaaggagucgagcgccucaaacggauggccaucucgggugacgacugcgucguaaagccgaucgaugaccgcuucgccaacgcgcugcuggcucugaaugacaugggcaaggugcggaaggauaucccucaguggcagccgagcaagggauggcacgacuggcagcagguccccuucuguucacaccacuuccaugaacugauuaugaaggacggccgcaagcugguagugccaugucgaccucaagacgagcucaucggccgggcgcgcaucagccagggggcgggcuggucccugaaggagaccgccugccugggaaaggccuacgcccagauguggagccuaauguacuuccaccggcgcgaccugcggcuggcguccaacgcuaucugcagcgcaguccccgugcacugggugccaaccucacggaccacuuggagcauccacgcucaccaccaguggaugacuaccgaggauaugcucaccguguggaaccgugucuggaucgaggacaacccguggauggaggacaagacgcccgucaccacaugggaggacgucccauacuuaggcaagcgcgaagaccaguggugcgggagccuaaucggccuaacuucccgcgccaccugggcgcagaauauccugaccgccauccagcaggugagaagccugaucggagacgaagaguuccucgacuacaugccguccaugaaacgguucagaaaagaagaggagucagagggcgcaauaugguaa

SEQ ID NO: 26183 - RNA, 9873 nt, Artificial Sequence
  derived and/or modified CDS sequence (opt11) from DENV-3__JF504679__SS-prME
acuagccuaugccuaaugaugauucuaccagcagcacuagccuuccaccucacaagccgagacggcgaaccucgcaugaucguggguaagaacgaacgaggaaagucgcucuuguucaaaacagcgagcggcauaaauaugugcacgcuaaucgcaauggaucuuggcgaaaugugcgacgauacagucaccuacaaaugcccgcacaucaccgaaguagaacccgaagacaucgacuguuggugcaaccuaaccaguaccuggguaaccuacggcacauguaaccaagccggggaacauaggagagacaaaagaucaguagcccuagcgccccacguaggcaugggccucgacacccgcacccaaaccuggaugucggccgaaggggcauggcgucagguggaaaaaguagaaacuugggcccuaagacacccgggcuucaccauauuggcacuguuuuuggcccacuacaucggaacaaguuuaacgcaaaaaguagucaucuuuauccuccucaugcucguuaccccaucgaugacuaugaggugcgugggggugggaaaucgugacuucguagaaggauuaucuggagcgacguggguggacguagugcuagaacacgggggcugcguaaccacaauggccaagaauaaaccgacucucgauauagaacuccaaaagacugaagccacacagcuagccaccuugcgaaaguuguguauagaaggcaagauaaccaauauaaccaccgacucccgaugccccacgcagggggaagcaguccuaccagaagaacaggaucagaauuacguaugcaagcacacauacgucgacaggggcugggguaacggcugcggcuuauucggcaaaggaucacuuguaaccugugccaaguuccaaugccuagagcccaucgaaggcaagguaguacaauaugagaaccucaaauacacagugaucaucacgguccacaccggugaccagcaccaagucgguaaugaaacacagggaguuacagcagaaauaacgccgcaggccucaacgacagaagcaauccuccccgaguacgggacauuagggcuggaguguagcccccgcaccggauuagacuuuaaugaaaugaucuugcugacgaugaaaaacaaggcguggaugguucaccgacagugguucuuugaucuaccacuaccuuggacuuccggcgcuacgaccgagacuccgacuuggaacaggaaagaacuucucgucacuuucaaaaacgcgcacgccaagaagcaagaagugguggugcucgggucacaagaaggagccaugcacacggcacugaccggcgcaaccgaaauccagaauagcggcgggacgucuaucuuugcaggccaucuuaaaugccggcucaaaauggauaaauuggaacuaaaaggcauguccuacgcaaugugcaccaacaccuuuguauuaaagaaggaagucucagagacacaacacggcaccauccucauuaagguggaguacaagggagaagacgcacccugcaaaauccccuucucuacugaagauggccaaggcaaagcccacaacggacgccuuauuacggcuaaucccguaguaacaaagaaagaagaaccaguaaauauagaagcugaaccgcccuuuggagaaucaaacauagugauaggcauaggugacaacgcacuaaaaaucaacugguauaagaaaggaucaagcaucgggaaaauguuugaagcaacggcccguggagcccgaagaauggcaauucuaggcgacacagcgugggacuuuggaaguguugggggagugcuuaauaguuuaggaaaaaugguacaucaaauuuucggcucggcguacacagcucuguuuaguggaguaucaugggugaugaaaauaggaauuggcguccugcugaccuggaucgggcucaacagcaaaaacaccaguaugucauucagcuguauagcgauuggcauuaucacacucuaucuaggcgccgucgugcaagcugacaugggaugcgucaucaacuggaagggcaaagagcugaaaugcggcagcggcauuuuugucaccaacgaaguccacacguggacagaacaguacaaauuucaagcggauagcccgaaacgccuggccaccguaauugcgggggccugggaaaacggggucuguggcauaaggucaacuacgagaauggaaaaccuccuauggaaacaaauugccaacgaacugaacuacauccugugggagaacaacaucaaacucacgguuguugucggugauacaauugguguacucgaacagggaaagcguacccuaacgccgcagcccauggaacugaaauauucuuggaagacauggggcaaagccaagaucgucacagccgaaacgcaaaauaguuccuucaucauagacggaccaaauaccccagaaugcccaucagcuagccgagccuggaacguaugggaggucgaagacuacggcuucggcguguuuacgacaaacauauggcuaaagcuacgagaagucuacacccaaaugugcgaccauagguuaaugagugccgccgucaaagacgaacgagcuguccaugcagacauggguuacuggaucgagucccagaaaaacggcaguuggaaacuagagaaagcgagccugauagagguaaaaacguguacauggcccaagucacacacgcuaugguccaacggcgugcuggaauccgacaugauaaucccgaaaagccuagcgggucccgucagucaacauaacuacagaccuggcuaucacacacagaccgcagggccauggcaccucggcaaauuagaguuagacuucaacuacugcgagggcacuaccguuguaauuacagaaaacugcggaaccagaggcccgucacuccgaaccaccacgguaagcggaaaacuaauccacgaguggugcugccgcagcugcacgcugcccccacuacgguacaugggagaggacggaugcugguacgggauggagauacgcccgaucagcgagagagaagaaaacaugguaaaaucucuagugagcgcgggcagcggaaaagucgacaacuucacaaugggaguacucugccuugccauccuguuugaggaagucaugcgaggcaaauuuggaaagaaacacaugauugcaggcgucuucuucacuuucauguugcuguuaagcggacagauaaccuggcgcgacauggcccauaccuugaucaugauaggaucuaacgcgagcgaucgcauggguauggggguaacuuaccuugcccugaucgcaacauucaaaauccaaccauuccuagcacuaggcuucuuucucaggaagcuaacgagccgagagaaucuacuccugggcguaggacucgcaauggcuacaacgauacagcuacccgaagauaucgaacaaauggcaaacggaauagcccugggauuaauggcccugaaacugauaacucaauucgaaacuuaccagcuauggacagcacuaauaagccucaccuguucaaacacgauauucaccuuaacuguagcauggagaacagccacauugauccuugcuggcgucucacuuuuaccagugugccaaagcucgucgaugagaaagaccgacuggcuacccaugaccgucgccgcgaugggagugccaccccucccccuguucauauucagccucaaagacacgcuaaagcgccgaagcuggccccuaaaugagggcgugauggcuguagggcucguguccauauuggcaucuucguuacuaagaaaugacguucccauggccggcccguugguugccggcggcuuacucauagcuugcuacguuaucacagggacgagcgcagaccucaccguagaaaaggcggcggacguaacuugggaggaggaagcugaacagacggggguuucgcacaaucuuaugaucacaguagacgacgauggaaccaugcggauaaaggaugacgagacggaaaacaucuugacagugcuacuaaagaccgcacuauugauagugucuggaaucuucccuuacucaauuccagcgacccuccuagucuggcauaccuggcagaagcagacgcaaaggagcggaguccuaugggaugucccaucuccuccagagacacagaaagcagaacuggaagagggaguguacaggaucaaacagcaggguauccuaggcaagacucaagucggcguaggcguccagaaggaaggugucuuccauacgauguggcacgugaccagaggagcagugcucacccacaauggaaagcgacuggagccaaacugggcuucugugaagaaggaucugauaaguuauggagggggcuggcgcuugagcgcucaguggcagaaaggagaggaaguccaggucaucgccguagaaccagggaagaacccuaagaacuuucaaacaaugccugggacguuccagacgaccacaggcgaaauaggugccaucgcgcuagacuucaaacccggcacuucgggaucgcccaucaucaaucgagaagggaaaguagugggccuguacggcaacggaguagucaccaaaaacggaggcuaugucuccgggaucgcccaaacaaacgcagaaccggacggaccgacaccugagcuugaagaagaaauguucaagaaacgaaaccuuacaauuauggaccugcacccgggaaguggcaaaacacgaaaauaucuaccggccauaguacgugaagcgauaaaacgucguuugaggacccuuauucuggcccccaccagaguagucgcggccgagauggaggaagcucugaagggccugccaauaagauaccagacgaccgcaacaaagucagaacacaccggucgugagaucgucgacuugaugugucacgcaaccuucacaaugcgacucuuaucgccgguccgaguacccaauuacaacuuaaucaucauggacgaggcgcauuuuacggauccggccagcaucgcagcgcgcgguuacaucaguacacgcgucgggaugggagaagcggccgcaauuuuuaugacggccacaccgcccggaaccgcugaugcauucccgcaaagcaacgccccgauucaggacgaggaacgagacauacccgaaaggagcuggaacaguggaaacgaauggauaacggacuuugccgguaagaccgugugguucgucccgagcaucaaagcggguaacgacauagccaacugccucagaaagaaugggaagaaggucauacagcuaagccgcaaaaccuucgauaccgaauaccagaaaacgaaacugaacgacugggacuucguaguaacgaccgacauauccgagaugggagcgaacuucaaggccgacagggugauagauccccgacgaugccugaaaccugugauucucacggauggccccgaaaggguaauccucgcaggcccgaugccagucaccgucgccagugccgcccaaaggcgcggucgcguaggcagaaauccucaaaaagaaaaugaucaauacauauuuaccgggcagccacucaacaacgacgaggaucacgcgcacuggacggaagcgaaaauguuauuagauaacaucaacacaccagaagguaucaucccagcacucuuugagcccgaaagagagaagucagccgcgaucgacggagaauauagacuuaagggcgaaucacgaaagacauucgucgagcuaaugcgccgcggagaccugccuguguggcuugcccacaagguggcaagcgaaggaauaaaauacacugacaggaaauggugcuucgaugggcaacggaacaaccaaauccuugaagaaaauauggacguagaaaucuggaccaaagaaggagagaaaaagaaacugcguccuagauggcucgaugcacgcacauauucagacccacuagcccuaaaggaauuuaaagacuuugcagcgggacgaaaaucgaucgcgcuagacuuagugaccgagaucgggcgcgucccgagucacuuggcacacagaaccagaaacgcacuggacaaccuagugauguuacacacaucagaacacggaggcagagccuaccgccacgcgguagaggaauugcccgagacgauggagaccuuacucuuauuaggacugaugauucuacucaccggaggggcaaugcuauuccuaaucucaggaaaagguauaggcaaaacauccaucgggcugauaugcguuauagcuagcagcggcaugcuuuggauggcggagauaccgcuucaguggaucgcauccgcaauuguguuggaguucuucaugaugguccuauugauacccgaaccagaaaaacaacguaccccacaagacaaucaauuggcguacguagugauuggaauccucacccucgcagcgauaauagccgccaacgagaugggccucuuggaaacuacaaagcgggaccuuggcaugagcaaagagccgggcguggucuccccgaccuccuaccuggauguggaccuccacccagcauccgccuggacacuguacgcgguagcuaccacaguaaucacgccuaugcuuagacauacgauagaaaacagcacagcgaacgucagucuggcagccauagcuaaccaggcagucgugcugaugggacuagacaagggcuggcccaucucaaaaauggaccuaggcgugccucuacucgcacuaggcugcuacucccaaguaaacccacuaacacucacggcagccgugcuccuacucguuacgcacuacgcaauuauaggcccuggguuacaagcgaaggccacccgugaagcccagaaacguacagcagcggguaucaugaagaacccaacgguagaugggauaauaacaauagacuuggaucccgugaucuacgacuccaaauuugagaaacagcucggacaggucaugcuccugguacuaugcgcaguccaacuacuguuaaugcggaccagcugggcacugugcgaagccuugacauuagcaaccggcccgaucaccacccucugggaaggauccccggggaaauucuggaacaccacaauagccguaagcauggcgaacaucuuccgaggcagcuacuuagcuggcgcaggcuuagcguucucaauaaugaaaagcguagggacaggcaagagagguacaggaagucaaggagaaaccuuaggugaaaaguggaaaaagaaacuaaaucaacucaguagaaaagaguucgaccuguauaagaaaagcgggaucaccgaaguugaccgcaccgaagccaaggaaggccuaaaacgaggagagacgacccaccacgcugugagcagaggcagugccaaauugcaaugguucguugaacgcaacauggugaucccagaaggacgcgucauagaccucggaugcggucgaggaggguggucuuacuacugcgcuggacucaagaaaguaacggagguaagaggcuacaccaaaggcggaccugggcacgaagaacccguaccaaugagcacuuacggauggaacaucguaaaacuaaugucggguaaagacguguucuaucuaccuccggagaagugugacacacugcuaugugacauaggugaaucuucuccgucgcccacggucgaggaguccaggaccauccggguccuaaagaugguagaaccuugguugaagaacaaccaauucugcauaaaaguauugaacccauacaugccagcggugaucgagcaccucgaacggcuccaaaggaagcaugguggaauguugguuaggaacccacuuucccguaacucaacccacgaaauguacuggaucagcaacggaacagggaacauagucuccagugugaacaugguaagcagacuccuacucaaccgauuuacaaugacccaccgacgccccaccauagagaaagacguugacuuaggagcgggaacgaggcacguuaacgcagaaccggagacccccaacauggacgucauaggcgaaagaauuagaagaauuaaagaagaacacaauucgacauggcauuacgacgacgaaaauccauauaagacaugggcguaucacgguucuuacgaggugaaggccacaggcuccgccucaaguaugauaaacgggguagucaaacugcucacgaagccgugggacguaguaccgaugguuacgcaaauggcaaugacugauacgaccccauucggccagcaacgaguauucaaagaaaaagucgacacccgcacgccgcgaccaaugccaggcaccagaaaagucauggagauaaccgcagaauggcucuggcgcacccucggcagaaacaaaagaccuagacucugcacaagagaggaauuuaccaaaaaggucagaacaaacgcggcaaugggggcaguauucacggaggaaaaccaaugggacuccgcaaaggcagccguggaagaugaagaguucuggaaacucguagaccgggagcgggagcuacacaaacuuggaaaaugcggaagcugcguuuacaacaugaugggaaaacgcgagaagaaacuaggggaauuuggaaaagcaaaagguucgcgagcaauaugguauauguggcucggggcccgcuaucuggaguucgaagcacuaggcuuucuaaacgaagaccauugguucucgcgggaaaacaguuacagugggguugaaggcgaaggacuccacaaacuuggcuacauccuccgagacaucagcaagauuccaggcggggccauguaugcagaugacacagccggaugggacacccgaauaacagaagaugaccuacacaacgaagaaaagaucacacagcaaaugaacccugagcaccgucuccuggccaacgcuaucuucaaacucacguaccagaacaaggucguuaaagugcaacgaccaaccccgacaggaacggucauggacauuauaucacgaaaggaccagcgcggaucuggacagguaggcacauacgggcugaacacuuucaccaacauggaggcgcagcuagugcgccaaauggaaggcgaaggaguccuuagcaaggcagacuuagaaaacccacaccuccccgaaaagaaaaucacccaauggcuggagacaaagggcguagagcgacucaaacggauggcaauauccggagacgacugugucguaaaacccauagacgaccgauucgcaaacgcgcucuuggcauugaaugacauggggaaaguuaggaaggacauaccacaauggcaacccagcaaagguuggcacgacuggcaacaaguccccuucugcucacaucacuuccaugagcugauaaugaaggauggacgcaagcucgucgucccgugccgcccccaagaugaacuaauagguagagcuagaaucucacagggagccggauggagcuuacgcgaaacggccugccuugggaaggccuacgcacaaauguggagucuaauguacuuccacagacgagaucuaagacuggcaagcaacgcgaucuguagcgcaguacccguacacugggucccuacaucccgaacaacuuggagcauccacgcacaccaccaauggaugaccacugaagacauguugacagucuggaauagggucuggaucgaggacaacccguggauggaagauaaaacgcccguaacuacaugggagaaugucccauaccuaggcaagcgagaagaccaguggugcgggagcuugauaggccucacgucacgagcgacuugggcgcagaacaucccgacagccauacaacaagugcggucucugaucgggaacgaagaguucuuagacuacaugccgucgaugaaacgguuuaggaaggaagaggaaagugagggcgcaauuugguaa

SEQ ID NO: 26184 - RNA, 9873 nt, Artificial Sequence
  derived and/or modified CDS sequence (opt11) from DENV-3__KC425219__SS-prME
acauccuuaugccuuaugaugauucuacccgcggcccuugcguuccaucucacgagucgcgauggggaacccagaaugauuguuggcaaaaaugaaagggggaaaagccuucuuuuuaaaacagcaagcggaaucaacauguguacacuaauagcaauggaccuaggagaaaugugcgacgacacaguaacauauaaaugcccacacauaacagaaguagaaccagaagauaucgauugcuggugcaaccuaacgucgacauggguaacauaugggacuuguaaccaagcaggagaaagacgcagggacaagcgcuccgucgccuuagcaccccacgucggaaugggacucgacaccagaacacaaacauggaugagugcagaaggggcauggcgucaaguggaaaaaguagaaacaugggcucuuaggcaucccggauucacaauacuggccuuauuccuagcacauuacaucgggacuucccugacgcaaaaagucgugaucuuuauccuccucauguuagugacgccaaguaugaccaugcggugcgucggggucgggaaucgggauuucgucgaggggcuuagcggagcuacaugggucgacguagugcucgaacacgggggcugcguaaccacaauggccaaaaacaaacccacccuagacauagaguugcagaaaacugaggccacgcaacuagcgacccuccgaaaauuauguauagaaggcaaaauaacgaacauaaccacggacucgaggugcccaacacaaggggaggccguacucccggaagaacaagaccaaaauuauguaugcaaacacaccuacguagaucgcggcuggggcaacggaugcggacuguucgguaaagggagccuugucacaugcgccaaguuucaaugccuagaacccauagaaggaaaagucgugcaauacgaaaaccuaaaauacacaguaaucauaacggugcacaccggcgaccagcaucaagugggcaacgagacgcaaggcguaacagcagaaauaaccccacaagcaagcacgaccgaagcaauacuaccggaguacggaacgcugggccuggagugcucgccucggacggggcuggacuucaacgagaugauucuucucaccaugaaaaauaaagcauggauggugcacaggcaaugguucuucgacuugccccuaccauggacgucaggagcgacaacggaaacgccaacauggaaccgcaaagagcuccuagucaccuucaaaaacgcgcacgccaagaaacaggagguugucguauuaggaagccaagagggggcaaugcacacggccuuaacuggagcgacggagauccaaaauuccgggggaacaagcaucuucgcgggacaccuaaaauguagauuaaaaauggacaagcuagagcucaaagguaugagcuaugcgaugugcacgaacacauuuguacuuaagaaagaaguaagcgaaacccagcacggaacaauccugaucaaaguggaguaccguggcgaagaugccccgugcaaaauccccuucaguaccgaagauggacagggcaaggcccacaacggaagacucauaacagccaacccggugguaacgaagaaggaagaacccguuaauauugaagccgaacccccuuuuggcgaaaguaacaucguaauaggaaucggcgacaacgcguuaaagauaaacugguacaagaaaggaaguucaaucggaaagauguucgaagcaacugcaagaggcgcucgaagaauggcuauccugggagacacugcaugggacuucggcagcgugggaggcguccugaacucccucggaaagaugguccaucagauuuucggaucagcauacaccgcccucuucagcggcguguccugggucaugaaaauaggcauaggcguccuccugacauggauugguuugaauccaaagaacacuuccaugagcuucucuugcauagcgaucgggauaauaacuuuguauuuaggcgcugugguccaggcagauauggggugcgucaucaauuggaaaggaaaggaacuaaaaugugggagcggcaucuucguuacaaacgagguccacacauggacggaacaguauaaauuucaagccgauagucccaagcgacuggcgacugccaucgcaggcgcgugggaaaacggcgucugcgggauaaggucaaccaccagaauggaaaacuuauuauggaagcaaaucgcgaacgagcugaauuacauauuaugggaaaacaauauaaaacuuaccguagucgucggagacauaaucggaguccucgaacaggggaagcggaccuugacaccccaacccauggagcugaaguacagcuggaagacauggggcaaggcaaaaauaguaaccgcagagacacagaacucgagcuucauaauagauggcccaaauacgcccgaaugcccuagcgccucgagggcauggaacguaugggagguagaagacuaugguuuuggcgucuucaccacaaacaucuggcugaaacucagagaaguguacacccaacugugcgaucaucgacuaaugagcgcagcggugaaggaugagcgcgcggugcaugcagacaugggguacuggauagaaucacagaaaaacggcucauggaagcuagagaaggcaagccucauagaaguaaaaaccuguacauggccgaaaagccacacccuauggagcaacggcguccucgagagcgacaugauaauacccaaaucacuggcggguccaauaucccaacauaaccaccggccgggcuaccacacacagaccgcaggcccguggcaucuaggaaaauuggagcuugauuucaacuacugcgaaggaaccacaguggucauuacugagaauugcgggacccgcgggccaucucucaggaccaccaccguaagcggcaaacugauccaugaguggugcugucgcagcugcacauuaccaccgcucagguacaugggugaggacggguguugguacgggauggagaucaggccuauaagcgagaaggaggaaaacauggucaagagucuaguaagcgccggaagcggcaaaguagacaauuucacgaugggagugcuaugccuggcgauucuauucgaagaggugaugcguggcaaauucgggaagaaacacaugaucgcgggcguguucuucacguucguacugcucuuaucuggccagaucacuuggagagacauggcgcacacauuaaucaugauuggaucaaaugccagugaucgaaugggcaugggcgugacauaccucgcucugaucgccacauuuaagauucagccuuuucucgcgcuaggguucuuucuaagaaaguugacaucacgggaaaaucuacuccuaggcguggggcuagcgauggcaacuacccuacaacucccggaagauaucgaacagauggccaauggcauagcccugggucuaauggcccuaaaacugaucacccaauucgagacauaucagcuuuggacggcacugauaucgcuuacgugcucgaacacgauguucacacucacuguagcauggcggacggcgacccuuaucuuagccggggucucccuccucccagugugccaaagcaguucaaugcgcaagacggacuggcugcccauggcggucgcggcaaugggcgugccacccuugccccucuucauuuuuagccuuaaggacacacugaaacgcaggagcuggccucuaaacgaaggaguaauggcggugggacucgucaguauacuagcaaguucacuccucaggaaugacguaccuauggcaggaccccugguagcgggagggcuacugaucgccuguuacgugaucacagggacaagcgcggaccugacggucgaaaaagcagcagacauaacuugggaggaggaggcagaacaaaccgggguaagccacaauuugaugauaacuguugaugacgacggcaccaugagaauuaaagacgacgaaaccgaaaacauacucacaguacuccuaaagaccgcacuucucauagugucgggaguauuucccuauucaaucccagcaacacugcucgucuggcauacauggcagaagcaaacgcaaaggagugggguuuuaugggauguacccagcccgccagaaacgcaaaaggccgaguuagaagaaggcguauauaggaucaagcaacaaggaaucuucggcaagacccaggucggggucgguguucaaaaagaaggagucuuucauacaauguggcaugugacuagaggggccguccucacauauaacgguaaacgacuagaacccaacugggcgucaguaaagaaagaccugaucagcuacggagggggauggcgcuuaucggcgcaauggcaaaaaggcgaagagguccaggucauagcaguggaaccggguaaaaaucccaaaaauuuccaaaccaugccgggaaccuuucaaacaacuaccggggagaucggcgccaucgcgcuagacuucaaaccagggacaucggggagccccauaaucaaccgggagggcaagguagucgggcuguacggcaacgggguggugaccaaaaacggcggcuacgucagcgggauugcacaaacuaaugccgagcccgauggacccacccccgaacucgaagaagaaauguucaaaaagcgaaaccuuacaauaauggacuuacacccagguagcggaaaaacaaggaaauacuuacccgcaauagugagagaagccaucaagaggaggcucaggacgcugauacucgcaccaacgagaguugucgccgcggaaauggaagaggccuuaaaagggcuaccgauccgcuaccaaacaacggcaacgaaaagcgagcacaccgggagggaaauuguugaucugaugugucaugcaacguucaccaugcgccuucuaucaccgguccgagugcccaacuauaaccuaaucauaauggacgaagcccacuucacggacccagcaagcaucgccgcccgcggcuacauauccacgcgcguaggcaugggagaagcagccgcgauauucaugacggcgacuccacccggaacagcagaugcauuuccucaauccaaugcccccauacaagacgaagaaagagacauaccagaacgcucguggaacagcgggaaugaauggauuacggacuuugcuggaaagacaguuugguucgugccgagcauaaaagcgggaaaugacaucgcuaacugccucaggaaaaacggcaagaaagucauccagcugucccgcaaaacauucgauacagaauaccagaaaaccaaacucaaugauugggacuucguggucacaaccgacaucuccgaaaugggggcaaauuucaaagcagacagagucaucgaccccagacgaugccucaagcccguaauacucacggacggcccggaacgggucauccucgcggguccaaugccuguaaccgcugcguccgcugcgcagcgccgcggacgagucggccgaaacccgcagaaggaaaaugaccaauauaucuucacaggccagcccuuaaacaacgacgaggaucacgcccacuggacggaagcaaagaugcuacuagauaacaucaacaccccugaagggauaauuccggcacucuucgagccagaacgugagaagagugcugccaucgacggagaauacaggcucaagggagagucaagaaaaacguucguagaacucaugcgccguggggaucugccaguguggcucgcucacaaagucgcaucggagggcaucaaauacaccgauaggaaaugguguuuugaugggcaacgaaacaaccaaauauuagaggagaauauggacgucgagaucuggacaaaagaaggagagaaaaagaagcuaagacccagauggcucgacgcaagaaccuacuccgacccucucgcgcuaaaagaguuuaaggauuucgcagcuggacgaaagucgauugcccuggaccuuguuacagaaauaggccgcguccccagccaccuggcgcauaggacucggaaugcucuagauaaucuuguaauguuacacaccagcgaacacggaggccgugcguaucgacacgccguugaggaacugcccgagacaauggaaacucuccuccuccuaggacuuaugaucuuacucacgggaggagcgaugcuauuccuaauaucggggaaaggcaucggaaaaaccuccauugggcuaauuugcguaauagcuaguagcgguaugcuguggauggcagagaucccacuacaauggaucgccucagcgaucguguuagaguucuucaugauggugcuacucauaccggagccugaaaaacaaaggaccccacaagauaaccaguuggcauacguagucauuggaauacuaacucuugcagccauaauagcagccaaugaaauggggcuucuggagaccaccaaacgagauuuagggaugagcaaagaaccuggggugguaucgccuaccagcuaccucgacguagacuuacacccggccagugccuggacgcucuacgcuguugcuacaacugucauaacacccauguuaagacacaccauagaaaacucaaccgcaaacgugagccuagccgcaaucgccaaccaagcuguaguacuaauggggcuugacaagggguggccgaucagcaaaauggaccugggagugccacucuuagcccucgggugcuacagccaaguuaacccgcugacacugacggcugcagucuugcuacugauaacacauuacgcgaucauaggacccggacugcaagccaaagcgacgcgagaagcacagaagaggaccgcagcaggcaucaugaagaacccgaccguagacggcaucaugacaaucgaccuugaucccgugaucuacgacucgaaguucgaaaagcaacuaggucaaguaaugcuccuaguucucugcgcgguacaacugcuccuaaugagaaccucaugggcacucugcgaagcauugacccucgccaccgggcccaucacgacguuaugggaaggcucaccaggaaaauucuggaauaccaccaucgcugugagcauggcaaauaucuuccgaggcucauaccucgcaggagccggccucgccuucagcauuaugaagaguguugguacaggcaaacggggaacugggagucagggugaaacccuaggggaaaaauggaagaagaaacugaaccaauuaagccggaaagaguuugaccuguauaaaaagucaggcauaacggaagucgaccgcacagaggcaaaagaaggacuaaaaaggggcgagauaacucaucacgccgugucucggggauccgccaaacugcaaugguuuguagagcgaaacauggucauaccagaggggcgagugaucgaccucggcuguggccgaggcgguuggaguuacuauugugcgggccuuaaaaagguaacagaagucaggggcuauacaaaaggaggccccggacacgaggaaccggucccaaugucuacauacggauggaacauagucaagcuaaugucaggcaaggauguuuucuaccuucccccagaaaagugcgacacacuguuaugcgauauuggugaaagcuccccguccccgacuguugaagagagccgcaccauacgggugcucaaaauggucgaaccgugguugaagaauaaucaauuuugcauaaagguauuaaaccccuacaugccgaccgugauugaacaccuugagagacuccagcgcaaacacggcgggaugcucguccgcaacccucuaaguagaaauuccacacacgaaauguacuggauaucaaauggcacaggaaacauaguggccaguguaaauauggugagccgacuccuucugaaccgcuucacgaugacgcaccgaagaccgacaauagagaaagacgucgacuugggcgcaggcacgaggcacguaaacgcggaaccggagacccccaauauggacguaauaggugaaaggauaaaacggauuaaagaagaacauaacucgaccuggcauuacgacgaugagaacccauacaagaccugggccuaccacggcucauacgaagugaaagccaccggguccgcgagcucaaugauaaacggggucguuaaacugcucacuaagccgugggaugucguaccuaugguaacccaaauggccaugaccgacaccaccccauucggacagcaacgggucuuuaaagaaaaaguugacacccgaacuccacgcaguaugccgggaacccgccgaguaaugggcauuacggccgaguggcucuggcggacauuagggcgcaauaaaaagccaagacuaugcacacgggaagaguucacaaagaagguacgaacgaacgcugcaaugggagcggucuuuacagaagagaaucaaugggacucugcgaaagcagccgucgaagacgaagacuucuggaagcucguggacagagagcgcgagcuacacaaacucggaaaaugcggcagcugugucuacaauaugaugggcaagcgcgagaagaaacucggugaguucggaaaagcaaagggaagccgcgcaaucugguauauguggcugggugcacgauaccucgaauuugaggcacugggcuuuuugaacgaagaccacugguucucaagagaaaacuccuacuccggcgucgaaggcgaaggccuacacaagcucggcuacauucugcgagacauuucaaaaaucccgggcggagccauguacgcagaugacacggcuggaugggacacccgaauaaccgaagacgaccuccacaacgaagaaaagauaacacaacaaauggaccccgagcaccgacaacucgcaaacgcgauauucaaacuaaccuaccaaaauaaggucgugaaaguacaacggcccacacccacaggaacggucauggacaucauaucccgcaaggaucaaagagguagcggacagguaggcacauacggacugaauacguuuaccaacauggaggcgcaacugauacgccaaauggaaggagaaggaguccucucaaaagccgaccuggaaaacccccaccuucccgagaagaaaaucacgcaauggcuagaaacaaagggagucgaaagguuaaagcggauggcaauaucaggggaugauugcguugucaaaccaaucgacgacagguuugcgaaugcacugcuugcccugaacgacauggggaagguccgcaaagacauaccacaauggcagccaucaaaaggguggcacgauuggcaacaaguaccauucugcucucaccacuuccacgaacuaaucaugaaggacggccgaaaacucgucgugcccugccgcccgcaggacgaacugauaggcagagcccgcaucagucagggcgcaggauggagccucagagaaacugcaugucuuggcaaggcauacgcccagauguggagccuaauguacuuccaccgacgcgaucuacggcuugcauccaacgcgauaugcucagcggucccaguucauuggguuccgacuagccgaacaaccuggucgauccaugcccaccaccaguggaugacaacggaagacaugcuaacggucuggaaucguguauggauugaagacaacccauggauggaagauaaaacccccguaacaacaugggaaaacguuccauaccuaggaaaacgggaagaccaguggugcgggucacucaucgguuugacuucgagagcaacaugggcgcagaacaucccaacagcaauacaacaaguccggucacucauugguaacgaggaguuucuugauuauaugccgagcaugaagcgguuuagaaaagaagaggaguccgaaggggccaucugguag

SEQ ID NO: 26185 - RNA, 9873 nt, Artificial Sequence
  derived and/or modified CDS sequence (opt11) from DENV-3__AY858037__SS-prME
acaucucugugucucaugaugaugcugcccgucacccuggccuuccaccucacgucccgcgacggggagccgcggaugaucgucgggaagaaugaacggggcaagagccugcuguucaagacugccuccgggauuaacaugugcacacucauugcgauggaccugggcgagaugugcgacgauaccguaacauauaagugcccccugaucacagagguggagcccgaggacauagacugcuggugcaauuuaacuucgaccugggugacuuaugggaccugcaaccaggccggcgagcaccgucgcgauaagaggucgguggccuuagcaccccacguggggaugggcuuagacacccgcgcccagacauggauguccgccgagggcgccuggaggcagguugaaaagguggagacgugggcuuuccgccacccgggguucaccaucuuggcccuuuuccuggcgcauuauaucggcacaucucucacccaaaagguggucaucuuuauccuccugaugcucgugacgccaagcaugaccaugaggugugugggggucgguaaccgcgacuucguggagggcuuguccggggccacguggguggacguaguacuggagcacggcgguugcgugaccacgauggcgaagaauaagccuaccuuggacaucgagcugcagaagaccgaggcaacccaacuggccacacucaggaagcucugcauagaaggcaagaucaccaacgugacaacagacagccgcugccccacacagggcgaggcaauccucccugaggaacaggaucagaacuauguguguaagcacaccuacguggaccggggauggggcaacgggugcggccucuucggcaagggaucccucguaaccugcgcuaaguuccagugccucgaaagcaucgagggaaagguggugcagcacgagaaucucaaguacaccgucauuauuacggugcacacaggugaccagcaucaggucggaaacgagacccagggggucacagccgagaucacgccacaggcguccaccguggaggccauacugccagaguacggaacccuugggcucgaaugcagcccucgcacagggcuggacuucaacgagaugauccuguuaaccaugaagaauaaggccuggaugguccaccgacagugguucuucgauuuaccgcugcccuggacguccggcgcaacaacagagacuccgacguggaauaagaaggaacuccuugugaccuucaagaacgcccacgccaagaaacaggagguaguagugcuggggagccaggagggagccaugcacaccgcgcucacaggugccacggaaauccagaccuccggugggaccucuaucuucgccggccaucugaagugucgccucaagauggacaagcucgagcugaagggcauguccuacgcaaugugcagcaaugccuuuguacugaagaaggaggucagcgaaacccagcacgggacgauccucaucaaaguagaguacaagggcgaggacgcgcccuguaagaucccguucucaacugaggacgggcagggcaaggcccauaacggccguuuaauuaccgccaaccccguggucaccaaaaaggaggaacccgugaacauugaagccgagccuccguucggggagagcaacaucaucaucggcaucggggaccgggcgcugaagaucaacugguauaagaagggcucgagcaucgggaaaauguucgaggccacugcgagaggggcccgucggauggcaauccugggcgacaccgcgugggacuucgguagcgugggcggcguccucaauagccuggggaagauggugcaucagaucuuugggagugccuauacggccuuauucucgggcguuuccuggaucaugaagaucgguaucggcguccuccugaccuggaucggccugaacagcaagaacacguccaugucguucuccugcaucgugaucgggaucaucaccuuauaucugggggccguaguacaggcggauaugggcugcgugaucaauuggaagggcaaggagcugaagugcggcucaggaaucuuugugaccaacgagguccacacuuggacugagcaguacaaguuucaggcagauucccccaaacgucucgccacggcaauagccggcgccugggagaacggggucugcggcauccguagcaccacccggauggagaaucugcuguggaaacagaucgcaaaugaacuaaacuacauccugugggagaacaacaucaaacugacgguggucgugggagacaucauaggcgugcucgagcagggcaagcgcacccugaccccacagcccauggaacugaaguacucauggaagaccugggggaaagccaagaucgucaccgccgaaacccaaaacucuuccuucauaauugacgggcccaauacacccgagugcccaaacgccagccgggccuggaacgugugggaaguggaggacuacggguucggcguuuucacgacuaacaucuggcuuaaguuaagggagauguacacccagcuuugugaccaucggcugaugucagccgcagugaaggacgagcgcgccgugcacgccgacauggguuacuggaucgagucccagaagaacgggagcuggaagcuggagaaagcaucccugaucgaggucaagaccugcaccuggccgaaaucccacacccucugguccaacggugugcuggagagcgacaugaucaucccgaagucccuggccggacccaucucucagcauaacuacagacccggcuaccacacgcaaaccgcggggccguggcaccucggcaagcuggagcuggacuuuaauuacugugagggcaccaccgucgucaucacggaaaacugcgggacccgcggccccagccuccgaacgacgacagugagcgggaagcugauccacgaguggugcuguaggucaugcacccuaccuccccugagguacaugggcgaggacggcugcugguacgguauggagauccgccccaucaacgagaaagaggagaacauggucaagucacugguuagcgccggcucuggcaagguggacaacuucacaaugggcguguugugccuagccaucuuauucgaagaggucaugagggggaaguucgguaagaagcacaugaucgcgggugugcuguucaccuucguuuuacugcucuccggccagaucaccuggcgcgauauggcgcggacgcuuaucaugaucggcagcaacgccucggaccguauggggaugggcguuacauaucuggcgcuaaucgccacguucaagauccagccguuccuugcgcugggguucuuccugagaaaguuaaccagccgcgagaaccuucuccucggcgugggccuggccauggcaacgacccugcaacuccccgaggacaucgagcagauggcaaacgggaucgcgcugggauuaauggcccucaaacugaucacucaguucgagacguaccaguuauggaccgcccucgugucauuaauguguuccaacacuaucuucaccuugacagucgcauggcggaccgccaccuuaauccuagcaggcauaucacucuuccccgugugucaguccagcuccaugaggaagacagacuggcucccgaugacggucgccgccaugggcguacccccgcugccccucuucauuuucucccuuaaggacaccuuaaagcgccgguccuggccacugaacgaaggugucauggccgucggccucgugucgauucuugcuuccagcuuacugcgcaacgaugugcccauggcggggccccuugucgcugggggccugcucauagccugcuacgugauaaccggcaccucggcagaccucacgguggagaaagccgcggacgucacuugggaggaggaggccgaacagaccggggugagccacaaccugaugauaacaguggacgacgacgggacgaugaggaucaaagacgacgagaccgagaacauccuaaccgucuuacugaaaaccgcgcugcugauugucuccgguaucuuccccuacucgauuccggcaacccuucugguguggcauacuuggcagaaacaaacccagcgcuccggcguccuuugggacgugcccagucccccagagacccagaaggcugagcuggaggagggcguauaccggaucaagcagcagggcaucuucgggaagacccaggucggugugggaguucaaaaggagggcgucuuccacacgauguggcaugugacgcgcggagcgguacucacuuacaaugggaaaagacucgagcccaauugggccagugucaagaaggaucugaucagcuacggagggggcuggcgcuuguccgcacaauggcagaagggugaggaaguccaggugaucgccgucgaacccggcaaaaaucccaagaacuuccagaccaugccgggcaucuuccagacgaccaccggugagaucggcgcaaucgcccuagacuucaaaccggguaccagcggcagcccuaucauaaaccgggaaggaaagguaguggggcuguacggcaacggagucgugaccaagaauggcggcuacguguccggcaucgcccagacgaacgcugagccggacggccccacacccgagcuggaagaagaaauguuuaagaagcgcaaccucaccauaauggaccugcacccuggguccggcaagacgcggaaguaucuccccgccauagugcgagaggcgaucaagcggcgccuccggacccuaauacuggccccuacacgcgucguggccgcggagauggaggaagcccucaaggggcugccgauccgguaccagaccacggccaccaagagugagcauacgggcaaggagaucgucgacuugaugugccaugccaccuucaccaugcgccuccugagccccgugcggguaccgaacuauaaccugaucaucauggacgaagcacauuucaccgacccggccagcaucgccgccaggggguacaucucgacccgugucggcaugggcgaggcugccgcaauauuuaugaccgcgacgccacccgguacugccgacgccuucccccaauccaacgccccgauccaggacgaggagcgcgauaucccugagaggucuuggaacucuggcaacgacuggauuacggacuucgccgggaagaccgucugguuuguacccagcauaaaggcggggaacgacauugccaacugcuugaggaagaacggcaaaaaggucauccagcuuucccgcaaaacguucgauaccgaauaccagaagaccaaacuuaaugacugggacuucguugugaccacggacauuuccgagaugggagcaaacuucaaagccgaccgggucauugacccuagaaggugucucaagcccguuauccugacugacggccccgagcgagugauccuggcgggucccaugcccgucaccguggcgucugcggcccagagacgcggccgggucgggcggaacccgcagaaggaaaacgaccaguacauauucaccggccagccucucaacaacgaugaggaucacgcacauuggacggaggcgaagaugcugcuggacaacauaaauacgcccgagggcaucaucccagcuuuauucgagcccgagcgggagaaaagcgccgccaucgacggcgaauacagacugaagggcgaaucccggaagaccuucguggaacugaugcgccggggagaccucccagugugguuggcccauaaggucgcgagcgagggcauaaaguauaccgaccgcaaguggugcuuugacggagagcggaacaaccaaauccuggaagaaaacauggauguugagaucuggaccaaggaaggcgagaagaaaaagcuacgcccucgguggcuggacgcacgcaccuauuccgacccucucgcccucaaggaauuuaaagacuucgcggcuggccgcaagagcaucgcgcuggaccuagugacugagaucgggagggucccgucccaucucgcccaccgaacucgcaacgccuuggacaaccuuguaaugcuucacaccagcgagcacggcggccgcgcuuacaggcacgccguggaggagcugcccgaaacaauggaaacccugcuucugcugggcuuaaugauucuguuaacuggaggcgcgaugcuauucuuaaucagcggaaagggggucggcaagacauccauuggucuaaucugcguggucgcaagcuccggcaugcucuggauggccgacauaccccuacaguggaucgcuucugccaucguccuggaauuuuucaugauggugcucuuaaucccggagcccgagaagcagcgcacgccccaggacaaucagcuggcguacguagucauugggauccugacccuggccgcaaucguugcagccaacgagauggggcugcuugagacgaccaagcgggaucugggcaugucaaaagagcccggcguggucagcccgaccuccuaccuugacgucgaccuucaucccgcgucggcuuggacccuguacgccguugcuacuacggucaucacgcccaugcuucgccauacuaucgagaacucaacagcgaacgugucucuugccgccaucgccaaccaggccgugguccugaugggccuggauaagggguggcccaucuccaaaauggaccucggcgugccacuucuggcgcucgggugcuauagccaggugaauccccugacacugacggccgcaguccuccugcuugugacucacuacgccauaaucggcccaggacuccaggccaaggcgacccgggaggcccagaagcgcacggccgccgguaucaugaagaaccccaccguggacggcauuaugaccauugaccuggacccgguaaucuaugacagcaaguuugagaagcaacugggacaggugaugcuccugguccugugugcuguccagcucuuacugaugagaaccagcugggcuuuuugcgaagcccucacccuggccacggggcccaucacaacccugugggaaggcucccccggaaaguucuggaacaccaccauugccgugucgauggcgaacaucuuccgcggauccuacuuggcuggggccggacuggccuucagcaucaugaaguccguggggaccggaaagcgagguaccgggagccagggcgagacccugggcgaaaaguggaagaaaaagcucaaccagcuaagccgcaaggaguucgaccuguacaagaagaguggcauuaccgaggucgaucggaccgaggcaaaggagggguuaaaacgcggcgagaucacccaucaugccguaagccggggcagugccaagcugcagugguuuguagagcgcaauaugguuauacccgaggggcgcgugaucgaccuggguugcggccgcggcggauggagcuacuacugcgcaggccucaagaaggucaccgaggugcggggauacacuaaagggggcccggggcaugaggagccuguucccaugagcaccuacggcuggaacaucgugaaacuuaugagcgggaaggauguauucuaccugcccccggaaaaaugcgauacgcuuuuaugugacauuggcgagaguagcccguccccaaccguggaggagagucgaaccaucagagugcugaagauggucgagccguggcugaagaacaaucaguucuguauuaagguccucaaccccuauaugcccacggucaucgagcaccuggagcgguugcagcgcaaacacggaggaauguugguccgaaacccccuguccagaaauucgacccacgaaauguacuggauuuccaacggcaccggcaacauugugucuucggugaacauggucucccggcugcuacuuaaccgcuucaccaugacguaccggcgcccuacaaucgaaaaggacguggaccugggggcgggcacaagacacgucaacgccgagccagagaccccgaauauggacgucaucggggagcgcauccggcgcaucaaggaggagcacuccucuacauggcacuacgacgaugaaaaccccuacaaaacuugggcauaccacggcucguacgaggucaaggccaccggauccgcaagcucuaugauaaacggagucguuaagcuccugacuaagccgugggacguaguccccacggugacgcagauggcuaugaccgacacaacgcccuucgggcaacagcggguguucaaagaaaaggucgacacacgcacgcccaagccgaugcccggcacccggaaagugauggagaucacugccgaauggcuguggcgcacccucggccguaacaagaggccccggcugugcacccgcgaggaguucacaaagaaggugcguaccaacgcggccaugggggccgucuucacggaagagaaucagugggacagcgcccgggcggccguggaggacgaggaauuuuggaagcugguggaucgcgagcgagagcuccauaagcugggcaagugcggguccugugucuacaauaugaugggcaagcgggagaagaaacuuggggaguucggcaaggccaaggguagccgggcaauaugguauauguggcucggggcccgcuacuuagaguucgaggcgcugggcuucuugaacgaggaccacugguucucccgggagaacagcuacuccgggguugagggcgaggggcugcacaagcuaggguacauccuccgggacaucucaaaaauccccgggggugccauguacgccgacgauaccgccggcugggauacaagaaucacggaggacgaccugcacaacgaggagaagaucacgcaacagauggacccggagcaccgccaacuggccaacgcgaucuucaagcuaaccuaccaaaacaaaguugugaaagugcaacggccuacccccaaggggacuguaauggacaucaucucccgcaaagaccagcgaggaagcggccaaguagggaccuacggccugaacacauucaccaacauggaggcccagcugauccgccaaauggaaggggagggcgugcucuccaagaccgaccuggagaacccgcaucugcucgagaagaaaaucacgcaguggcuggagaccaaagggguggagcggcugaaacgcauggcgaucagcggcgaugacugcgucgugaagcccauagacgaccgauucgccaacgcccuccuggcgcugaacgacauggggaaggugcgcaaggauaucccccaguggcagcccucgaaggguuggcacgauuggcagcaggucccuuuuuguagucaccacuuccaugagcucaucaugaaggacggccggaaguuggugguccccugccgcccccaggacgaacugaucgggcgggcacgcaucucccaaggggccggguggucacucaaggagaccgcaugccuggggaaagccuaugcgcagaugugggcccugauguacuuccaccgccgugauuugcgccuggccagcaacgccauuuguagcgcagugccagugcacugggugcccaccucccggaccacauggagcauccacgcccaucaccaguggaugaccacagaggacaugcugacggucuggaaccgcguauggaucgaagacaacccguggauggaggacaagacccccgugaccaccugggaggacgucccguaucucggaaaacgggaagaucaguggugcgggagccugaucggacuaacgucccgcgccaccugggcccagaacauccucaccgccauccagcagguucgcucgcugauuggcaacgaggaguuccuggacuacaugcccuccaugaagcgauuucggaaggaagaggagagcgagggcgcgaucugguga

SEQ ID NO: 26186 - RNA, 9873 nt, Artificial Sequence
  derived and/or modified CDS sequence (opt11) from DENV-3__KJ737429__SS-prME
acaagccuaugccugaugaugaugcuaccagcaacccuggcguuccaucuaacaagccgcgacggggagccucgcaugauagucgguaagaacgaacgggggaaaucccuauuauucaaaacggcguccgguauuaacaugugcacucugauagcaauggaccugggcgaaaugugugacgacacagucacuuauaaaugcccacucauagccgaggucgagccagaggacaucgauugcugguguaaucugacgucuacgugggugacauacgggacgugcaaccaagcaggcgagcacaggcgcgacaagcgcagcgucgcguuggcgccacauguuggcaugggacucgauacgcggacccagaccuggaugagugccgaaggggccuggcgucaaguagagaaaguagaaacaugggcgcuacgccaccccggcuucacgauccucgcuuuguuccucgcacacuacauaggcaccagcuuaacacaaaaagucguuauauuuauccuacugaugcucguaacccccuccaugacgaugagauguguagguguagggaacagagacuucguggagggcuuaucgggcgccacauggguggaugugguucuagaacacggaggcuguguuacgacgauggcuaagaacaagccaacccucgacauugaguuacaaaaaacggaggccacgcagcuagcaacacuuagaaaacuaugcauugaaggaaaaauaacgaacauuaccacagacucgagauguccgacacaaggcgaagcgauccuuccggaggaacaagaccaaaacuacgugugcaaacacacguacguagaccgcggguggggcaacggcugcggccuguucggaaaaggcucccugguaacuugcgcgaaguuccaaugucucgaaccaauagaaggaaaggugguacaauacgaaaaccugaaauacaccguaaucaucaccgugcacacaggcgaccaacaccaagucggaaacgauacacaaggaguaacgguggagauaacaccgcaagccagcacaguagaagcagugcucccggaguacggcaccuuaggucuugaaugcucaccgcgcaccggccuagauuucaacgaaaugauccuacuuacgaugaagaacaaggcuuggaugguacaucgacaaugguuuuuugaccuaccgcuccccuggacaaguggggcaaccacggagacgccaacauggaaccgcaaggaacuauuaguaaccuucaaaaacgcgcacgccaaaaaacaagaaguagucguacuaggaagccaggaaggugcgaugcacacggcccugacgggggcuacggaaauucagaacuccggugggaccaguaucuuugcuggccaccuaaaauguagacugaagauggacaagcuagaacuaaagggaaugucauacgccaugugcuuaaacaccuucguacugaaaaaagaggugagcgagacccaacacggcacuauccugaucaagguugaguauaaaggagaagacgccccgugcaaaauccccuucuccacugaggauggucaaggaaaggcccacaacggaagauugaucacagcgaaucccguagucaccaaaaaagaggaaccagugaacaucgaagcggagccccccuucggugaaucaaacauaguuauaggaaucggagacaaagcgcucaaaauaaacugguacaaaaaggggucuucgauagggaaaauguucgaggcaacggcacgcggcgcacggcggauggccauccuaggcgacacggcuugggacuuuggaucaguuggaggcguucucaacucacugggaaagauggugcaccagauauucgguuccgcguauacagcgcuauucucaggcguuuccuggauuaugaaaauagggaucggaguacucuuaacguggauaggccucaacagcaagaacacuucuaugucguucaguugcauuguaauuggcaucauaacgcuauaucuaggagcaguaguccaagcggacauggggugcguuauaaauuggaaaggaaaggaacugaagugcggguccgguaucuucguuacgaacgagguacacacguggacagagcaguacaaguuccaagcggacagccccaagagacucgcaacagcgaucgcaggagcuugggaaaacggcguauguggaauccgaucgaccaccagaauggaaaaucuacuuuggaaacaaaucgccaaugagcuaaacuacauccugugggagaacaauaucaagcuaacgguggucgugggagacaucauuggggugcuggaacagggcaaacgcacccugacuccccaaccaauggaacugaaauacaguuggaagaccuggggaaaagcaaaaauuguuaccgccgaaacacagaacagcagcuucaucauagacgggccgaauacuccggaaugcccgucagccagucgcgcuuggaaugugugggagguugaggauuacggauuuggaguauucacaaccaauauauggcugaaacuaagagagguguacacccaguccugcgaccaccgccucaugagcgcagcaauaaaagacgaacgugcugugcaugccgacaugggcuacuggaucgagucccaaaaaaacgggaguuggaaacucgaaaaagcgagcuucauagagguaaagaccuguacuuggcccaagucucacacgcuauggagcaacgggguauuggaguccgacaugauaauaccaaagucccucgccggccccauaucacaacacaaccaccgcccuggauaccacacgcaaaccgcaggaccuuggcaucuaggcaagcuagagcuugacuucaauuacugcgaaggaacuacagucgucauaaccgaaaacugcggcacuagaggaccuucacucaggacuacgacuguaagugggaaacuuauccacgaaugguguugucgcagcuguacccucccaccccugagauauaugggagaagacggguguugguacggaauggaaauccggccaaucaacgaaaaggaggaaaacauggugaaaagucuaguauccgcagggucaggaaagguagacaacuuuacgauggggguauuaugccucgcaauccuuuucgaggaagugaugaggggaaaauuuggaaaaaaacacaugauugccggaguauuguuuacguucguacuacuacucucaggucagaucacauggcgagacauggcccacacgcucauuaugaucggaucgaaugcaagcgacagaauggggaugggcgucacauaccuagcucuaaucgcgaccuucaaaauacaaccuuuccuggcacugggguucuuccuucggaaacugaccagccgugagaaccuccuacuaggggucggcuuagccauggcgacaacacuucagcuaccugaagauauugagcaaauggcuaacggaaucgcccuagggcuaaugacguugaaacuaaucacacaauucgaaacguaccaacuauggaccgcgcuagugucccuaacaugcuccaacacgauauucacucugaccguagcauggcgaacagcgacgcugauccucgccggagugucgcuccugccacugugucagagcuccucuaugcgcaaaacagacuggcuaccgaugacggucgcugcaaugggaguuccaccccuaccacucuucauuuucucccuaaaagacaccccaaaacgaaggucuuggccccugaacgaaggagucauggccguaggacucgugaguauacucgcgagcucacuccuucgcaacgaugucccgauggcgggcccccucgucgcgggcggacugcuaauugcgugcuauguaauuacgggaacaagcgcugaccucaccguugaaaaggccgcggacgucacaugggaggaggaggcggaacagacuggaguuagccauaaccucaugaucacggucgacgacgacggaacgaugcgaauaaaggacgacgagacagagaacauauugacuguccugcucaaaacggcccuacuaaucguaagcgggaucuucccguacucgaucccagcgacguuacuggucuggcauacauggcaaaagcagacacaaagaucgggagucuugugggacguaccaucacccccagaaacucagaaggcggaguuagaagaaggcguguacagaauaaaacagcagggaauauucgggaagacccaggugggcguagggguacaaaaagaaggagucuuucacacaauguggcacgucacaagaggugcaguccucacacacaacggcaagagacuggaacccaacugggccagcgugaaaaaggacuuaaucucuuacggaggcggcuggaggcuuagcgcccaguggcaaaaaggagaagaaguccaaguaauagcaguagaacccggaaagaauccaaagaauuuccaaaccaugccugguaucuuccaaacgacaacgggcgaaaucggagcgauagcccuggacuucaaaccagguacaucgggaagcccaauaauaaaucgggaagggaaggucgucggccuguaugguaacggagucgugacaaaaaauggaggguacgucucaggaauagcgcaaaccaacgcugagccugacggaccaacaccggaacuagaggaagagauguucaaaaagcgaaacuugacuauaauggaccuccacccuggaucaggaaaaacgcgcaaauaccuacccgccauaguuagagaggcuauaaagcgccgacuacgaacccuaauauuggcccccacacgaguaguagccgcggagauggaagaagccuugaaaggcuugccaauacgguaccaaacuacagcaaccaagagcgagcauacaggccgcgagaucguugaucuuaugugccacgcaacguucacaaugagacuacuaaguccggucagagucccgaacuacaaucuaauaauuauggacgaggcgcacuucaccgauccggccaguauagccgcgcggggguacaucagcacaagagucggcaugggggaggcagcagcaauauuuaugacugccacuccgccugggacagcagaggcauuuccgcagagcaacgcacccauucaggacgaggagcgggacauccccgaacggucuuggaacagcgggaacgaauggauaacggacuuuguaggcaagacagucugguuuguacccaguauaaaggcgggcaaugauauagccaacugccugcgcaaaaaugggaaaaaaguaauacaacugucgagaaagaccuuugauacugaguaucaaaagacgaggcugaacgauugggacuucgucguaacaacggacaucucggaaaugggggccaacuuuaaagcagaccgggugauagauccacgccggugccucaaaccggucauacucaccgacggaccggagagggugaucuuagccgggccgaugccgguaacagccgccagugcagcacagagaagaggccgcguaggacgaaacccgcaaaaagaaaacgaccaguauaucuucaccggacaacccuuaaacaacgacgaggaccacgcacauuggacagaagcgaaaaugcuccuagauaacauaaacacgccugaagguaucauaccagcacuuuucgagccggaacgagaaaaaagcgcagccaucgauggcgaauaccgcuuaaaaggagaaagcagaaagacguucgucgaacugaugagacgcggagacuuaccugucuggcucgcacacaaaguugcaagcgagggcauuaaauacacugacagaaaaugguguuucgauggcgagcgcaacaaucaaaucuuggaagaaaacauggauguggaaauauggacgaaggagggugaacgaaaaaaacucaggccacgcuggcuagacgcaagaacauacagcgacccacuggcccuuaaggaauuuaaagacuucgcggcagggaggaaaagcaucgcgcuugaccuagugacugagaucggacgcgucccaagccaccuugcacacaggacgcgcaaugccuuagacaacuuagucaugcuccacaccagcgaacauggggggagagccuaucgucacgcgguugaagagcuccccgagacgauggagacccugcuacugcucggccuuaugauacuauugacgggcggggcgaugcuauuccugaucucuggcaaggggauuggaaaaaccagcauagguuugaucugcgugauagugagcuccgggaugcucuggauggcagauguaccacugcaguggauagcaucagcaauaguacucgaauucuucaugaugguucuacucauuccagagccggagaaacagagaacgccgcaggacaaccaacuggcuuauguggugaucgguauacucaccuuggcagccaucguagcggcaaacgaaaugggacuacucgagacaacaaaaagagaccuaggaaugucaaaagaaccaggaguagucucaccaacaaguuaccuggacguugaucuacaucccgcaagcgcauggacucuauacgccguagcaacaacggugaucacacccaugcucaggcacaccauagaaaauagcacagcuaacguuagucucgccgcaaucgccaaccaagccguuguacugaugggacucgacaagggguggcccauaucgaagauggaccucggcguaccccuccuagcacugggaugcuacagccaagucaacccacucacacucaccgccgccguauuacuccucgucacccacuacgcgauaaucgguccaggacuccaggcaaaagcuacgcgggaagcccaaaaacgaacagcugcaggcaucaugaaaaaucccacagucgacgguaucaugaccauagaccuugaccccguaauauacgacucaaaauucgaaaaacaacuaggacaagucauguugcugguacucugugcggugcaacuccuccucaugcggacaucaugggcgcucugcgaagcccucacccuggcaacgggcccuaucaccaccuuaugggaggggagcccggggaaguucuggaacacaacaaucgccgucagcauggcaaacaucuucaggggauccuacuuagccggagcaggucuagcguucucgauuaugaaaagcguagggacggggcgucgugggacaggaucgcagggagaaacccuuggcgagaaguggaagaaaaagcucaaccaguuaagcagaaaagaguucgaccuguacaagaaaagcggcaucacagaagucgauagaacagaagcaaaagaaggccucaaaagaggagaaacaacgcaucaugcugugucaagagggagcgcaaaacugcaaugguucgucgaacgcaauauggugauaccggaagggagaguaaucgaucuuggcuguggcagggggggcuggucuuacuacugcgcgggucuaaagaagguaaccgagguccgaggauacacuaagggcggcccgggccacgaagaacccguccccaugagcaccuauggguggaacaucguaaaacuaaugagcgggaaagauguauucuaccuuccgcccgaaaagugcgacacucugcuaugcgacauaggagagagcucuccaagccccacagucgaagaaucgcggacaauacgggugcuaaaaaugguugaaccauggcuaaaaaacaaccaauucugcauuaaagugcucaaucccuacaugccaaccgucauagaacaccuagagagacuccaaagaaaguauggcgggauguuaguacgcaauccacuaucccgaaacagcacacacgagauguauuggauaagcaacggaacgggcaauauaguaagcucaguaaacaugguaagcagauuacuucuaaaccgguucacaaugacacauaggcggccaacaaucgaaaaggaugucgaccucggcgcaggaacccgacacguaaacgcagagcccgaaacaccgaauauggacgugaucggugaaagaauaaagcggauaaaagaggagcacuccaguacauggcacuacgacgacgaaaacccuuacaagaccugggcauaccacggcucuuacgaagucaaagcaaccgguagcgcaagcucaaugaucaacggcgucgucaaacuauugaccaagcccugggacgucguaccaauggucacacagauggcuaugacggacacgaccccauuuggucagcaaagaguguucaaagaaaagguagauacgagaacaccaagaccgaugccagguacacguaaaguaauggagaucacggcggaauggcucuggcggacgcuuggacggaacaaaaaaccccgccuauguacgcgcgaggaguucacaaagaaggugcgaacaaacgcagcaaugggggcgguauuuaccgaggagaaucaaugggauucggcgagagcagcaguagaggaugaggaguuuuggaagcugguggacagggagcgcgaguuacacaaacugggaaaauguggcucaugcguguacaacaugauggguaaacgagaaaagaaauuaggcgaauucgggaaagccaagggcagcagagcaauaugguauaugugguugggagccagauaccuagaauucgaagcgcuaggguuccuaaaugaggaccauugguucagccgugaaaacuccuauagcggagucgaaggagagggccuacacaaacugggauacauacuacgggacauaaguaagauccccggcggcgcuauguaugccgaugauacagcuggcugggacaccagaaucaccgaagacgauuugcacaacgaggagaaaauuacucagcaaauggacccagaacacaggcaacucgcgaacgcgauauucaaauuaacauaccaaaacaaaguuguuaagguccaaagacccaccccuaaaggcacggugauggacauuaucucacgcaaggaccagagagggucgggacaggugggaaccuacggauuaaacaccuucaccaacauggaggcccaacuagugcgacagauggagggcgagggcguccuuucgaaggcugaccucgaaaauccccaccuacuagagaagaaaauaacacaaugguuagaaacuaaggggguggagcgccuuaagcggauggccaucucgggugacgacugcguaguaaaacccauagacgauagauuugccaacgcccuccuugcacuuaacgacaugggaaaaguacgcaaggacauaccacaauggcagcccucgaaaggauggcacgacuggcaacaggucccauuuuguagccaccacuuucaugagcuaauaaugaaagacgggcgcaaauugguggugccgugucggccccaagacgagcuuauaggacgggccagaauaucacaaggagccgguuggagucucaaggagacagcaugucuggggaaagcguacgcccagauguggucguuaauguacuuucaccggcgagaccuacgccucgccucgaacgcaauuugcuccgcagucccgguacacuggguaccaacaucacgaacaacauggagcauccaugcgcaccaucaguggaugacuacggaggacauguugacggucuggaaccgcgucuggaucgaggauaacccguggauggaggauaaaacgccagugacaacgugggaggacgucccauaccuaggcaaaagagaagaccaguggugcggcagccucauaggucugaccucccgagccacgugggcgcaaaacauuuugaccgcaauacagcaagucaggucacugauaggggacgaagaauuucuagacuauaugccauccaugaaaagauuccgaaaagaagaggagagugagggagcaaucugguga

SEQ ID NO: 26187 - RNA, 9873 nt, Artificial Sequence
  derived and/or modified CDS sequence (opt11) from DENV-3__DQ863638__SS-prME
acgagccuuugucucaugaugaugcugccggcgacguuagcauuccaccucaccagccgggacggcgagccccggaugaucgucgggaaaaaugagcggggcaagagcuuacuguucaagacugcauccgggaucaauaugugcacccugauagcaauggaucucggcgagaugugcgacgacaccgugaccuacaagugcccccauauugcagaaguggagccugaggacaucgauugcugguguaaccugaccagcaccuggguaacauauggcacgugcaaucaagccggggagcaccggcgcgauaaacgguccguggccuuagcgccucacguuggcaugggucuggacacccgcacccaaacguggauguccgcugagggcgccuggagacagguggagaaggucgagacgugggcccugcgccaccccggguucacaauccucgcgcuguuccuggcccauuacaucggcaccucccucacucagaagguggugauauucauucuccuaauuuugguuacgccuagcauggcaaugcgcugcgugggggugggcaacagggacuucgucgagggcuugucaggggccacuugggucgacgugguccuagaacacggugggugcgugaccaccauggccaaaaacaaaccuacgcucgacauagagcuccagaagaccgaggcuacacagcuggccacauuacggaagcugugcauagagggcaaaaucacaaauaucaccaccgacagccgcugccccacccagggagaagcgauccugcccgaggaacaggaccagaacuacguuugcaagcacacuuacgucgaccggggcuggggcaacgggugcggccucuuuggcaagggcucccucgugaccugcgccaaguuccagugucuagagucgaucgagggcaaggugguccagcacgagaaccucaaguacaccgugauuaucacugugcacacuggugaccagcaccaagucggaaacgagacucagggggugaccgccgaaauaacgccccaagccucuacggucgaggcuauccugcccgaguacggcaccuugggccucgagugcagcccccgcaccggccuggauuucaaugaaaugauccuguugaccaugaagaauaaggccuggauggugcacaggcaaugguucuuugaccugccguuaccauggaccuccggcgccacgaccgagacccccacauggaauaggaaggaacuccuuguuacguuuaagaacgcccacgcgaagaagcaggagguaguggugcuggggagccaggagggcgcgaugcauaccgcgcucacuggggcuacugagauccagaacucaggagggaccaguaucuucgccggccaccuaaagugccgucugaagauggacaaacucgagcuaaagggcauguccuacgcgaugugccugaauaccuuugucuugaaaaaggagguguccgaaacccaacacgggacgauccugaucaagguggaguacaagggugaggacgcuccuuguaagauaccguuuucaacggaagacgggcaaggcaaggcgcauaacgguaggcugaucacugcuaaucccguggugaccaagaaggaggaacccgugaacauugaggcagaaccuccguucggggaguccaacauuguaaucggcauuggggauaaggcccuaaagauaaacugguacaagaagggcagcaguaucgggaaaauguucgaagcgacagcacgcggggcacgccggauggcgauccucggagauacggcaugggacuucgggagcgugggcgguguacuaaauucccuggguaagaugguucaccaaaucuucggaagcgcuuacaccgcccuguucucgggcgugucguggaucaugaagaucggcaucgguguacucuugacguggauaggccugaacuccaaaaacacgucaauguccuucagcugcauugccaucgggaucaucaccuuguaucugggcgcggucgugcaggccgacaugggguguguuaucaacuggaaagggaaggaguuaaagugcggcucagggaucuucgucacaaacgagguucauacuuggaccgagcaauauaaauuccaagcagacagcccaaagcgucuggccacagcgaucgcgggcgccugggagaauggggugugcggcauccgcuccacgacccgaauggagaaccugcucuggaaacagaucgccaacgagcugaauuacauccugugggagaauaacaucaagcucaccgugguggucggggacaucauaggcgugcuagaacagggcaagcgcacacucacgccccagcccauggagcucaaguacagcuggaaaaccuggggcaaggccaagaucgucaccgcggagacgcagaacaguucguucauaaucgacggaccgcacacuccugagugccccagggccagccgcgcuuggaacgugugggaggucgaggacuacggauucggcguguucacgacgaacaucuggcucaagcugagggaagaauacacgcaguuaugcgaccaucggcucaugagcgcagcugucaaggacgaaagagcgguccacgcagacaugggauacuggaucgagucccagaagaacggaucuuggaagcucgaaaaggccagccucaucgaagugaagacauguaccuggcccaagucccauacccuguggagcaacgggguucuggaguccgacaugauaaucccuaagagcuuggcggggccaaucucccagcacaaccaccgcccgggcuaccacacccagacggcgggacccuggcaucugggcaagcuggagcucgacuucaacuauugugagggcaccacagucgugaucaccgagaacugcgggacgcggggccccucacugcgcaccaccaccgugagcgggaagcucauccacgagugguguugccggucuugcacacugccaccccuccgguacaugggcgaggacgggugcugguauggcauggaaauucggccgauaaacgaaaaagaggaaaacauggucaaaucacuggcgagcgccggcuccggaaagguagacaacuucaccaugggguuccucugucucgccauccucuuugaagaaguuaugcgagggaaauucgguaagaaacauaugaucgccggggucuuuuuaaccuuucugcuucuccugucgggccagaucaccuggcgggacauggcccacacacugaucaugaucggcuccaaugcgagcgaccgaauggggauggggguaaccuaccucgcgcugauagccaccuuuaagauucagcccuuccuggcccucggguucuuccuccgaaaacugaccagccgcgagaacuuucuccugggcgugggccuggcaauggcgacgacuuuacagcugcccgaagauaucgaacagauggccaacggaaucgcccugggccucauggcucucaagcugaucacgcaauuugaaaccuaccaacucuggacugcgcuggucucguugaccugcagcaacacgaucuucacuuuaacggucgccuggcggacugcuacgcugaucuuagccggagugucccuccugcccgucugucagucauccucgaugcgcaagaccgacuggcuuccgauggcaguugcggccaugggcgugccuccccugccacucuucaucuucucucugaaggacacgcucaagcgccggagcuggccgcugaacgaaggagugauggcuguggggcuggucaguauauuggccagcucccuguugcgcaacgaugugcccauggccggaccccuuguggcuggaggguugcugaucgcgugcuacgucauaaccgggaccagcgccgaccucaccguggaaaaggccgcggacguaaccugggaagaggaggcugagcagacuggggucucccacaacuuaaugaucacugucgaugaugacgggacgaugcgaaucaaggacgacgagacggagaacauacugaccguacugcugaagaccgcccugcucaucgucuccggcauauuccccuacuccauuccugcgacccugcucguguggcacaccuggcaaaaacagacgcagagaucgggcgugcucugggacgucccuagcccgccggagacucagaaagccgagcuggaggagggaguguaccggaucaagcagcagggaaucuucggaaagacccaggugggcguuggggugcagaaggaaggcguguuucacaccauguggcaugucacgagaggcgcggugcugacccacaacgguaagcggcucgaaccgaacugggcgagcgucaagaaggaccugaucuccuacggcgguggcuggcgccuaagcgcccaguggcaaaagggggaagagguccaggugauagccguggaaccuggcaagaaccccaaaaacuuccagaccaugccuggcaucuuccaaacaacgaccggggagauaggggccauugcgcuggacuucaaaccagggaccucgggcucgccuauuaucaaccgagaaggaaaggucgugggccucuacggcaaugggguggucaccaagaacgguggguacgucucugguaucgcccagacgaaugcugaaccagacggcccaaccccugaacuggaggaggagauguucaagaagcgcaaccugacgaucauggaucuccaccccggguccggcaagacccgaaaauacuuacccgccaucgugcgcgaggccaucaaaaggcgccugcggacgcucauucuggcgccgacucgcgucguggccgccgagauggaggaagcccugaaggggcuucccauccgguaccaaaccacugcaacaaaguccgagcacaccggccgggagaucguggaccugaugugccacgcgaccuucacaaugcggcuguugucuccuguccgugugcccaauuauaacuuaaucaucauggacgaggcccauuuuacggacccggcgagcaucgcggcacggggguauaucucuacccgcguuggcaugggggaggccgccgcuaucuucaugacugccacgccacccgggaccgcggaugcguucccccaaagcaacgccccgauccaagacgaggaacgcgacauccccgagagguccuggaacuccggcaacgaguggaucaccgauuucgugggaaagacagugugguucgugcccuccaucaaagccggaaacgacaucgccaauugccugagaaagaacgggaagaaagucauccaguuaagccggaagacguucgacacggaguaccagaagacuaagcugaacgacugggacuucguugugacaaccgacaucuccgagaugggcgccaacuuuaaggccgaccggguuaucgacccuagaagguguuugaagccugugauccucaccgauggccccgagcgggucauccuggccgggccuaugcccgucacggccgccucagcagcucaacgccggggacgcgugggacggaacccgcagaaggaaaacgaucaauacaucuuccggggccagcccuuaaacaacgacgaggaucacgcccauuggacugaggcgaagauguuacuagacaauaucaacaccccagaggggaucauacccgcgcuguucgagcccgagcgggagaagucggccgccaucgacggugaguaccgccucaaaggcgaauccaggaagacguuuguggagcugaugcgccgcggggaccugcccgucuggcucgcacauaaggucgccagcgaggggaucaaguacaccgaccgcaagugguguuucgauggggagaggaauaaccagauccuagaggagaacauggacguugagauauggaccaaggagggcgagaagaaaaagcugcgcccccgauggcucgacgcacggaccuacagcgacccucuggccuuaaaggaguuuaaggacuucgcugccggcaggaaaucuauugcccuagaucuggucaccgagauugggcggguuccgucgcaccucgcccaccguacgcguaacgcucucgacaaucuggucauguuacacacuuccgagcacggugggcgcgccuaccggcacgccguagaggaacuccccgaaaccauggagacccugcugcuccugggucugaugauccuccugacagguggggccauguuguuccucaucagcgggaaggggaucggcaagacuagcauagggcugaucugcguuauugcaaguagcggcaugcucuggauggccgacguaccccuacaguggaucgcauccgccaucguguuggaguucuuuaugaugguccugcucaucccggaacccgagaagcagagaacuccccaggauaaucagcuggccuacguagugaucgggauccugaccuuggcggccauaguggccgcaaacgagaugggccuucuggagacgaccaagcgggaucucggaaugagcaaagagcccggagucguauccccaacaucauaccuggauguggaccugcaccccgcuuccgcguggacccucuacgccgucgccaccacggugaucacccccaugcuucgccacacgaucgagaacagcacugcaaacgugucccuggcggccaucgcuaaucaggcagucguguuaaugggccucgacaagggauggcccaucucuaagauggaccugggcgugccgcuccuugcccugggguguuauucccagguaaauccccucacccugacggccgccgugcuacuccuggccacccacuaugccauaaucggccccggucuacaagccaaagcgacgcgggaagcccagaaacgcaccgcggccgguaucaccaagaacccaaccguggacggcaucaugacgaucgaccuugacccagucauuuacgauagcaaguucgagaagcagcuuggccaggugaugcuccuuguguugugugccgugcagcugcucuuaaugcggaccuccugggcccugugcgaggcucugacccuggcuaccggacccaucacgacccugugggaggguagccccggcaaauuuuggaacaccacaaucgccgugucaauggcgaacaucuuucggggcucguaccucgcaggggccgguuuggcguucaguaucaugaaguccguugggacgggcaagcgggggaccgggucccaaggcgagaccuuaggggaaaaguggaaaaagaagcucaaccagcugagccgcaaggaguucgaccuguacaagaaguccgguaucacagaaguugaccgcacggaagccaaggaggggcucaaacgcggugagauaacccggcaugcugugucccgcgguucugccaagcugcagugguucguggagcggaacaugguaauccccgaggggcgcgucaucgaccuugggugcgggcgcggcggguggucguauuacugcgccggacucaagaaggugacagagguccggggcuacacaaagggcggcccugggcacgaggagcccgugcccaugagcaccuacggcuggaacaucgugaagcugaugagugggaaggacgucuucuaccugccuccggagaagugcgacacgcuguuaugcgacaucggcgagagcucccccucccccaccguagaggagucccgcacaauccgggugcugaagauggucgagccuuggcugaagaacaaccaguucugcaucaaggugcuuaacccguacaugccuacgguuaucgaacaccuggagcgccugcagcggaagcacggcggaaugcuuguacgcaacccgcuuagccgaaacaguacacacgagauguauuggauaagcaacggcaccgggaacauugucuccagcgugaacauggucucccgccugcuucucaaccgguucaccaugacccaccgccggccgacgaucgagaaggacguggaccugggagccggcacgcgccacguaaacgccgagccggagacacccaacauggacguaauaggggagcggaucaagcgcaucaaggaggagcacaauagcaccuggcacuacgacgacgagaaccccuacaagacaugggcuuaccacggcuccuacgaagugaaggcaaccgggucagccuccagcaugauaaacggaguagucaaacuccugacuaaacccugggauguuguuccgaugguaauccagauggccaugaccgauacgacccccuucgggcaacagcggguguucaaagaaaaggucgacacccgcacuccccggccuaugcccggcaccaggaaggugauggaaaucaccgcugaguggcuguggaggacccucgggcgcaacaagcgcccccggcuguguaccagggaagaauuuacgaagaaggugcggaccaacgccgcuaugggggccgucuucaccgaggagaaccagugggacagcgccagagcggccguagaggacgaggaguucuggaaacugguggacagggaacgcgaauugcauaagcugggcaagugcgggaguugcgucuacaacaugaugggaaagcgcgagaagaaguuaggagaguucgggaaggccaagggcucgcgcgccaucugguacauguggcucggagcccgguacuuggaguucgaggcgcugggauuuuucaacgaggaccauugguucucgcgcgagaacagcuacuccgguguggagggcgagggguugcacaaacuaggcuauauucugagagacaucagcaagauccccgguggagcgauguaugccgacgauaccgccggcugggacacgcgcaucaccgaagacgacuugcacaaugaggagaagauaacucagcagauggauccggagcaccggcaauuggccaacgcgaucuuuaaguugaccuaccagaacaaagugguaaaggugcagcggcccacgcccaaggggaccguaauggauaucauuagccggaaagaccagcgcggaagcggccagguagggacguacggccucaacacuuucaccaacauggaagcccaacugguacgacaaauggagggggagggcgugcuuuccaaggccgaccucgagaacccacaucuccuggagaagaagauuacacagugguuagaaaccaagggggucgagcgccucaaaagaauggccaucagcggcgacgacugcguuguaaagccaauugacgaccgguucgccaacgcccugcucgcguugaaugacaugggcaaaguccgaaaggacauaccgcaguggcagcccucgaagggguggcaugacuggcaacagguccccuucugcucucaccacuuccacgagcugaucaugaaggacggcaggaagcucguggucccgugccgcccacaggacgagcugaucggucgggccagaaucuccagaggcgcuggguggagcuugaaggaaacagcaugccucggaaaggccuaugcucagauguggucgcugauguacuuccaccgacgcgauuugcgccuggccucgaacgccaucugcagugcggugcccguacauuggguuccuaccagccgcacgaccuggagcauccacgcccaccaucaguggaugaccacugaggacaugcugacggucuggaacaggguguggaucgaggacaacccguggauggaggacaagacccccguaacgaccugggaagauguaccguaucuggguaaacgcgaggaccaauggugugggucacucaucggacugacgagccgcgcuacaugggcccagaauauccugaccgcgauccagcagguccguuccuugauagggaaugaggaguuccuggauuacaugccgucgaugaaacgcuucaagaaggaggaggagagcgagggagcaaucugguaa

SEQ ID NO: 26188 - RNA, 9873 nt, Artificial Sequence
  derived and/or modified CDS sequence (opt11) from DENV-3__KJ737430__SS-prME
acgagccugugccuuaugaugauguuacccgccacccuggcuuuccaccucaccucccgcgacggcgaaccccggaugaucgugggcaagaacgaacgggguaagagccuucuguucaagacugcgucugggaucaauaugugcacccucaucgcuauggaucuuggggagaugugcgacgauaccgucacguacaagugcccccugauagccgagguggagcccgaggacaucgacugcuggugcaaucucaccagcaccugggucaccuacgggacgugcaaccaggcgggcgagcaccggcgcgacaaacggucagucgcccuggcgccccaugucgggaugggucuggacaccagaacccagaccuggaugagcgcggaaggugccuggcgccagguggagaaggucgagacgugggcgcuccggcauccuggguucaccauccuggcgcuguuccuggcccacuauaucggcacgucccugacccaaaagguugugauauucauccugcucaugcucgucacgcccaguauggccaugcgguguguaggcgugggcaaccgcgauuucguagaaggccuguccggggccaccuggguggacgugguccucgaacacggaggguguguuaccacgauggccaaaaauaagccuacacuagauaucgagcugcaaaagacugaggcgacccagcucgccacguuacgaaagcuguguauugagggcaagauuacaaacaucaccaccgacagccgcugccccacccagggcgaggccauccucccggaggaacaggaucagaacuaugucuguaagcauacguacguugaucggggguggggcaacgguugcggccuguucgggaagggcucccugguaaccugcgcaaaguuccaguguuuagagagcaucgagggcaaggugguccagcacgaaaaccugaaauacaccgugaucaucaccgugcacacgggggaccagcaccaggucggcaacgacacucaaggggugaccgucgagaucaccccucaggccuccacgguugaagcuauccugcccgaguauggcacccucgggcuggagugcagcccccgcacuggccuggacuucaacgagaugauccuacugaccaugaagaacaaggccuggaugguucaccgccagugguucuucgaccuaccucuucccuggaccuccggugccacgacggagacucccaccuggaaccgcaaggagcugcuugucacguuuaagaacgcccacgccaagaaacaagagguggugguccucgggucacaggaaggcgcgaugcacaccgcccugacgggggccacagagauacagaacuccggcgggacgagcaucuuugcgggccaccucaaaugccggcucaagauggacaaacuggagcucaagggcauguccuaugcgaugugccucaacaccuucgugcugaagaaggagguuagcgaaacacagcacgggaccauccugaucaaggucgaauacaagggggaagacgccccgugcaaaaucccguucagcacagaggacgggcagggcaaggcccauaacggccggcugaucaccgcaaaucccgugguaaccaagaaggaggagcccgucaacaucgaagccgagccacccuucggggaauccaauaucgugaucggcaucggggacaaggcgcucaagauuaauugguacaagaagggaagcucaaucggcaagauguucgaagccaccgcccggggagcccggcggauggcaaucuuaggcgauaccgcgugggauuuugguucugucggcgggguccuuaacucccucggaaagauggugcaccagaucuucgggagcgccuacacagcccuguucuccggcgugagcuggauaaugaagauaggcaucggggugcugcucaccuggauaggccugaacucgaagaacaccuccauguccuuuuccugcaucgccaucgggaucaucacguuauaucucggugccguggugcaggcggacauggggugcgucaucaauuggaagggaaaggagcucaagugcggcuccgggaucuucgugaccaacgaggugcacaccuggaccgagcaguauaaguuccaggcagauagcccuaagcggcuggccacggccaucgccggcgcgugggaaaacggggucugcgguauccgcagcacgacccggauggagaaccugcuguggaagcagaucgccaacgagcuaaauuacauccuaugggagaacaacaucaagcugaccgugguggugggggacaucauuggcgugcuggagcaaggcaagcgcacucucacuccccagccuauggagcugaaguacagcuggaaaacuugggggaaggcuaagaucgucaccgcagagacgcagaacuccagcuucaucaucgacggcccaaauacccccgagugccccucugcgagccgggccuggaacgucugggaaguugaggacuacgguuucggcguuuuuaccaccaacaucuggcuuaagcuccgcgaggucuauacucaaucgugcgaccaucggcuaaugucggccgcaaucaaggacgaacgggccgugcacgcugacaugggauacuggaucgagagccaaaagaacggguccuggaagcuggagaaggcuucauuuauagagguaaagacaugcaccuggcccaagucgcacaccuuauggagcaacggaguccuggagagcgacaugauaaucccgaagagucuggccgggcccaucucacagcacaaccaccgucccggcuaccacacccaaaccgccgggccguggcaccugggcaagcuggagcuagacuucaacuacugcgagggcaccacuguggugaucacagagaauugcgggacgcggggcccuagccuccggacuacaaccguguccgggaagcugauccaugaauggugcugccgcucgugcacacugccaccccucagguacaugggcgaggacgggugcugguacggaauggagauccgcccgaucaaugagaaggaggaaaauaugguaaagucacuggucuccgccggcuccggaaaggucgacaacuucacgaugggcgugcuaugucuggcgauauuguucgaggaaguuaugcggggcaaguucggcaagaagcacaugauagccgggguccuauucaccuuuguucuccugcuuagcggccagaucaccuggcgugacauggcccacacgcucaucaugaucgguagcaacgccagcgaccgaaugggaaugggagugaccuaccuggcccucaucgcgaccuucaagauccaacccuuccucgcucugggcuuuuuccugcgcaaacucaccucucgggaaaaccuacugcucggugucggccuggcuauggccacgacccuucagcuccccgaggacaucgagcagauggcgaacggaauagcccugggccugauggcucucaaacugauuacccaguucgagaccuaccaguuauggacggcccucguaucccugacgugcucgaacaccaucuucacccugacagucgcuuggaggaccgcgacccucauccuggcaggggucucccugcuacccgugugccagagcucgucgaugcggaagaccgacuggcugccgauggccgucgccgccaugggcgugccgccacugcccuuguucaucuucucccugaaggacacgcugaagcgcagauccuggccccucaacgaaggcgugauggcugucggccugguguccauccuggcuagcucccuccuucggaaugacgugcccauggccggaccccuggucgcagggggccuguuaaucgccugcuacgugaucaccgggacgagcgcggaccucaccguugagaaggccgccgacgucacgugggaggaagaggcagagcagaccggcgugucucacaaccucaugauuacuguggacgaugacggcaccaugcgaaucaaggacgaugagacggaaaacauccuuaccguccuguuaaagaccgccuuacuuaucgugagcggcaucuucccauacuccauuccggcgacccuacugguguggcacaccuggcagaagcagacgcagcggagcggcguucucugggacgugcccagcccacccgagacgcagaaggcagagcucgaggaggggguguaccgaaucaaacagcagggcaucuuuggcaagacccagguuggcguaggcgugcagaaggagggcgucuuccacaccauguggcacgugacgaggggcgccgugcugacccacaacgggaagcgacuggagccaaacugggccagcgucaagaaggaccuuaucucauauggugguggcuggcgucugagcgcgcaguggcagaaaggagaggagguucaggugaucgccgucgagcccggcaagaaccccaagaacuuccagaccaugcccggcauuuuccagacgacgaccggggagauuggcgccaucgcucuggacuucaagccggggaccagcggaucccccaucaucaaccgcgagggcaaggugguggggcucuacggcaacggugucgugaccaagaacggcggguacgucagcggcaucgcccagacgaacgccgaacccgacggcccgaccccagagcuagaggaggaaauguucaagaagcgaaauuugaccaucauggaccugcacccaggguccggcaagacccgcaaguaccuccccgccaucguccgugaggcuaucaagcgccgacuacguacguugaucuuagccccgacccgggugguggccgcagaaauggaggaggcccugaaagggcugccgauccgguaccagaccaccgccacuaagagcgagcacacgggucgggagaucgucgaucucaugugccacgccaccuucaccaugcgccugcugucacccgugcgcgucccaaacuacaaccugaucaucauggacgaggcccacuucacagacccagcgaguaucgcggcuaggggguacauuuccaccagagucggcaugggcgaggcagcggccauuuucaugacugccacaccucccgggacggccgaagcguucccccagagcaacgcaccgauccaggacgaagaacgcgauauuccugagcgauccuggaacucggguaaugaguggauuaccgacuucguugggaagaccgugugguucguccccucaaucaaagccgguaacgacaucgcaaacugccugcggaagaaugggaagaaggugauccagcugucccgcaagacuuucgacacagaguaucagaagaccaaacucaacgauugggacuuuguggucaccacagacaucuccgagaugggcgccaacuucaaggcugaccgagugaucgacccccgccgaugccugaagccagugauucugacggacggccccgagcgcgucauccucgcggggccaaugcccgugacugccgccagcgccgcgcagcggcgcgguaggguggggcgcaacccgcagaaggagaaugaucaauacauuuuuacaggccagccccugaacaacgacgaggaccacgcgcacuggaccgaggccaagaugcugcuugacaacaucaacacacccgaggggaucaucccagcccuguucgaaccggagcgggagaaguccgccgcgauagauggcgaguaccgccuaaagggugagagccggaagacauucguagagcucaugcgccguggggacuugcccgucuggcuggcacacaagguugccuccgagggcaucaaguacaccgaccgaaaguggugcuucgauggggaacggaauaaccagauacuugaggagaauauggacguggagauuuggaccaaggagggcgagaggaagaagcugaggccgcgcuggcuggaugcccgaaccuauagcgacccucucgcccugaaggaguucaaggauuucgcggccggccggaaguccaucgcccuggaccucgugacugagaucgggcgugucccgagucaccuggcccaccggacgcgaaacgcccuggacaauuuggugaugcugcacaccucggagcacggcggccgggccuaccgucacgccguagaggaacugcccgaaaccauggagacccucuuacugcuaggacugaugauccugcucaccgggggcgccaugcuguuccugaucucagggaagggaauuggaaaaaccagcauugggcugaucugcgucaucguguccucgggcaugcuguggauggccgaugugccccuccaauggaucgccuccgccaucguccucgaauuuuucaugaugguccugcugaucccggagcccgagaaacagcgaacaccccaggacaaucagcucgccuacgucgucauugguauucugacgcuugccgcgaucguggcagcgaaugagaugggauugcuggagaccaccaagcgugaucugggcaugucaaaggagcccgggguggucuccccgaccagcuaccuagacguggaccugcaucccgcuuccgcuuggacgcuguacgccguugcgaccaccgucauuacccccaugcuacggcacacgauagagaacaguacagccaaugugucgcuggccgccauugccaaccaggcggugguccugauggggcuugauaagggguggccaaucaguaagauggacuugggcgugccacuguuggcuuuggggugcuacucccaggugaacccccugacccucaccgccgccguccugcuacucgugacgcacuaugccauuauuggacccggccuccaggcgaaggccacccgagaggcucagaagcggacagccgccgggaucaugaagaacccuacgguggauggcaucaugacgauugaccuggacccggucauauacgauagcaaguucgagaaacagcucggacaggugaugcuccuugugcucugcgcgguccagcuucugcucaugcgcacuuccugggcccugugcgaggcucugacacucgccaccggcccaaucacgacccuuugggagggaucuccaggcaaguucuggaauaccaccaucgcgguguccauggccaacaucuuccggggcuccuauuuggccggggccggucucgcguuuuccauuaugaaguccgugggaacuggcaaaaggggcaccgguagccagggugagacguugggugagaaguggaagaagaagcugaaccaguuaucccguaaggaguuugaucuauacaagaaaucuggcauuaccgaggucgaucgcacggaggcgaaggagggguugaagaggggcgagaccacucaucacgccgugucccgcggcagcgccaaacuucagugguuuguugagcggaacauggucauccccgaggggcgcgugauagaccuuggcugcggacgaggcggguggucguacuacugcgccggccugaagaaggucacugagguucgaggcuacaccaaagggggcccgggacacgaggagccggugccaaugagcacauauggcuggaacauugugaaacucaugagcgggaaggaugucuucuaccuacccccggagaagugcgacacccugcuaugcgacaucggcgagagcaguccuagccccaccgucgaggaaucccgcacuaucaggguucucaagaugguggagcccuggcugaagaacaaucaguuuugcaucaaggugcugaacccguacaugcccacugugauagaacaccucgagcgcuuacagcgaaaauacggcgggaugcucguccgcaacccccucagccggaacucuacucaugagauguauuggaucagcaauggcacggggaauaucguguccagcgugaauauggucagucggcugcugcucaaccgguucaccaugacgcaccgccggcccaccaucgagaaggacguggaccugggcgccggcacccgccacgucaacgcggaacccgagaccccaaacauggacgugaucggagagcggaucaagcgcaucaaggaggagcauucguccacguggcauuacgacgacgagaacccuuacaaaaccugggcguaccacggcagcuacgaggucaaagcaaccgguagcgccuccucaaugaucaacggcgucguuaagcugcucaccaagccaugggacguaguccccauggugauccaaauggccaugacggauaccacccccuucggacagcaacggguguuuaaagagaaagucgauacccgcacgccccggccuaugcccggcacccggaaggugauggagaucaccgcggaguggcucuggaggacccugggccgcaacaagcggccccgccucugcacgcgcgaggaguucaccaagaaagugcggaccaacgcggcaaugggggccguuuuuaccgaagagaaccagugggacuccgcgagggcugccguggaggacgaggaguucuggaagcugguagaucgggagcgcgagcugcacaagcucgggaagugcgggagcugcguauacaacaugaugggcaaaagggagaagaagcugggggaguucgguaaggccaagggcagccgcgcaaucugguacauguggcugggagcccgguaccucgaguucgaggcccugggauucuugaacgaggaucacugguucagccgcgagaacuccuauucggggguagagggcgaagggcuccacaagcugggguacauccugcgggacaucuccaaaauacccggcggggccauguaugccgacgauacggccggcugggacacucgcaucacggaggaugaccugcacaaugaagagaagaucacccagcagauggauccggagcaccggcagcuggcgaacgccaucuucaagcugacguaccagaacaaggucguaaaggugcagcgcccuacccccaaagggaccguaauggacaucauaagccggaaggaccagagaggcuccggccaggucgguacauacgggcucaacacguucaccaacauggaggcccagcugguacggcagauggagggggagggcgugcugagcaaggccgaccucgagaacccacaccuuuuagagaagaagaucacucaguggcucgagaccaagggggucgagcgccugaagcggauggcuauaucaggcgacgacuguguugugaaaccuauagacgaccgcuucgcgaaugcccugcuugcccugaacgacauggguaagguccgaaaggacaucccucaauggcagccaagcaagggguggcacgacuggcaacaggugcccuucuguucccaccacuuccacgagcugauuaugaaggacggcaggaaacucguugucccuugccggccccaggacgagcugaucgggagagcgcguaucagccagggcgccggguggucccuuaaggagaccgcgugccucggaaaagccuacgcccagauguggagucugauguauuuccaccggcgcgaucugcggcuggccuccaacgcgaucugcucugccguacccgugcacuggguuccaacgucccgcaccaccuggaguauccacgcacaccaccaauggaugaccacggaggacaugcugaccguguggaacagaguuuggaucgaggauaauccguggauggaggauaagacuccggucaccacgugggaggacgugccauaucugggcaagcgcgaggaccaauggugcgggagucuuaucggccugacauccagagccaccugggcccagaacaucuugacagcgauccaacagguacgcaguuuaaucggcgacgaagaguuccuggacuacaugcccuccaugaaaagauuucgcaaggaggaggaaagcgagggcgcaaucugguga

SEQ ID NO: 26189 - RNA, 9873 nt, Artificial Sequence
  derived and/or modified CDS sequence (opt11) from DENV-3__AY858040__SS-prME
accucguugugccucaugaugaugcugccggcaacccuggccuuccaccucacgucccgcgacggcgaaccccggaugaucguggggaagaacgagcgcggcaagagccugcuguucaagaccgcuuccgggaucaacaugugcacccucaucgcaauggaccugggcgagaugugcgacgauaccguaacguacaagugcccccugauuaccgagguggagccggaggauaucgacugcuggugcaaucugacuagcaccugggucacguacgggaccugcaaccaggccggcgaacaccggcgagacaagcguuccgucgcccuggcuccccacguggggauggggcuggacacccgcgcgcaaaccuggaugagcgccgagggcgcguggagacagguggagaaggucgagacaugggccuuccgccauccgggguucaccauacucgcgcuguuucuggcccacuacaucgguaccagucucacccagaagguggugauauucauccugcugaugcucgucacacccucaaugaccaugcggugcgugggggugggcaaccgcgacuucguggagggucucuccggggccaccuggguggacguggugcuggagcacggcgggugcgugacuacgauggcuaagaacaagcccacccucgacauugagcugcagaaaaccgaggcgacccagcuggcuacgcugcggaagcugugcaucgagggcaagauaacuaacguuacuaccgauagccgcugccccacucagggcgaggcgauacugcccgaggagcaagaucagaacuaugucugcaagcacaccuacguggaccggggguggggcaacgggugcggucucuucgggaagggcucccuugugaccugcgccaaguuccagugccuggaauuaaucgagggcaaagucguccagcacgagaacuugaaguauaccguuaucauaacgguacacaccggggaccagcaccaggugggcaaugagacccagggggucacggcagagaucacgccacaggccagcaccguggaagcgauucugcccgaguacggcacccucgggcuggaguguucgccccgcaccggccuggacuucaacgagaugauccuccugaccaugaagaacaaagccuggauggugcaccggcagugguucuucgaccugccgcuccccuggacgagcggcgccaccacagaaacccccacuuggaacaagaaagagcuccuggucaccuucaagaacgcccacgccaagaagcaggaagucgugguccucgggucccaggaaggcgcgaugcacaccgccuuaaccggcgccacggagauccagaccuccggcgggaccuccaucuucgccggccaccugaagugucgcuugaagauggacaagcuggagcugaaaggcaugaguuaugccauguguagcaacgcguucgugcucaagaaggaggugagcgagacccagcacgggacgauacucauaaaggucgaguacaagggcgaagacgcccccugcaaaauccccuucagcaccgaggacgggcagggcaaggcccacaacggccgguuaaucaccgcaaaccccguugugaccaaaaaggaggagcccgucaacaucgaggcggagcccccguuuggggaguccaacaucaucaucggcaucggagacaaggcccuuaaaauaaacugguauaagaaagguagcagcaucgggaagauguucgaggccacggcacgcggcgcccggcgcauggcgauccuaggcgacaccgccugggacuuugggagcgugggcggggugcugaacucucuggguaagaugguccaucagauuuucgggucugccuacaccgcccucuucagcggcguaagcuggaucaugaagaucggcaucggggugcugcugaccuggauuggcuuaaacagcaagaacacgagcaugagcuucagcugcaucgucauagggaucaucacgcuguaccugggcgccguggugcaggcggacauggggugcguuauuaacuggaagggcaaggagcuaaagugcggcuccgggaucuucgucaccaacgaggugcacaccuggacggagcaguacaaguuccaggcagacagccccaaacggcuggccacagcgaucgccggcgcuugggaaaacggggucugcggcauccgguccaccacccgcauggagaaccugcuguggaagcagaucgccaacgagcucaacuacauccugugggagaacaauaucaaauuaacgguggucgucggggacauuaucggcguccuggagcagggcaaacggacccugacaccccagccuauggagcucaaguauagcuggaagacuugggggaaggccaaaaucgugacggcugagaagcagaacuccagcuucaucaucgacgggccgaacaccccagagugccccaacgcgucacgagccuggaaugucugggagguggaggacuacggguucggcguguucaccaccaacauuugguugaagcugcgggaaauguacacgcagcucugcgaccaccgccugaugagcgcugccgucaaggacgagcgggccgugcacgcggacauggguuauuggaucgaaucucagaagaacggguccuggaagcuggagaaagccagucucaucgaggugaagacauguaccuggcccaagucccacacccuguggagcaacggcguccuggaguccgacaugauuauccccaagagccucgccgggcccaucucccagcauaacuaccgccccggcuaucacacccagacggccgggccguggcaccugggaaaacuggagcucgacuucaauuacugcgagggcacaaccguggugaucacggaaaacugcgggacgcggggucccagccugcgcaccaccacggucuccgggaaacugauccacgaauggugcugccgcagcugcacgcuaccacccuugcgcuacaugggcgaggacgggugcugguacggcauggagaucaggccaaucaacgagaaggaggagaauauggugaagucccuugugagcgccggcuccgggaaggucgacaacuucacgaugggagugcuaugccuggcaauccuguucgaggaggucaugcgcgggaaguucggcaagaagcacaugaucgccgggguccucuuuaccuucgugcuguuacucagcggccagaucaccuggcgggacauggcccgcacgcugaucaugaucgguucaaacgccagcgaccggauggggaugggcgugaccuaucuggcccucauagcuaccuucaaaauccagcccuuccuggcccugggcuucuuccuccgcaagcugaccucccgggagaaccugcuccugggcgucggccuggccauggcuacgacccuccagcugcccgaggauaucgagcagauggcgaacgggauagcccugggccucauggcccugaagcugaucacacaguucgagaccuaccaguuguggacagcccugguaagccugaugugcagcaacacgauauucaccuugaccgucgccuggcgcacggcgacccugaucuuagccgggaucucccucaugccagucugccagagcucaagcaugcgcaagaccgacuggcugccgaugacugucgcagccaugggggucccgccccugccccucuuuaucuucagucugaaggacacgcugaagcgccgcagcuggccgcucaacgagggggugauggcggucgggcugguauccauucuggcgagcucccuccugcggaacgaugugccuauggccggcccacuuguagccgggggccuccuaauugccugcuacgugaucaccgguaccagugccgaccugaccguggagaaggccgccgacgugacaugggaggaagaggccgagcagacaggugucucucacaaccucaugaucaccguggacgacgacgggacaaugcgcaucaaggaugacgagacggagaacauccugaccgugcugcucaagaccgcgcugcugaucguaagcggcaucuuccccuacuccaucccggccacccuccugguguggcacaccuggcaaaagcagacucaacgcagcggcguacugugggacguccccagcccacccgagacacagaaggcggagcucgaagaagggguguacagaaucaagcagcagggcaucuuugguaaaacccaggugggcgucggggugcagaaggagggcguguuccacaccauguggcacguaacucggggcgcugugcuaacuuacaacgggaagcgccuggagccgaacugggccagcgugaagaaggaccucaucuccuacggcgggggcuggcggcugagcgccuacuggcagaagggggaggagguccaagugaucgcgguggagcccggcaagaaccccaaaaacuuccagacuaugccuggaaucuuccagaccacgacuggggagaucggcgccauugcucuggacuucaagccggggaccaguggcagccccaucaucaaucgcgagggaaaggucguggggcuguacggcaacggugugguaaccaagaacggcggguacgugagcggaaucgcccagacgaacgccgagccagacggcccgacccccgagcucgaggaagagauguuuaaaaagcggaaccugaccaucauggaccugcaucccggguccggcaagacccgcaaguaccuccccgcgaucguucgggaagccaucaagcgccggcugcgcacgcugauccucgccccgaccagaguaguagcggccgagauggaggaggcucugaaggggcugcccguucgcuaccagaccaccgcgacgaagucagagcacacaggcaaggagaucgucgaccucaugugccacgcuaccuucaccaugcggcugcugucccccgugcgcgugcccaacuacaaccucaucaucauggacgaggcccacuucacggacccggccagcaucgcggcacggggguacaucucgacacgcgucggcaugggcgaggccgcagcgaucuucaugacugccacucccccagggacggccgaugccuucccccaguccaacgccccgauacaggacgaggagcgggacauccccgagcgcucauggaacagcggcaacgauuggauaaccgauuucgcggggaagacugugugguucgugcccucaaucaaggccggcaacgacaucgccaacugccuucgaaagaacgggaagaaggucauucagcuuucucggaagaccuucgauacagaguaccagaagaccaaguuaaacgacugggacuucguggugacgaccgacaucuccgagaugggcgccaacuucaaggccgaccgugucauugacccccggcgaugucuaaaaccggugauacugacggacggcccggagcggguuaucuuggcggggccuaugcccguuaccguggccagcgccgcccagcgccgcggccgcguggggcgcaacccgcagaaggagaaugaccaguacaucuucacaggccaaccgcugaacaacgaugaggaccacgcccacuggacagaggcaaaaaugcugcucgacaacauuaacacuccggagggaauaauccccgcuuuauucgagccugagcgagagaaguccgccgcuauugacggcgaguaccguccgaagggcgagagccgcaagaccuucgucgaacugaugcggcgcggggaccuccccguguggcuggcgcacaaggucgccuccgagggcauuaaauacacagaccgcaaguggugcuuugacggagagcgcaacaaccagauccuggaggagaacauggacgucgagauuuggaccaaggagggcgagaaaaagaaguuacggccccgcuggcucgacgcgcggaccuacagcgacccgcuggcccuaaaagaguucaaggacuucgccgcgggacgcaaguccaucgcccuggacuuagugacggagaucggccgagucccgagccaccucgcccaucggacccgcaacgcccuggacaaccuggucaugcuccauaccucugaacacggcgggcgggccuaccgccacgcgguggaggaacugcccgagaccauggagacguuacuccugcugggccucaugauccugcugaccgguggagcgaugcuauuccuaaucagcgggaaaggugucggcaaaaccagcaucggucugauaugcguaguggccucaagcggcaugcuguggauggccgacauuccguugcaguggaucgcgucugcaaucguccuggaguuuuucaugaugguacuccugaucccugaacccgagaagcagcggacaccccaggacaaccaguuggcuuacguggucauugggauccuaacgcuggccgcaauugucgcugcgaacgagaugggccugcucgagaccacaaagcgagacuugggcaugagcaaggagccggggguggucucccccaccagcuaccuggacguggaccuccaccccgccuccgccuggacucuauacgccguggcgaccacaguuaucacccccauguugcggcacacaauugagaacagcacagccaacgugucccucgcugccaucgcgaaccaggcgguggucuugaugggccuggacaagggguggccgaucagcaagauggaccucggcgugccccugcuggcccucggaugcuacucgcaagugaacccccugacccugaccgccgccguacuccugcugguuacucacuacgccauaaucggccccggccuccaggcgaaggccacccgagaggcccagaagcgcacagcugccggaauuaugaagaacccgaccguggacggaaucaugacgaucgaccuggaccccgucaucuacgacagcaaguucgagaagcagcugggacaggugauguuacuggugcucugugcgguccagcucuuacugaugcgcacuuccugggccuucugcgaagcacucacccuggcgaccggccccaucacgacccucugggagggcagccccgggaaguucuggaacaccaccaucgcgguguccauggccaacaucuuccgaggaagcuaucucgccggggccggacuggccuucuccauuaugaagucuguggggacgggaaagcgcggcaccgggucccagggcgagacucugggcgaaaaauggaagaagaagcucaaucaacugagccggaaggaguuugaccuguacaagaaguccggcaucaccgagguugaccgcacggaggcgaaggaggggcugaagcgcggcgagaucacucaccaugccgugucccgcggguccgcuaagcugcagugguuuguggagcggaacauggugaucccggaggggagggugaucgaccugggcugcgggagaggcggguggucguacuauugcgccggccucaagaaggucaccgagguccgaggcuacacaaaagggggcccaggacaugaagaacccguacccaugagcaccuacggcuggaacauugugaagcugauguccgggaaggacgucuucuaucugccgcccgagaagugcgacacgcuccugugugacaucggcgagagcucucccucacccaccguagaggaaagccggaccauccgcgugcugaagauggucgagccguggcugaagaacaaccaguucuguaucaaggugcucaacccuuacaugcccaccgucauugaacaccuggagcgccuccagaggaagcacggagggaugcucguucguaauccccuaagccggaacucgacucacgagauguacuggaucagcaacggcacagggaacaucguguccagcgugaacaugguuucccgccuucuccuaaaucgguuuaccaugacauaccgccggccgacgaucgaaaaggacguggaucugggcgcuggcacccgccacgucaacgcggagcccgagacccccaacauggacgugaucggggagcggauccgccgaaucaaggaggagcacagcucuaccuggcacuacgacgaugaaaacccguauaagacgugggccuaccacggcagcuacgaggugaaagcaacgggguccgccagcagcaugaucaacgggguggugaagcuguugacuaagcccugggacgugguccccaccgugacucaaauggcuaugaccgauaccacccccuucgggcagcagcgcgucuucaaggagaaaguggacacgcggaccccaaagccgaugccggggacccguaaggugauggagaucaccgcggaguggcuguggcggacgcugggccgcaacaagcggccacggcuguguacccgggaggaguucaccaagaaggugaggaccaacgccgccaugggggccguauucacggaggagaaucagugggacuccgcgcgcgccgcgguagaagacgaggaguucuggaagcugguggacagggagcgcgaacuccacaaacucggcaagugcgggagcugcgucuauaacaugaugggaaaaagggagaagaaauugggcgaguucggcaaggccaagggcagccgcgccaucugguacauguggcuaggggcgcgguaccuggaguuugaagcccucggguuucugaacgaggaccauugguucagccgcgagaacuccuacagcgguguggagggcgagggccugcacaagcugggcuacaucuuaagggacaucuccaagaucccgggcggggccauguaugccgacgacacagccggcugggacacccgcauaacggaggacgaccugcacaacgaggagaagaucacgcagcagauggagcccgaacaccggcaguuagcgaacgccaucuucaagcucacuuaccagaacaaaguggugaaagugcagcgccccacccccaaagggaccgugauggacaucauuagccggaaggaccaacgcggcuccggccaagucgggacguauggccugaacaccuucaccaacauggaggcccaguugauccggcagauggagggggaggacguuuugagcaagaccgaccuggagaacccgcaucugcucgagaagaagaucacccagugguuggagacgaaaggcguggaacgccugaagcggauggccaucuccggugacgacugcgucgugaaacccaucgaugaccgauucgccaacgcacuccuggcacugaacgacauggguaagguucggaaggauaucccucaguggcagcccagcaagggcuggcacgacuggcagcagguaccguucugcucccaccacuuccacgagcucaucaugaaggacgggcgcaaacuugugguccccugccggccccaggacgagcucaucggccgcgccagaaucucgcagggggcuggcuggucucuuaaggagaccgccugccuggggaaggcguacgcccaaaugugggcccugauguacuuccaccgccgcgaccuccggcuggccucaaacgcgaucugcuccgccguccccgugcacugggugccaaccagcaggaccacguggagcauccacgcucaccaucaguggaugaccaccgaggacaugcugacugucuggaaucggguguggaucgaggacaaccccuggauggaggacaagacacccgugacuaccugggaggacguccccuaccucggcaagcgcgaggaccaguggugcggcagccuuaucgggcugaccagucgggccacgugggcccagaacauccucaccgcgauccagcaagugcgcagucugaucggcaacgaggaguuccuggacuacaugccgagcaugaagcgguuccgcaaggaggaggaauccgagggggccaucugguga

SEQ ID NO: 26190 - RNA, 9873 nt, Artificial Sequence
  derived and/or modified CDS sequence (opt11) from DENV-3__AY858041__SS-prME
acaucucuaugucuaaugaugauguugccggcaacccuagcauuccaccugacaucgcgggacggagaaccucgaaugaucguagggaaaaaugaacggggcaaaaguuuacuguucaaaacagccagcggaauaaacaugugcacccugauagcuauggaccuaggugaaaugugcgacgauacaguuacauauaaaugcccgcuaauaaccgaaguagaacccgaagacauagauugcuggugcaaccugacgagcacaugggucaccuaugggaccuguaaccaagcgggcgaacaccgccgggauaaacgauccguagcacuagcuccccacguagggauggggcuggauacaagggcgcaaaccuggaugagcgcagaaggagccuggcgacaagucgaaaaagucgaaacgugggcauuccgccaccccggguucaccauccuagcguuguuucuagcgcauuacaucggcacaucacugacucaaaaaguagucauuuucauucuucucaugcuaguuacgcccaguaugaccaugcgcugugucggggucggaaacagggacuucguagaaggacuauccggcgcgacguggguagacgucguccucgaacauggcggaugcgucacgacaauggccaaaaacaaaccuacacucgauaucgaacuccagaaaacggaagcaacgcaacucgcaacccuuaggaaacucugcauagagggaaaaaucacaaacguaacaaccgacagucgcugccccacacagggcgaagccauccuaccagaagaacaagaccagaacuacgucuguaaacacacauacguugaccgaggcuggggcaauggaugcggguuauucggcaaaggaucccucgucacaugcgcaaaauuccaaugccuggaauugauagagggcaaagucguacagcacgaaaaccucaaauauaccgucaucauuaccguucacaccggagaucaacaccaaguggggaacgagacacagggaguaaccgcagagaucacgccccaagccagcacaguggaagcuauacuccccgaauacgguacuuuggggcucgaauguucgccaaggacaggacucgacuucaacgaaaugauacuccugacaaugaaaaauaaagcguggaugguacacagacaaugguucuuugaucucccguuacccuggaccagcggcgccacaacugaaacucccaccuggaacaagaaagagcuccucguaacauucaagaaugcacacgccaagaaacaggaaguuguaguacuaggaagccaagagggggccaugcauacggcgcucaccggagccaccgagauccagaccucaggcgggacauccauuuuugcaggccaucucaaaugccgccuaaagauggacaaacuagaacuuaaaggcauguccuacgcgaugugcagcaacgcuuucgugcuaaagaaagagguuucagagacacagcacggaacaauacuaauaaaaguagaguacaaaggggaggacgccccauguaagauacccuucucgaccgaagacgggcaagggcaagcgcacaacggcagacuaaucaccgcgaaccccgugguuacgaagaaagaggagccagugaauauagaagcagaaucucccuucggcgaaaguaacauuauaauagggauaggggacaaggcccucaagaucaacugguauaagaaaggaucaagcaucggcaaaauguucgaggcuaccgcccgaggggccaggagaauggccauccugggggacacggcaugggacuucggaagcguagguggaguccuaaauagucuaggcaagaugguacaccagaucuucgggucggcguacacagcgcuauucaguggggucagcuggauaaugaagauaggcauagggguacuccuaacuuggaucggucuuaauucaaagaacaccucgaugucauucagcuguauagugauugggauaauaacccuauaccucggugcagugguacaggccgacauggguuguguaauuaauuggaagggcaaagaacugaaaugcggcagcggcaucuucguuacaaacgaaguacacacguggacugagcaguacaaguuccaggcagauucccccaaacgccuggcgacugcaauagcgggggcgugggaaaacgguguaugugguauacgaagcaccacacguauggaaaaccuuuuauggaagcagauagccaaugaacugaacuacauccucugggagaacaacauuaagcuaacagucguugugggugacauaauaggggucuuagaacagggcaagcgaacacucacgccacaaccaauggagcucaaguauagcuggaagacauggggaaaggcaaaaaucguaacggcggaaauacaaaauuccaguuucaucaucgacgguccgaauacacccgagugcccuaacgcgagccgcgccuggaacguaugggaagucgaagacuauggauuuggaguguucacaacaaauauauggcuaaaguugagagagauguacacucaauugugcgaccaucggcucaugagcgcagcaguaaaagacgagcgcgccguucacgcggauaugggguacuggauagagagccaaaagaacggcucauggaaacuggagaaggcuucacugaucgaggucaaaacaugcaccuggcccaaaagucauacgcuuuggagcaacggcgugcuggaguccgacaugaucauuccaaaaucacucgcagggccaauaagccaacacaacuacagaccaggcuaucacacccagacggccggcccguggcaccucggaaaacuagagcucgacuucaacuacugcgaggguaccacgguaguaauuaccgaaaauuguggaaccagaggccccucacuccgcacaacgacagugagugggaagcugauccacgaguggugcugcagauccugcaccuuaccgccccugcgauauaugggugacgaugguuguugguacggaauggaaauccgacccauuaaugagaaggaggagaauaugguaaagucccucguuagcgccgguaguggaaaggucgacaacuucacgaugggcguacugugccucgccauacucuucgaagagguuaugcggggcaaauucggcaagaagcacaugauagcuggcguccuguucauguucguucucuugcucagcggccaaaucacauggagagacauggcgcggacacugauaaugaucggcucuaacgcaagugacagaauggggaugggcgucacuuaucuagcacucaucgccaccuucaagauccagcccuucuuggcgcugggcuucuuccuacgaaaacucacgucgagggagaaccugcuccucgggguaggucuggcaauggccaccaccuugcaauuaccugaggacauagaacaaauggcaaauggcauagcccucggacucauggcguuaaaauuaauaacacaguuugagacauaucagcuauggacugcguugguaagccugacgugcagcaacacaaucuucacccuaacgguagccuggcgcaccgcgacgcuuauacuagccggcaucaguuuacugccgguuugccaaucgucuagcaugaggaagacggacuggcuaccuaugacaguggcugcaaugggggucccgccgcucccgcucuuuaucuucagucucaaggacacccuaaagcgacgcuccuggccacuaaacgagggaguaauggcggucgggcucguuuccauccuggcgagcucccuacuucgcaacgacguaccaauggcugguccucuaguagcuggcggacugcugauagcgugcuacguaaucaccgggaccagcgccgaccugaccguggagaaagcggcagacguaaccugggaggaagaagcagaacaaacgggaguaucacacaaccucaugaucacaguagacgacgacggcaccaugcggaucaaagacgacgaaaccgaaaauauacucaccguacuccucaagaccgcacuacugauuguauccggaauuuuuccauacuccauacccgccacacugcugguguggcacacguggcaaaagcaaacccaaagaagugguguacuaugggauguacccucaccacccgaaacacagaaggcggaauuagaagaaggaguauaccggaucaaacaacaagggauauuuggaaagacucaaguggggguuggcguacaaaaggaggguguauuucacacgauguggcacgugacacgaggggcaguuuuaaccuauaacggcaaacgucuugagccaaauugggcguccgucaagaaagaucucauauccuauggagggggcuggcgacugagcgcccaguggaagaaaggggaagagguccaagucauagccgucgaaccagggaaaaaucccaagaacuuccagacgaugccaggaauauuucagacgaccacaggagagauaggagccauagcacuagacuucaagcccggcacgagcggguccccuaucauaaaccgcgaggggaaagucgugggccuauauggcaauggcgucgugaccaaaaauggcggguacgugucuggaauugcacaaacaaacgcugagcccgacgguccgaccccggagcucgaagaagaaauguucaagaaacgaaaucugaccauuauggaucuacacccuggaagcgguaaaacccgcaaauaccuuccagcuauagugcgagaggcgaucaagcgacgacucagaacgcuaauccucgcacccacccgcgucgucgccgccgagauggaagaagcacucaaaggccuacccauaagauaucagacuacagcaacgaaaucggaacauacaggcaaggagauaguagaccuuaugugucacgcaacguucacaaugcgacugcuaagucccguaagagucccaaacuacaaucuaauaaucauggacgaagcacacuucacggacccggcaucaauagcagcacggggcuauauuucaacaaggguaggcaugggcgaggcagccgccaucuuuaugacggcgaccccgccggggacagccgacgcguucccacaaucaaacgcaccgauccaagaugaagaacgcgauauaccagaacggucuuggaacagugguaacgauuggauaaccgacuucgcgggcaagaccgugugguuuguccccagcauaaaggcugggaacgauaucgcuaacugccuccgaaagaacggcaagaaaguuauccaacuaucgcggaaaaccuucgacacugaauaucagaagacgaaguuaaacgacugggacuucguaguaacuaccgacauaucagagaugggggccaacuucaaagcagacaggguaaucgaccccaggcgaugccuaaaacccguaauauugaccgacgggccugaacgagugauccuggcggggccgaugcccgucacaguggcaucggccgcccagcggcgagggcgcguaggacggaacccacaaaaggaaaaugaucaguacaucuucacuggccagccgcucaacaaugacgaagaccacgcccacuggacggaagcgaagaugcuacuggacaacauaaauaccccggaagggauaaucccagcauuguucgagccagagcgggaaaaguccgccgccauagauggcgaguauagacucaaaggagaaucccggaagacauuuguggaacucaugcgacgcggcgaccuaccggucuggcuagcccacaagguagcaucagagggaauaaaguacacggaccgaaaauggugcuucgacggcgaacggaauaaccagauccuagaggagaacauggacguugagaucuggaccaaagagggcgagaagaagaaacucagacccagauggcucgacgcaaggacauauuccgaccccuuagcgcugaaagaauuuaaagacuuugcggccgguagaaaaucaaucgccuuggaccuagucacagaaauaggaagaguuccgagccaccucgcccacagaacacgaaacgcauuagacaaucuaguuaugcugcauacgucggagcacgggggccgagccuaucgccacgcuguagaggagcuaccagaaaccauggaaacgcucuugcugcuaggccugaugauauugcucacaggcggggcaaugcuuuuccuaaucagugggaagggcguugggaaaacgucgaucgggcucaucugcgugguggccagcagcggaaugcuauggauggcagacauaccccugcaguggauagcaucggcaauuguccuagaguucuucaugaugguacuacuaauccccgaaccagagaagcaacgaacgccucaagauaaucaacucgccuauguuguuaucggaauacuuaccuuggccgccaucguagccgcaaacgagaugggauugcucgagacaacgaagagggaccugggcaugucaaaggagccgggggucgucucgucuacgagcuaucuagacguagaccugcacccggcguccgcguggacuuuguaugccguggccacaacugucaucacgccgaugcucaggcauacgauagaaaacaguaccgcaaacgucucguuggccgcgauagcgaaccaggccguaguucugauggggcuggacaaaggguggccgauauccaaaauggaucuaggcguaccccuacucgcucucggcugcuacucgcaaguaaacccguuaacccuaacggccgcaguccuacuccuaguaacucacuacgcaauaaucggccccggacuccaagcgaaggcgacaagagaggcacagaaacgcaccgcagccgggaucaugaagaaucccacaguugacggcauaaugacgauagaccucgacccagugauauaugacuccaaguucgaaaagcagcucgggcaaguaaugcuccucgugcuaugcgcgguccaacuccuacuuaugcgaaccagcugggccuucugcgaagcacucacguuggcuacgggcccaauuaccacacucugggagggcucaccgggaaaauucuggaacacgaccauagcaguauccauggcuaauaucuuucguggcagcuaucuagcaggagccggacuugccuucucgaucaugaaaucaguuggaacaggcaaaagggggacagggagccaaggagaaacauuaggggagaaauggaagaagaagcuaaaccagcuaagcaggaaagaguucgacuuguacaagaaaucaggaaucacagaaguagaccgaacggaagcaaaggagggguuaaaacggggagaaauaacacaccacgccgucagccgcggaagugccaagcuccaaugguuuguggaaagaaacaugguuaucccggaagggaggguaaucgauuuggggugcgggcgcggaggauggucauauuacugugcaggucucaaaaaggugacagagguuaggggauacacuaaaggaggaccgggccacgaggaaccaguccccaugagcacuuacggauggaacaucgucaagcugaugagcgggaaggacguguuuuaccuaccgcccgaaaaaugcgacacuuuguugugcgacauaggggagaguucgccuucaccaacaguagaagagagccgaacgauucgcguccugaaaauggucgaacccugguugaaaaauaaccaguuuugcaucaaaguccugaacccguauaugccaacagugauagaacaucucgaacggcuacaacguaaacacggaggcaugcuaguacgaaacccgcuaaguaggaacucgacacacgaaauguauuggaucagcaacggaaccggaaauauagucagcagcguaaacaugguguccagguuacuucugaacagguucacuaugaccuauaggcgaccaacgauugagaaagaugucgauuugggcgcaggcacaagacacgucaacgcagaaccugaaaccccgaacauggacgucaucggagaaagaauaagacgaauaaaagaggagcacucaucgacguggcacuacgacgacgaaaaccccuacaagacgugggcauaucacggcuccuacgaggucaaagcuacaggcucggcaagcucaaugauaaacggagucgucaaacugcucacgaagccuugggacguagugccaaccgucacacagauggccaugacugacacuacaccguucggucagcaaaggguuuucaaagagaaagucgauacgcgcacacccaagccaaugccagggacuagaaaagucauggaaaucacagccgaaugguuauggcgcacgcugggaagaaacaagcgaccaagacuaugcacacgagaggaguucacgaagaaaguccgaacgaacgcggcgaugggcgccguauucaccgaagagaaucaaugggacagcgcgcgugccgccgucgaagacgaggaguucuggaagcucgucgacagagagcgggaacuacauaaacaaggcaaauguggaaguugcguauacaacaugaugggcaagcgcgagaagaaacucggugaguucggaaaagcuaagggaucgcgcgcaauaugguauauguggcuuggggcacgauaccucgaguucgaggcccugggcuucuugaacgaagaccacugguuuucucgagaaaacagcuauucagguguagaaggagagggccuacacaagcuaggauacauccuaagagauauauccaaaaucccaggaggggcaauguacgccgacgacaccgccggcugggacacacgcaucacugaagacgaucuccauaacgaagagaaaaucacucagcaaauggaccccgaacacaggcagcuggcaaacgcaauauucaagcucacguaccagaacaagguggucaaggugcaaagacccaccccuaaaggcacagugauggacauaauaucaaggaaagaccaacgagguucgggacaaguaggcacauacgggcuaaauacguucacgaacauggaagcacaacuaauacgccagauggaaggagaaggaguucucucaaaaaccgaucuagaaaacccgcaccuccucgagaagaaaauaacgcagugguuagaaaccaagggcguggaaaggcugaaacgaauggccauaucaggggacgacugcguaguaaaaccaauagacgacagauucgcgaacgcgcuacuggcacuuaacgacaugggcaaaguccgaaaagacauaccacaauggcaaccaucgaaaggauggcaugacuggcaacaggucccguucugcucccaccauuuccacgaguuaauaaugaaagacggaagaaagcuggucguucccugccguccucaagaugaacugaucggacgugcgagaauaagucaaggggcaggguggagccuaaaggaaacggcaugcuuaggcaaggcauacgcacaaaugugggcacucauguacuuucacagacgggaccuacgacuggcuagcaacgccauauguagcgcgguuccaguacacuggguccccacuucgagaacaacauggaguauacacgcacaccaccaguggaugaccacggaggacaugcucacggucuggaauaggguauggaucgaggacaaccccuggauggaagauaagacgccaguaacaacaugggaagaugucccauaccuaggaaagagggaagaucaauggugcggcucacugaucggacuuacgucgcgagcgacaugggcacagaacauccuuacugcaauacaacaagucagauccuugaucggcaaugaggaguucuuagacuacaugccgagcaugaagagauuuagaaaggaagaggaaucagaaggagccauuugguga

SEQ ID NO: 26191 - RNA, 9873 nt, Artificial Sequence
  derived and/or modified CDS sequence (opt11) from DENV-3__KC261634__SS-prME
acgagcauuugccuaaugaugauguugccggcgacuuuagcguuccaccuaacuucacgagauggggaaccgaggaugauuguagggaaaaacgaacgcggaaaaagucuauuauucaaaacggcaagcgggauaaacaugugcacccuaauugcaauggaccucggagaaaugugcgacgauacaguuaccuacaaaugcccacucauugcagaagucgaacccgaagacauugauugcuggugcaaccuaacgucaacuuggguuacauacggcacuugcaaccaagcuggggaacaccggcgggacaaacguuccguggcccucgcaccgcaugucgggaugggacuggacacgcguacgcaaacguggauguccgcagaaggagccuggcgacaaguggaaaaaguugaaaccugggcccuccggcaucccggcuucacgauccuagcgcucuuucuagcacauuacauaggaaccagucuaacgcagaaaguaguuauuuucauacuucugaugcugguaacgccgagcaugacgaugcgcugugucggaguaggaaaccgggacuucguggaaggccugaguggagcgacauggguggacguggugcuggaacacggagggugcgugacaacaauggcgaaaaacagaccgacccuagacaucgaacuacagaaaacagaagcgacacaacucgcaacccugcggaaacugugcaucgaaggaaaaauaaccaacauaaccacugacagcagaugccccacgcaaggagaagcuguccucccggaagaacaagaucaaaacuacgucugcaaacacaccuauguggauaggggauggggaaacggcugcggauuguuugggaaagggaguuuaguaaccugcgcgaaauuccagugccuugaacccaucgaaggaaaagucguccaguacgaaaaccuaaaauacaccguuauaauaaccgugcacacaggcgaccaacaccagguuggaaacgacacucaaggggucaccguggaaaucacgccacaagcuagcacaguggaggcgguacucccggaauauggcacccucggacucgaaugcucaccccgaacagggcuagacuuuaacgaaaugauccuacucacgaugaaaaacaaagcguggaugguccaccgacaaugguucuucgaccuaccacuacccuggacaucgggggcuacaacggagacccccaccuggaaccguaaagaacuccucguuacuuucaaaaacgcccacgcgaagaaacaagaggucguuguacuuggcucccaggaaggggccaugcacaccgcgcuaaccggagcaacagaaauccagaacucgggaggcacaagcauauucgcggggcaccugaagugcagacuaaagauggacaaacucgaacugaaaggcauguccuacgccaugugucucaacacauucguacucaagaaagaaguaagcgaaacccaacauggaacgauauuaauucgaguagaguacaaaggagaggacgcccccuguaagaucccauucucgacggaagaugggcaggguaaagcccacaacgggcgacucaucacggcaaauccagugguaacgaagaaagaggagcccgucaacaucgaggcagagccaccguucggagaaagcaacaucguaauuggaacgggcgacaaagccuuaaagaucaacugguauaagaaaggaucaaguauaggaaaaauguuugaggcaaccgcaagaggcgcgcgacgcauggccauucugggcgacacggcuugggauuucggaucaguagggggaguccuaaacagccuagggaaaauggcgcaucagaucuucggcucggcauauacagcacucuucagcgggguuucauggaucaugaaaaucggcaucggcguccuccucacuuggaucggccuuaauuccaagaacaccagcaugucguucagcugcaucguaauugguaucaucacccuguaccucggagcgguuguacaggccgacaugggcuguguaauaaacuggaaaggaaaggaacuaaagugcggcaguggaaucuuugucacaaacgaaguccacacauggacggaacaauacaaguuucaagcugacucccccaagagauuggcaaccgcaauagcuggcgcuugggaaaauggcgugugcggaauaagaagcacgacaaggauggagaaccuccucuggaagcagauagcgaacgaacuaaauuacauauugugggaaaacaauaucaaacuuacggucgugguuggggacaucauagggguacuagaacaagggaaacgaaccuugacgccgcagcccauggagcugaaguacucauggaagacguggggaaaagcaaagaucgugaccgccgagauacaaaacagcagcuuuauaaucgacggaccaaauacaccggaguguccuucugcaaguagggcauggaacgucugggaagucgaggauuacgguuucggcguguuuacuaccaacauaugguugaagcuccgggaaguauacacacaauccugcgaccacaggcuaaugucggcagcaauaaaggaugaacgcgcuguacacgcagacaugggauacuggauagagucccagaagaacgguagcuggaaacucgaaaaagcaucauucaucgagguuaaaacguguacauggccgaaaagccacacacucuggucaaacggcguacuggaauccgauaugauuauaccgaaaucacucgcaggaccgauaucgcaacacaaccaccgaccaggauaucacacccaaacagcagggccguggcaccucgggaagcuagagcuagacuucaauuauugcgaaggaaccacagucguaauuacggagaacuguggaacucggggucccucacuccgaacuacaacaguaagugggaaauuaauucacgaauggugcugcagaucuugcacucugccuccauuaagguacaugggcgaagauggcuguugguacgggauggaaauccggccaauuaacgaaaaggaggaaaacauggucaagagcuuaguaagcgcaggcagcggaaaaguagauaacuuuacaaugggcguacugugcuuagccauucucuucgaggagguaaugagaggaaaauucggcaagaaacauaugaucguggguguacuguuuacauucgugcuacuacuaucugggcaaauaacuuggagagacaugacgcacacucugauuaugaucggauccaacgccucagaccggaugggaaugggugucacauaccuagcauugaucgcuacauucaaaauacagccauuccucgcgcucggguucuuucugcgcaaacucaccucucgcgagaaccuacuccugggcgucgggcucgccauggcuaccacccuacaacuaccggaggacauagaacagauggcaaacggcaucgcccuaggacucaugacccuaaaauugaucacacaguucgaaaccuaucaacucuggaccgcguuaguaucauuaacuuguaguaauaccauauucacgcucacaguggcuuggcgaaccgccaccuugauccuagcuggagugagucugcuaccgcucugccaaaguagcaguaugcggaagacagacugguuaccgaugaccguggccgcaaugggaguaccaccacugccucuuuucauauuuagucuaaaggacgcgccuaagaagcguuccuggccacucaaugaaggaguaauggcaguaggucuaguaagcaucuuagcauccagucucuugcggaacgacguccccauggcgggcccccuaguagcagggggucuccugaucgcauguuaugucaucacaggcaccuccgcagaccucacaguagagaaggcggccgacgugaccugggaagaagaggcagaacagacagggguaucucacaaccuuaugaucaccguugacgaugacgguacgaugcgcaucaaggacgacgaaaccgaaaacauacuuacgguccuacuaaagacagcacuacuaauagucucaggcauauucccguacagcauccccgcuacgcuccugguauggcacacguggcaaaaacagacacaaaggagcgggguacucugggacgucccuagcccacccgagacccaaaaagcagaacuggaagaggggguauaucggauaaaacaacaaggaaucuucggaaaaacgcaaguaggggucggagugcaaaaagagggugucuuccauacuauguggcacguaacaaggggugcuguacugacccacaacgggaagcgacuagagccuaauugggcauccgucaagaaggacuuaaucuccuacgggggaggauggaggcuuagcgcacaauggcaaaaaggcgaagagguacagguaauagcagucgaaccaggcaagaacccuaaaaauuuccaaacaaugccggggauauuucagacaacaacaggagaaauuggagccauagcccucgacuucaaaccaggcacaaguggcucccccauaauuaaccgugagggaaaaguggugggucuauacggcaacgguguaguuaccaaaaauggagguuacgucucaggcaucgcacaaacaaacgccgaaccggacgggccaaccccggaacucgaggaagagauguucaaaaagagaaaccuaaccaucauggaccuacaccccgggucugguaagacacgaaaauaccugccagcaauagugagggaggcgauaaagcggcgacugcgcacacugauacuggcaccaaccagagucguagcggcugagauggaagaagcacuaaaaggucuacccaucagauaccaaacgacagcgaccaaaagugaacacacuggccgugaaauagucgaccuuaugugccacgcaacguucaccaugcggcuacuaagcccaguaagagucccaaacuacaaucuaaucauaauggacgaggcacauuuuaccgaucccgcguccauagcggccaggggcuauauaagcacccgcgucgggaugggagaggcagcagccauuuucaugacagccacaccaccaggcaccgccgaagccuuuccacaaagcaacgcgccaauacaggacgaggaaagagacauaccagaacgcucauggaacagugguaacgaauggauuacugacuuuguggggaagacggugugguucguucccucaaucaaggccgguaacgacaucgcuaacugccugcguaagaacggaaagaaagucauccaacugucccguaaaacauucgacaccgaauaccagaaaacaaggcuuaacgacugggacuucgucguuacaacggacauaucagagaugggagcaaacuucaaagcggaccgcguuaucgauccacgccggugccuaaagccggucaucuuaacagacgguccagaacgggucauccuugcggggccaaugcccguuacagcggcuagcgccgcacagcgacgaggccguguaggacgcaauccccagaaggaaaacgaccaauacauauucacuggacaaccccugaacaacgacgaagaccacgcacacuggacggaggcgaagaugcucuuagacaacauaaacaccccggaaggaaucauaccggcucuguuugagcccgaaagagagaaguccgcggccauagauggcgaguauagacuuaaaggugaguccaggaaaacuuuugucgaguuaaugagacguggcgaccuuccuguuuggcuugcccauaaagucgcaucggagggcaucaaauacaccgacaggaaauggugcuucgacggagagcggaauaaucaaaucuuggaggagaauauggaugucgaaauauggacgaaagaaggcgaaaggaagaaauuaaggccacgauggcuagaugcacggaccuacucagacccccuugcgcucaaggaauuuaaagacuucgccgcaggccguaagaguaucgcacucgaccucguaacagagauagggcggguucccagccaccucgcccaccgcacgcgcaacgcacuggacaaccuggugauguuacacacaucggagcacgguggacgcgcguaccggcacgcaguagaagaguugcccgagacuauggaaacccuacuacuacucggacuaaugauauuacuaaccggaggggcgaugcuguucuugauuagcggcaaggguauagggaaaaccagcauaggccuaauaugcguaaucguuagcagcggcaugcuguggauggccgauguaccacuccaauggaucgccucagcgauaguacucgaguucuucaugauggugcuccuaauccccgaaccagaaaaacagagaacgccgcaagacaaucagcuagccuacguaguaaucggaauccugacucucgcagcuaucguagcagcuaacgagaugggacuccuggaaaccacaaagagggaccucggcaugagcaaggagccaggggcagucagcaguacaaguuaccuggacguagacuuacacccagcuagugccuggaccuuauaugcgguagccaccacagucaucacgccaaugcuacggcacaccauagagaacaguacggccaaugugagccucgcugcaauugccaaucaagcagucguccuaauggggcuagacaaaggauggccaaucagcaagauggaucugggcguucccuugcucgcccuggguugcuacucacaagugaacccccuaacgcuuaccgcugccguccuacuacuuguuacccacuacgccauuauaggacccggccuacaggcuaaagccacacgagaggcgcagaaaagaaccgcugcaggaauaaugaagaacccaacagucgacggcauuaugaccaucgaccuagacccaguuauuuacgacaguaaauucgaaaaacaacuaggacaggucaugcuccuagugcuuugcgcaguacaacuacuauuaaugagaacuucgugggcacugugcgaagcacuaaccuuagcaacaggcccgaucaccacgcucugggaggguagcccugggaaauuuuggaacacaacaauugcagucucaauggcuaacaucuuucgggggaguuaccucgcaggggccggacucgcguuuagcauaaugaaaagcguaggcacaggucgucgcggaaccggcagucaaggagagacacucggggagaaauggaagaaacggcucaaccaacuaaguagaaaagaguucgaccuuuacaaaaaguccggcauaacagaagucgaucggaccgaggcaaaggagggguuaaaacgaggggaaacaacacaccacgccgugagccggggcucugccaaguuacagugguucguagagcggaacauggucauaccagaaggaagaguaaucgaccuaggaugcggcaggggcggcuggaguuauuacugugcagggcucaagaaaguaacagaggugcgaggcuauaccaaaggcgguccuggacaugaagaacccgucccaaugucgaccuauggguggaacauugugaagcugaugagcggaaaggacguauucuacuuaccaccagaaaagugugacacccuucugugcgauaucggcgaguccaguccaucacccacagucgaagaaucaaggacaauccgaguucucaaaaugguggaaccauggcugaaaaacaaccaauucugcauuaagguacugaaccccuacaugcccaccguuaucgagcaucuagaaaggcuccagcguaaauaugggggaauguuaguaagaaacccucuaagccgaaacaguacgcacgaaauguacuggaucucaaacgggaccgggaauauagucagcagcgugaauaugguaucgcgacuucucuuaaacagguuuacgaugacgcaucgccgacccacaauggagaaggacguggaucuaggugcaggcaccaggcacgugaacgccgaacccgaaacucccaacauggacguaauuggugagcgaaucaaacgcaucaaagaagaacacuccaguaccuggcacuacgacgacgagaauccauacaagacgugggcauaccacgguagcuacgaggugaaagcaacaggcuccgcaucuucgaugauaaauggcguggugaaguuauuaacaaagcccugggacgugguaccaaugguuacgcagauggccaugacagacacgacgccauucgggcagcagaggguguucaaggagaaaguggacacacguacaccgcgacccaugcccgggacgcgaaaaguaauggagauaacggccgaauggcuguggcgcacguugggucgcaacaagaagccacgacucugcacgcgggaagaauuuacaaagaagguccgaaccaacgcugcgaugggggcaguguuuacagaagagaaucaaugggacucugccagggcggcaguugaggaugaggaguucuggaagcucguggauagggaacgggagcuccaucgacugggcaaguguggcucaugugucuacaacaugaugggcaaacgagagaagaaacuaggggaguucgguaaggccaagggcucccgggcaaucugguauauguggcuuggggcgagauaccuugaguucgaggcuuuaggguuccucaacgaagaucauugguucagccgcgaaaauagcuacagcggggucgagggagaaggacuacauaaacuuggguacauucuuagagacauaaguaagaucccgggcggcgcaauguacgcagaugacacagccgggugggacacacgcaucacagaggaugaccuccacaacgaagagaaaauaacacagcaaauggacccagagcacaggcgguuagcaagcgcgauauucaagcuaacauaccagaacaagguaguuaaagugcaacgacccacaccuaaggggacgguaauggacauaaucucacguaaagaccaaaggggcagugggcaagugggcacauacggacuuaacaccuucaccaacauggaagcgcaacuggucagacagauggagggggagggagugcuuucgaaagccgaccuggaagacccacaccuauuagaaaagaaaauuacacaguggcucgagacgaaaggaguugagaggcugaagcgcauggcgauuucgggggacgacugcguaguaaagccaauugacgaccgguucgcgaacgcucugcuagcgcuaaacgauauggggaagguaaggaaagacauaccacaauggcaaccaucaaaaggcuggcacgacuggcaacaaguacccuucuguagucaccacuuucacgaauugaucaugaaggacggccggaagcuagucguacccugccgcccgcaagacgaacucauaggucgggcacgcaucucccaaggugccggauggucgcugaaggagacagcaugccuuggcaaggcuuacgcucaaauguggucccuaauguacuuccaucgacgugaccucagacuagcaaguaacgccauaugcagugcaguaccuguucacuggguucccacaagucgcacaaccugguccauccacgcacaccaccaauggaugaccacugaggacaugcucaccgucuggaaccgaguuuggauagaggacaauccauggauggaggauaagacuccagucaccacgugggaggacguaccguacuuaggaaagcgggaggaucaaugguguggcucacuaauaggacuaacaucgcgugcaacaugggcgcaaaacauacucaccgccauccaacaaguucgaucccuaauaggggacgaggaguuuuuagacuauaugccaucgaugaaacguuucagaaaggaagaggaauccgagggcgcgaucugguag

SEQ ID NO: 26192 - RNA, 9873 nt, Artificial Sequence
  derived and/or modified CDS sequence (opt11) from DENV-3__JN662391__SS-prME
acgagccuuugcuuaaugaugauucuacccgccgcucuggcguuccaccucaccucucgggacggcgagccccggaugaucguaggaaagaacgagcgcgggaagagccuguuguucaagaccgcguccgguauuaacaugugcacccucaucgccauggaccugggcgagaugugcgacgacaccgugaccuauaagugcccgcauaucaccgagguggagcccgaggacaucgacuguuggugcaaucugacaagcaccugggugaccuacgggaccugcaaccaggcaggcgaacaucggcgcgauaagcgguccguugcccucgccccccacgugggcauggggcuggacacccgcacccagaccuggaugagcgccgagggcgccuggcggcagguugaaaagguggagacgugggcucugcgacauccuggguucaccauccucgcguuguuucuggcccacuacaucggcaccucccuaacccagaaaguuguuaucuucauccugcugaugcucguuacucccagcaugacgaugcggugcgucggggugggaaaccgcgacuucguggagggccuguccggggccaccuggguggacgugguccuggaacauggcgggugcgugaccacgauggccaagaacaagcccacacucgacaucgaguugcagaagacagaggccacccaguuagcgacgcuucggaagcuguguaucgaaggcaagaucaccaacauaaccaccgauucgcgaugccccacucagggcgaggccgugcucccugaggagcaagaccagaacuacgucuguaagcacaccuauguagaccgggggugggguaacgggugcggccucuucgggaagggcucacuggugacuugcgcuaaguuucagugccuggagcccaucgaggggaaggucguacaauacgagaaccucaaauacaccgugaucaucacaguccacaccggggaccaacaccagguggggaacgagacccagggggucaccgccgagaucacgccccaggccagcacaacggaggcgauccugcccgaguacggcacccuggggcuugagugcuccccgcgcacaggcuuagacuucaacgagaugauccugcucacgaugaagaacaaggccuggauggugcaccggcaaugguucuucgaccugccccugcccuggaccagcggcgcuaccaccgagacgccaaccuggaaccgcaaagagcucuuagugaccuuuaagaacgcccacgccaagaaacaggaggugguggugcuggggucccaggagggcgcgaugcacaccgcgcucacgggggccaccgagauccaaaacucaggagggacuuccaucuucgccggccaccugaaaugccggcugaagauggacaagcucgaacuaaagggcaugucguacgccaugugcaccaacacguucguccugaaaaaggagguguccgagacccagcacggcaccauccucaucaaaguggaauacaagggcgaggacgcgccgugcaagauucccuuuuccaccgaagacgaacaggggaaggcccacaacggccgccugaucacggccaaccccgucgugaccaagaaagaagagcccgugaacaucgaggcagaaccccccuucggcgagagcaacaucgugaucgggaucggcgacaacgcccugaagaucaacugguacaagaagggauccucuaucggcaagauguuugaagccaccgcccgcggggcccggcggauggcaauccugggugacacagcgugggacuucgguuccgucgggggcguacucaauucacugggcaagauggugcaccagauauucggcuccgccuacacggccuuauucagcggaguguccugggugaugaagaucggcaucggagugcuccugaccuggauaggccugaacagcaagaacaccuccaugagcuucuccugcaucgccauuggcauaauuacgcuuuaccugggggccguggugcaagcggacaugggcugcgucaucaacuggaagggcaaggaacugaaguguggcagcggcaucuucgugacgaacgaagugcacacuuggaccgagcaguacaaguuccaggccgacucucccaagcgucucgcuaccgccaucgccggggcgugggagaacggcgucugugggauccgcaguaccaccaggauggagaaucuguuauggaagcagaucgcaaacgagcucaacuauauccugugggagaacaacaucaagcucaccgugguugucggcgacacaaucgggguacucgagcaaggcaagcgcacccugacgccccagccaauggaacugaaguacuccuggaagaccuggggcaaggccaagaucgugaccgcagagacgcagaacagcucguucaucaucgacgggccgaacacccccgagugcccuagcgcgagucgggccuggaacgucugggagguggaagacuacggcuucggaguguucacaaccaacaucuggcucaagcugcgggaggucuauacccaaaugugcgaccaccggcugaugucagccgcuguaaaggaugagcgcgccguucaugcggauaugggcuacuggaucgagucucagaagaacgggaguuggaagcucgagaaggccucgcugaucgaggucaagacuugcaccuggccgaagucccacacccuguggagcaauggcgugcucgaguccgacaugaucauccccaagagccuugccggccccauaucccagcacaauuaccggccaggauaucauacccagacggccggccccuggcaccuggggaagcucgaguuagacuucaacuacugcgagggcacaaccguagucaucaccgagaacugcggcacgcgcggccccagccugagaacuaccaccguguccggcaagcucauacaugaguggugcugccgcagcugcacguugcccccgcugcgguacaugggugaggauggcugcugguacgggauggagauccgcccuauuuccgaaaaggaggagaacauggucaagagcuuggucuccgccggcagcggcaagguggacaacuucacaaugggcgugcugugccuggcgauccucuucgaagaagucaugcggggcaaguuugggaagaagcacaugaucgccggcguguuccugaccuuuaugcugcuucugucugggcagaucaccuggcgcgacauggcccacacgcugaucaugaucggcagcaacgccuccgaccggauggguauggggguuacguacuuggcccucaucgcuaccuuuaagauccagccuuucuuggcccucggcuucuuccuacggaagcugacuagcagagagaaccuccugcuagggguaggccucgccauggccacgaccauccaacugccagaggacaucgagcagauggcgaauggcauagcguuagggcuaauggcccugaagcuuauuacccaauuugagaccuaccagcucuggacggcgcuaaucagccugacuugcuccaacaccaucuucacccucaccguagccuggcgcacagcaacacugauccuggccggcgugagccuccugcccguaugccaguccagcaguaugcggaagaccgauuggcugcccaugacgguggccgccaugggggugccuccccucccgcuguucaucuucagcuuaaaggauacccucaagaggcgcuccuggccguuaaacgagggcgugauggccguggggcuggucagcauccuugccuccagccugcugcggaaugacgugcccauggccggcccccucguggcgggcgggcugcugaucgccugcuacgucauaacggggaccucggcggaucucacgguggagaaggcggccgacguaaccugggaggaggaggccgagcagaccggcgugucacacaaccugaugauaacaguggacgacgacggcacuaugcgcaucaaggacgacgagacugagaacauccucacagugcugcugaaaacugcccugcucaucguuuccgggaucuucccguacucuauucccgccacccuccugguguggcacacguggcaaaagcagacucaacggucuggcgugcuaugggacguccccucaccgcccgaaacacagaaggcagagcuggaggagggcguguaccgaauaaagcagcaggguauucugggcaaaacgcaagugggggucggcguacagaaggagggggucuuccacacgauguggcacgucacgcggggcgccgugcucacccacaauggcaagcgccuagagccuaacugggccuccgucaagaaggaccugauuuccuacgggggcggguggcggcucuccgcccaauggcaaaagggagaggagguccagguaauugcuguggagcccgggaaaaacccgaaaaacuuccagacgaugcccggaacguuucaaaccaccaccggugagaucggggcuauugcccuggacuucaagcccggcacgagcggaagccccauuaucaaccgcgaggguaaagucgugggguuauacgggaacggcguggucaccaagaauggggguuacguguccgggaucgcccagaccaacgccgagccggacggccccacucccgaacuggaggaggagauguucaagaagcggaaccucacgaucauggacuuacaccccggcagcgggaagacccgcaaguacuuacccgcgauagugcgggaggccaucaaacgucggcuccgcaccuugaucuuggcccccacccgugucguagccgccgagauggaggaggcgcucaagggccugcccaucagauaccagacgaccgccacuaaguccgagcacaccgggcgggagaucguagacuugaugugucaugccacguucaccaugcgccucuugucacccguccgugugccgaacuacaauuuaaucaucauggacgaggcccacuucaccgaccccgccuccaucgccgcccgcggcuacaucagcacccggguggggaugggcgaggccgccgcgaucuucaugacagccacuccgcccggcacugccgacgccuucccgcagaguaacgccccaauccaggacgaggagagggacauccccgagcgcagcuggaacuccgggaacgaguggaucaccgacuucgcgggcaagacggucugguucgugccaucgaucaaggcagggaacgacauagccaacugucuccgaaagaacggcaagaaagugauccagcugucccgcaagaccuucgacaccgaauaccagaagaccaaguugaacgacugggauuucguugugacgacugacaucucugaaaugggcgccaacuucaaagcugaccgggugaucgacccccgccggugccucaagcccgucauacugaccgacggucccgagcgugugauccuagcgggccccaugcccgugacggucgccagcgccgcccagcggcgcggacgugugggucgcaacccccagaaggagaaugaccaguacauuuucaccgggcaaccccucaacaacgacgaggaccacgcacacuggacggaagcgaagaugcugcuggacaacaucaacacccccgagggcaucaucccggcgcucuucgagcccgagagagagaaguccgccgccaucgacggagaguaccgacugaagggcgagucucggaagaccuucguggagcugaugcgacggggcgaccuccccgucugguuagcgcacaagguggccucagaggggaucaaguacaccgaccgcaaauggugcuucgacggccagcggaacaaccaaauccuggaggaaaacauggacgucgagaucuggacaaaagaaggggagaagaagaagcucaggccccgguggcuggacgccaggacguacuccgacccgcuugcccucaaagaauucaaggacuucgccgcgggccgcaaaagcaucgcccuggaccuggugacggaaaucggccgggugccgucccaccuagcgcaccgcacccggaacgcacuggacaaccuaguuaugcuccacacgagcgagcacgggggccgggccuacagacaugcaguagaggaacuucccgagaccauggagacccugcuccugcuugggcugaugauccuucugaccggcggggccaugcuauuccugaucagcggcaagggcaucgggaagaccucaaucggccuaauaugcguuaucgccagcuccgggaugcucuggauggccgagauuccguugcaguggaucgcaagcgcuaucguacuggaguucuuuaugauggugcuccugauccccgagcccgagaaacagcgcacgccccaggacaaccaacuggccuacguggucaucggcauacucacucuggcggcgauuaucgccgcgaacgagaugggguugcuagagaccacgaagcgggaccuuggcaugucaaaggagccgggcguggugagccccaccucauaccuggacgucgaccuacaucccgccagcgccuggacccuguacgcagucgcgacgacggugaucacacccaugcuacgccacaccaucgagaacuccaccgcuaacgucagucucgcugccaucgccaaccaggcggugguucugauggggcuugacaaaggcuggccgauuuccaagauggaucucggggucccccuucucgcccucggguguuacucacaggugaacccccugacacugacugcagccguucuccuguuaguuacccacuaugccaucaucgggcccggucugcaggcaaaggccacccgggaggcccagaagcgcacggcagcgggcaucaugaagaacccgaccguggacgggaucaucaccaucgaccuggaccccgugaucuaugacuccaaauucgagaagcagcuggggcaagucaugcuauuggugcugugugcggugcagcuccugcugaugcggacgagcugggcgcucugcgaggccuuaacacucgcgaccgggcccauaaccacccucugggagggcucccccggcaaguuuuggaacacgaccaucgcggucagcauggcgaacaucuuccgcggguccuaccuggccggcgccgggcuggccuucagcauaaugaaauccguuggaacugggaagcggggcaccggcucacagggggagacccucggagagaaguggaagaagaaacugaaucagcugucgcgcaaagaguucgaccucuacaagaaguccgggaucacggagguagaucgcaccgaggccaaggagggccugaagaggggggagaccacccaccacgccgucagccggggcuccgcuaagcugcagugguucguggagcguaacauggugauaccagagggucgugucaucgaccucgggugcggccgcgggggcuggagcuacuacugugccgggcugaagaagguaacggaggugcggggcuacaccaagggggggccgggccacgaggagccuguccccaugucaacccacggguggaacaucgugaaguuaaugagcggcaaggacguuuuuuaucucccgcccgaaaagugcgacaccuuacugugcgacauaggggaguccagccccuccccgacggucgaagagucucgcacgauccgcgugcugaagaugguggaaccguggcucaagaacaaccaguuuugcaucaagguacugaaccccuacaugcccgccguuaucgaacaccuggagcggcuacaacgcaagcacggcggcaugcuuguacggaauccccugucccgcaacucgacgcacgagauguacuggaucuccaacgggaccggcaacaucgucucauccgucaacauggugucacgucuccugcugaaccgcuucacgaugacccaucgccgcccgaccaucgagaaggacguggaccucggggcuggcacccggcacgugaacgcggagcccgaaacucccaacauggacguuaucggcgagcggauccggcggaucaaggaggagcauaacucaaccuggcacuacgacgacgaaaacccguacaagaccugggccuaccacgggucauacgaggucaaggccacaggcuccgccagcuccaugaucaacggaguggucaagcugcugacgaagcccugggacguggugccgauggucacccagauggcgaugaccgacaccacgccuuucggccagcagcggguguucaaggagaaggucgacacccgcaccccaagacccaugccggggacccgcaaggucauggagaucacggccgaauggcuauggcggacccugggucgcaacaagcguccccgccuguguacccgcgaggaguucaccaagaaggucagaaccaacgccgccaugggcgcggucuucaccgaggagaaccagugggacucagccaaggccgccgucgaggacgaggaguucuggaagcugguggaccgcgagcgggagcugcacaagcuggggaaguguggcagcugcguguacaacaugauggggaagagagagaagaaauuaggggaguucgggaaggccaaaggcucccgggcgaucugguacauguggcugggagcacgauaccuggaguucgaggcacucggguuccugaacgaggaccacugguucagccgggagaacuccuacucaggcguagagggggagggccuucacaagcucgguuacauccugcgcgacaucuccaagaucccgggcggcgcaauguacgcagacgacaccgcggggugggacaccaggauuacggaggacgaccugcacaacgaggagaagaucacccagcagaugaacccggaacaucgccuccuggcuaacgccauauucaaauuaaccuaucaaaacaagguggugaagguccagcggcccacccccaccggaacgguuauggacaucaucagcaggaaagaccagcgcggguccggccaggugggcaccuacgggcucaacaccuucaccaacauggaggcgcagcugguacgccagauggagggcgagggggugcugaguaaggccgaucucgagaauccgcaccucccagagaagaagauaacgcaguggcuggagaccaagggcguggagcggcucaaacgcauggcgauuuccggggacgauugcgucguaaagcccauagacgaccgguuugccaaugcccugcuggcccucaacgauaugggaaaggugcguaaggauauaccccaguggcaaccauccaaaggcuggcacgacuggcagcaggucccuuucugcucccaccacuuucacgagcugaucaugaaggacgguaggaagcuaguggugcccugccgcccgcaggaugagcucaucggccgggcccgcaucagucaaggggcggguuggucccugcgcgagaccgccugccuggggaaggccuacgcccagauguggucgcucauguacuuccaccggcgcgaccugcggcuggccuccaaugccaucuguagcgccgucccgguucacuggguacccaccucccgcaccacauggagcauucacgcucaccaccaguggaugaccaccgaggacaugcucaccguauggaaucguguguggaucgaggacaaccccuggauggaggacaaaacgcccgugaccaccugggagaacgucccauaccugggcaagcgagaagaccaguggugcggaagccugaucgggcugaccagucgggccaccugggcgcagaacaucucgaccgccauccaacagguccgcagucugaucgggaacgaggaguuccuggacuacaugcccagcaugaagcgguuccgcaaggaggaggagucagagggggccauaugguga

SEQ ID NO: 26193 - RNA, 9873 nt, Artificial Sequence
  derived and/or modified CDS sequence (opt11) from DENV-3__AY858043__SS-prME
accucacuaugccuaaugaugaugcuaccagcuacccuggcguuccaccuaacaucgagggacggugaaccgcgcaugauaguagguaaaaaugaacgcgguaaaucacuacuguucaaaacagccucaggcaucaacaugugcacacuuauagccauggaucugggcgaaaugugcgaugacacgguaacguauaagugcccccuaaucacggaaguugaaccggaagacauagacugcuggugcaaccuaacgagcaccugggucacuuaugguacaugcaaccaggcuggugaacaccgacgagacaaacgguccgucgcacucgcgccgcaugucgguauggggcucgacacccgagcacaaacguggauguccgcagaaggcgcguggcgacaagccgagaaaguggaaaccugggcacuacggcauccaggcuucaccauccucgcacuauuccuggcccacuauauagggaccucgcuaacacagaaggucguaaucuucauacuccugaugcuaguaacgcccagcaugacaaugcgcugcguuggaguggggaaccgagacuucgucgaaggccugucuggagcaaccuggguagacgucguauuagaacauggugggugugucaccaccauggcgaaaaacaagccaacccuagauauagagcugcagaagaccgaggcgacccaacuagcaacacuccgcaaacuauguauagaaggcaagauaaccaaugucacgacagauucaaggugcccaacccaaggugaagcgauauuacccgaagaacaagaccaaaacuacgugugcaggcacaccuacgucgaccgaggcuggggcaacgguugcggacucuucgggaaagguagcuuaguaacaugcgcaaaauuccaaugccuugagcucauagagggcaaaguaguccaacacgagaaccuaaaauauacagugauaauuacaguccacaccggggaucagcaccagguaggaaaugaaacccaagggguaaccgcggagauaacaccccaggcgucgaccguagaggcgauacuaccggaauacgggacauugggacuagagugcagcccaagaacgggacuggacuuuaacgaaaugauucuauuaaccaugaaaaacaaagcguggauggugcauaggcagugguucuuugaucugccgcuucccuggacaagcggggccacgaccgaaacaccaacauggaacaagaaagaacuccuagucaccuuuaaaaacgcccacgccaagaaacaagaaguuguaguuuugggcucucaggagggcgcuaugcacacagcccuaaccggcgcuacagaaauacagaccaguggcggcaccuccauauucgcgggacacuugaaaugcagacuuaagauggacaagcuagaacugaaggggaugucuuacgccaugugcagcaacgcauucgugcucaagaaagaagucagcgaaacgcagcauggaacaaucuugauaaaagucgaauauaaaggcgaagacgcacccuguaaaauuccauucucaacugaagacgggcaaggcaaaguccacaacggucgccugauaaccgcaaacccgguaguaacaaagaaggaggaaccggugaauauagaagcggagccacccuuuggagaaagcaacauuauaaucggaauuggcgacaaggcccuaaagauaaauugguauaagaaagggaguuccauuggaaaaauguucgaggcgaccgcgcgaggagcaagaaggauggcgauacugggagacacugcaugggacuucggcagcgucggcggugugcuaaacagccuaggcaaaaugguccaucagaucuuugguucagcauacacagcauuguuuagcgggguuagcuggaucaugaaaauaggaaucggagugcuguugacuuggauagggcugaacuccaaaaauaccucaaugucauuuuccuguauagucaucggaaucauuacacuauaccuuggagcggucguccaagcagacauggguugcguaauuaauuggaagggcaaggagcucaagugcgggagcgggauuuuugugaccaacgagguccauacauggacagaacaguacaaauuccaggcugacucuccgaagaggcuugcgacagcaauugcaggggccugggagaauggugugugcggaauacggaguacgacucgcauggagaaccuacuauggaaacagaucgcuaacgaauugaacuacauacuaugggagaacaacauaaagcucacagucguaguaggcgacaucauaggaguacuagagcaagggaaaagaacgcuaaccccacagcccauggaauuaaaguacagcuggaaaaccuggggaaaagcuaaaguuguuacugcagaaauucaaaauucaucguucauaauagacgggccgaacacucccgaaugccccaacgcgucgcgagccuggaacguuugggaggucgaagacuauggauuuggagucuucacaacgaacauauggcucaaacuucgcgagauguacacccaacucugugaccacaggcuaaugucggcggcagugaaggacgagagggcgguacacgccgacaugggcuacuggauagagucgcaaaagaacggcucauggaaacuggagaaggcaagccuuauagaaguuaagacuuguacguggcccaagucccacacccucuggucgaacggagucuuagaguccgacaugaucaucccgaaaucauuggcgggacccauaucacagcauaauuaucgucccggguaccauacgcaaacggccggcccauggcacuugggaaaacucgagcuagacuucaacuauugcgaggggacaaccguggugaucacagagaacugcgggacccgaggccccucguugcguacaacgaccgucuccggaaagcuaauccacgaauggugcugccgaucuugcacacucccgccacuccguuacaugggggaggacgguugcugguacggaauggagauacgucccauaaacgaaaaggaagagaacauggugaaaagccucguaagugcugggucaggcaaaguggauaauuuuacaauggguguccucugucuagccauccuauuugaggagguuaugcgaggaaaguuugguaaaaagcacaugaucgccggcgugcuuuuuauguucguccuacugcucagcggacaaauaacguggcgggacauggcccggacacucaucaugauaggguccaaugcauccgacagaaugggcaugggagugaccuaccuggccuuaauagccacguuuaagauacagccauuucuugcccucggauucuuucuccggaagcucaccucgagagaaaaccuacuccuaggagucgggcuggccauggccacgacccugcagcuacccgaagacaucgaacaaauggccaacgguaucgcacuagggcugauggcccuuaagcucauaacccaauucgagaccuaccagcuguggacggcucucguuucccuaaccuguuccaauacuauuuucacgcuaacaguggcuuggagaacggcgacacugauccucgcagggaucucguugcuaccagucugucaaucguccuccaugagaaaaacagauuggcucccuaugacuguggccgccaugggaguaccgccgcuuccucucuucauauucagccuaaaagacacgcucaagaggcgcucguggccccugaacgagggugugauggcggucggccuagucuccauucucgcauccucgcugcugcguaacgacguacccauggcagguccccuugucgcuggaggccugcuaauagcgugcuacgucaucacaggcacgagcgcagacuuaacugucgaaaaggcggcggacguuacgugggaggaagaggcagagcaaacuggcgucagccacaaccugaugauaacugucgacgaugauggaacaaugcgcaucaaggacgaugagacggaaaacauuuuaacuguccucuugaagacugcacugcucauugugucaggcauauuccccuacaguauaccugcgacccuccuaguguggcacacauggcagaagcagacccaacggucggguguacuaugggaugugccguccccucccgaaacucaaaaagcagaacuagaggaaggcgucuaccgcaucaaacaacaaggcauuuucgggaaaacacagguagguguaggaguccagaaagaagggguguuucacaccauguggcauguaacacgaggcgcugucuugacauacaacggcaaaagauuagagccaaauugggccagcgugaaaaaggaucucaucaguuacgggggaggguggcgccucucagcacaauggcggaaaggcgaagaagugcaaguaauagccgucgaacccggcaaaaacccaaagaacuuccagacgaugccgggcaucuuucagacgaccacgggugagaucggggccauagcacuugacuucaaaccaggaacgucaggaagccccaucaucaaccgggagggcaaaguggugggacuguauggaaacggagucgucacgaagaacggcgguuacguaucagggauugcacaaacaaacgcagaaccggacggaccgacaccagaacuggaagaggagauguucaagaagagaaacuugacaauuauggaucuucacccagguagcgguaaaacccgaaaauaucugccggccaucgugagggaagcgaucaaaagacggcuacgcacacugauacucgcaccaaccagaguuguggccgccgagauggaagaagcacugaaaggccuaccaauccgauaucagacaacagcaacuaaguccgaacacacgggaaaggaaauuguggaccuaaugugccacgccaccuucacaaugaggcuccugucccccguccgcgugccuaauuacaaccuaauaaucauggacgaggcgcacuucacagacccagcaagcauagccgcaagaggauacauaucaacgagaguaggaaugggggaagcagcagcaauauuuaugaccgcgacgcccccagguacugccgaugccuucccccaaucaaacgcuccaauacaagacgaggagagggacauacccgaaagauccuggaauagcggcaacgacuggaucacugacuucgcagggaaaaccgugugguuuguacccuccauaaaagcagguaacgacauagcuaauugcuugaggaaaaauggaaagaaaguaauacaauuaaguagaaagacuuuugacacagaauaccagaaaacaaagcuaaaugacugggacuucgucguaaccaccgauaucuccgaaaugggggcaaauuucaaagccgaucgggucauagacccgcgccgcugucucaaaccaguaauacucaccgacggcccagaaagagucauccuugcuggaccuaugccagugacaguagcgagcgcugcgcaacggcgugggaggguuggacgcaacccgcagaaggagaacgaucaguacauauucacaggacaaccccugaacaacgaugaagaccacgcacacuggacggaagcuaagaugcugcuagacaacauaaauacuccggaaggaauaauucccgcucuauucgagcccgagagagaaaaauccgcagccaucgacggggaauaucgccucaaaggagaaagucggaagacguuuguagaauuaaugcgaaggggagaccucccgguguggcuagcccacaaaguggccucugaaggaauuaaauacacggaccgcaaguggugcuucgauggcgaacgaaacaaccaaauacuagaggaaaacauggauguugaaaucuggaccaaagaaggggagaaaaagaaguuacgaccgcgauggcucgacgccaggaccuacucagacccacuagcucuaaaggaguucaaagacuuugccgccggccggaaaagcauugcacucgacuuagugacagagauagggcgaguacccucacaccuagcccaccguacaagaaacgcacuggacaaccuaguaaugcuacacacaucggaacacggugggagagcauaccgucacgcgguagaagaacuaccggagacgauggaaaccuuuuugcugcuaggccucaugauccucuugacgggcggggcgaugcuguuccucaucuccgggaagggaguggggaaaaccagcauagggcuaauauguguaguggccagcagcggcaugcuguggauggccgacaucccccugcaguggaucgcuuccgccauaguacucgaauuuuucaugaugguccuacucaucccagaaccggaaaagcagcguacaccucaggauaaccaacuggcauacguagucauuggcauuuugacacucgcugccauaguggcggccaacgaaaugggucuguuagaaaccacgaaaagagaccuggggaugucuaaagaacccgguguaguuuccccaacuucauaccuagauguagaucugcacccagcgagcgcguggacgcucuacgcaguugcuacuacagucauuacaccaaugcucagacacacgauagagaacuccaccgcgaacgugagccuggcggccauugcaaaccaggcgguaguccugauggggcuagacaagggcuggccgauuagcaagauggaccuugggguaccccuacucgcccuaggguguuacucgcaagugaacccccucacccuaacggccgcuguccugcuccuggucacacacuacgccauaauaggcccgggcuugcaagcaaaagcgacgcgagaggcgcagaagcgcacugccgcaggaauuaugaagaacccaacgguggacgguaucaugaccauagaccucgauccagucauuuacgacucuaaguuugaaaaacagcucggucagguaaugcugcuaguacugugcgcaguccaguuacuccucaugcgaacguccugggccuucugcgaagcccuaaccuuagcaaccggacccaucaccacucugugggaggggucuccaggcaaguucuggaacaccacuauagccgucuccauggcuaacaucuuccgggguagcuaccuagcaggggccggcuuggccuuuuccaucaugaaaagcgugggaacugggaagagaggaaccgggagccaaggagaaacccucggagaaaaguggaaaaagaaauugaaccaacuaucccggaaagaguucgaccuuuacaagaaauccggcaucacagagguagaccggacggaagcgaaagagggucucaaaagaggggaaacgacacaccaugccguaagcagaggcagcgcgaaauugcaaugguucguggaacgcaacaugguaaucccggaagggaggguaauagaccugggaugcggaagagggggcuggucguacuacugcgcgggucucaagaaaguaacagaggugagagguuacaccaagggcggccccggucacgaggagccgguacccaugucaacauacggguggaacauagucaagcugaugucaggcaaagacguauucuaccucccacccgaaaagugcgacacacuacuaugcgacauaggagagucgucgccaucacccacuguggaagaauccagaacgauacgcguacuaaagaugguugaaccauggcucaaaaacaaccaguuuugcauaaaaguacuaaaucccuacaugccuacaguaauagaacaccuagagagacuacaacgaaaacacggaggcaugcugguacggaacccuuugagcagaaacaguacccacgaaauguacuggauaucaaauggcaccggaaauauaguuucaagcgugaacaugguaucccgacuacuccugaaccgguuuacaaugacguacaggcgaccuacuaucgaaaaggacgucgaccuuggagcgggaacccgacacgugaacgcggaaccagaaacaccaaacauggacguaaucggagagagaauaaggagaaucaaggaggagcacaguucuacuuggcacuaugacgacgaaaaccccuauaagacaugggcauaucacggaucuuacgaagucaaggccacuggauccgccucaagcaugauuaacgggguugugaaauuacuaacaaagccgugggacgucgugccgacaguaacccagauggccaugacagacacgacgccauucggacagcagcgugucuuuaaggaaaaggucgacacccggaccccaaaaccgaugccuggcacccgcaaagucauggagaucacagcggaguggcuauggcgcacccuggguagaaacaaaaggccgcggcuuugcacacgagaagaguucacgaagaaaguaaggacaaaugcagcaaugggggccguuuucaccgaagagaaccaaugggacagcgcaagagcagcagucgaggacgaagaguucuggaaguuaguagacagagaacgagaacugcacaaacaagguaagugcggguccugcguauacaacaugaugggaaagcgggaaaagaaacuuggcgaauuuggaaaagccaaggggagccgagcuauuugguauauguggcuuggagcacgguaccuggaguucgaagcucuaggauuccucaacgaagaccacugguuuagccgugaaaauaguuacagcggaguagaaggcgaggggcuucacaaacuuggauacauacugcgcgacauuagcaaaauaccaggaggagccauguacgcugacgacacggccgggugggauacgcgcauuaccgaagacgaucuacauaacgaggagaagauuacacagcagauggacccggagcacaggcagcucgcuaaugcgaucuucaagcugacauaucaaaacaaaguugugaaagugcaaaggcccacgccaaaaggcacagucauggacaucaucaguagaaaagaccaaagaggauccggacaggugggcacguacggacucaacaccuuuaccaacauggaagcccaacugauaagacagauggagggagaaggaguacuguccaagaccgacuuagaaaacccacaccuccucgagaagaaaaucauccaauggcuggaaacgaaaggcgucgaacgauuaaagcgaauggcgaucucgggcgacgacugcgucguaaaacccauugacgacagauucgcaaacgcgcuucuagcacucaacgauaugggaaaagugcgaaaagacaucccgcaauggcaaccaagcagggguuggcacgacuggcagcagguccccuucugcagccaccacuuccacgagcugauuaugaaggaugggcguaaacucguagucccaugucgaccccaagacgagcuuaucggccgcgcccgcauaagccagggagcaggguggucacucaaagagacagccugccugggaaaggcguacgcccaaaugugggcgcuaauguacuuccacaggagggacuuacgacucgcuucaaacgcuauuugcagcgccgugccugugcacuggguccccacaaguagaaccaccuggagcauacacgcacaccaccaauggaugaccacagaggauaugcuaacagucuggaauagaguuuggauagaggacaacccuuggauggaagacaaaacgccugugacaaccugggaggacguacccuaucuagggaaaagggaagaucaguggugcggcagccuaaucggccugaccagccgagcuaccugggcacagaacauccuuaccgcgauacaacaagugaggucucucaucggaaacgaagaguuccuagacuacaugccauccaugaaacguuuccgaaaagaagaagaaucggagggagcaauaugguaa

SEQ ID NO: 26194 - RNA, 9873 nt, Artificial Sequence
  derived and/or modified CDS sequence (opt11) from DENV-3__AY858044__SS-prME
acaagucugugccucaugaugaugcugcccgccacccuggcuuuccacuuaaccucaagagacggggagcccagaaugaucguggggaagaacgagcgcggcaagagccugcuguucaaaacagcguccggaaucaauauguguacgcucauagccauggaccuuggggaaaugugcgacgacaccauuaccuacaagugcccccugaucaccgagguggagcccgaggacauagacuguuggugcaaccugaccucuacuugggugacguacgggaccugcaaccaagcgggcgagcaccggagagauaagcggagcguggcccuggcgccccacguggggauggggcuggacacccgcgcgcagacguggaugagcgcggagggcgcguggcgccagguggaaaagguggagacgugggccuuccgccaccccggauucaccauccuugcgcuguuccuggcccacuacaucggcaccucccugacucagaaaguggugaucuucauccugcugaugcucgugacgccgagcaugaccaugcggugcgucggggugggcaaccgcgacuuugucgagggccugucgggggccaccuggguugacgugguacuggagcacggcgggugcgucacaacgauggccaagaacaagcccacauuggacaucgagcuucaaaagacagaggccacccagcuggcgacucuccgcaagcugugcaucgaagguaagauaaccaauguaaccaccgacagccgcugcccgacgcagggcgaggccauccugcccgaggagcaggaccagaacuacgugugcaagcacaccuaugucgaccggggguggggcaacgggugcggccucuucgggaagggcagucugguuaccugcgccaaguuccagugccuugaguuaaucgaaggcaaggugguccagcacgagaaccugaaguacaccgugaucaucacggugcacaccggugaccagcaccaggucgguaacgaaacccaaggggugaccgccgagaucacuccccaagccagcaccgucgaagcgauccuccccgaguacggcacccucgggcuggagugcagcccgcggaccgguuuagacuucaacgagaugauccuccuaaccaugaagaauaaggccuggauggugcaccggcagugguucuuugaccugccgcuccccuggacgagcggcgccaccaccgagaccccuacguggaauaagaaggagcuguuagugacuuucaagaaugcgcacgccaaaaagcaggaggugguagugcucgggucccaagagggcgcgaugcacacggcccugacaggugcaacugaaauccagacuagcgggggaaccuccaucuucgcaggccaccugaagugccgccucaagauggacaaacuggagcugaaggguaugagcuacgcuaugugcuccaacgcguucguucucaagaaagaggucagcgagacccagcacggaacgauccuaaucaaggucgaguacaagggagaggacgcccccugcaagaucccguucagcacagaggacggacagggcaaggcccacaacggcagacugauaaccgcuaaccccgucguuaccaaaaaggaggaaccgguaaacaucgaggcggaacccccguucggcgaguccaacaucaucaucggcaucggggacaaggcccuaaaaaucaacugguacaagaagggcagcuccaucgggaagauguucgaggccacggcccgcggcgcccggcgcauggcgauccucggggacacggccugggacuucggaagcgucggcggcgugcuaaauucccugggcaagauggugcaccagaucuucgggagcgccuacaccgccuuauucucaggcgucagcuggaucaugaagaucgggaucgggguauuguugaccuggauagggcucaacuccaagaacacgagcauguccuucucuugcaucgugauagggauuaucacccuguaccuaggcgcagucgugcaggcagacauggguugcguuaucaacuggaagggcaaggaguuaaaaugcggcucugggaucuucgugaccaacgagguucacaccuggacggagcaauacaaguuccaggccgacagcccgaagcggcuggcaaccgccauagcuggcgcgugggagaacggggugugcgggauccgguccacgacaagaauggaaaaccuacucuggaagcagaucgccaacgagcugaauuacauccugugggagaacaacaucaagcuaacggucguggugggggauaucaucggcguccuggagcagggcaagcggacccugacgccccaaccuauggagcucaaguacagcuggaagaccugggggaaagccaagaucgugaccgccgagauccagaacuccagcuucaucauugacggccccaacacuccugaguguccaaacgcgucaagggccuggaacgugugggaggucgaggacuacggguucggaguguucaccaccaauaucuggcuaaagcugcgggagauguacacgcagcugugcgaccaccgccugaugagcgccgccguaaaggacgagcgggccguccacgcggacaugggcuacuggaucgaaucgcagaagaauggaagcuggaaguuagagaaggccucccuaaucgaggugaagacgugcaccuggccgaagucccacacccuguggucuaacggcgugcuggaguccgacaugaucauuccuaagucacucgccgggccaaucucgcagcacaacuaccguccgggcuaccacacccagacggccgggccguggcaccugggcaaauuggagcucgacuucaacuacugcgagggcaccacagucgugaucaccgagaacugugggacgagaggccccucccugcgcaccaccaccguaucugggaaguuaauacacgagugguguugccggaguugcacgcucccgccucuccgcuacaugggcgaggacggguguugguacggcauggagauacggccgaucaacgagaaggaggaaaacauggucaagucacuggugagcgccggcuccggaaagguggacaacuucaccaugggcguccucugccuggcgauccuguucgaagaggugaugcgcgggaaguucggcaaaaagcacaugaucgcaggggucuuauucauguuugucuugcugcucagcggccagauaaccuggagggacauggcgcgcacccugaucaugaucgggagcaacgccagcgaccgcauggggaugggagugacguaccuggcccucaucgcgaccuucaagauccagcccuucuuggcucugggguucuuccuccgcaaguugacaagccgggagaaucuacuccugggcgugggacuggcgauggccacuacgcuccaacugccagaggacaucgagcagauggccaacgggaucgcccugggccugauggcccugaaguugaucacccaguucgagaccuaccagcucuggaccgcccuggucagccucacgugcagcaacacaaucuucacacucaccguggccuggcgaacggcaacccucauccuggccggcaucucccuccuacccgugugccagagcuccuccaugcggaaaaccgacuggcuuccgaugaccgucgccgccaugggaguaccgccccucccccuuuucaucuucucccugaaggacacgcucaagcgcaggagcuggccgcucaacgaaggcgugauggccgugggccugguuuccauccucgcaagcucucugcuacgaaacgacgucccaauggccggaccccucguggcaggcgggcugcugaucgcgugcuacgugaucaccgggaccagugccgaccucacuguagagaaggcggccgacgugacgugggaggaggaggccgaacagaccgggguaucgcacaaucugaugaucaccguggacgacgacggaaccaugcggaucaaggacgacgagacggagaacauccugaccguccuccucaagaccgcccugcucauaguguccggcauuuuccccuacuccaucccggccacccugcugguguggcacaccuggcagaagcaaacgcagcggaguggcgugcucugggauguucccagcccgcccgagacacagaaggcggagcucgaagagggggucuaucgaaucaagcaacaaggcaucuucggaaagacacaggugggcguggggguccaaaaggagggcguguuccauaccauguggcacgugacgcggggcgccguccucaccuauaacgggaagcgccucgagccgaacugggccagcguaaagaaggaccugaucuccuacgguggaggcuggcggcugagcgcccaguggcaaaagggggaggaggugcaggucaucgcgguggagcccggcaagaacccgaaaaacuuucagaccaugcccggcaucuuccagaccacgacuggggagaucggcgccaucgcgcuggacuucaagccggggacguccggcagccccaucaucaaccgugagggcaagguggucgggcucuacggcaacgggguggucaccaaaaacggaggguacgugagcggcaucgcccaaacuaacgcggagcccgauggcccgacucccgagcuggaggaggagauguucaagaagcggaaccugaccaucauggaccuccaccccgggucuggcaagacccgcaaauaccugccugccauaguccgcgaggcaaucaaacgccggcugcgcacgcucaucuuagccccgacccggguggucgccgccgagauggaggaggcucugaaggggcuccccauccgguaccagaccacugccaccaagagcgagcacaccgggaaagagaucguggaccugaugugccacgccaccuucaccaugcggcugcucucccccgugcgcgugcccaacuacaaccugaucauaauggacgaggcccacuucacggacccggccagcaucgcggcccggggcuacaucuccacacgcgugggcaugggcgaggcagccgcgaucuucaugaccgccacgccgcccgggacggccgacgcuuucccccagagcaacgccccgauccaggacgaggagagagacaucccggagcgcuccuggaauagcggcaacgacuggaucaccgacuucgcggggaagacagugugguucguccccucgaucaaggccgggaacgacaucgccaacugcuugcgcaagaacgguaagaaggugauccagcucagucggaagaccuucgacacugaguaucagaagaccaaacugaacgacugggauuucguagucaccacugacaucuccgagaugggcgcuaacuucaaggcugaccgugugauagacccccgccgcugccugaagccggugauccucacugacggccccgagcgcgucauccuggcggggcccaugccggucaccguugccagcgccgcccagcgccguggcaggguagggcggaacccccagaaggaaaacgaccaguacaucuucaccggccagccccuaaacaacgacgaggaccacgcccacuggacagaggcgaaaaugcuucuggacaacaucaacacgcccgaggguauuaucccagcccuguucgaaccagagcgcgagaaguccgccgcgaucgacggugaauaucggcucaagggcgaaucucggaagaccuuuguggaguuaaugcggcgcggggaccugcccguguggcucgcgcauaaggucgccuccgaggggaucaaguacaccgaccggaaguggugcuucgauggggagcgcaacaaccaaauucuggaggagaauauggacguggagaucuggacuaaggagggcgagaagaagaaacugcgaccacgcuggcuagacgcccggaccuacagcgacccccuggcccuaaaggaguucaaggacuucgccgcgggacgcaaauccaucgcucuagaucuggucacggagaucgggcgcgugccuagccaucuggcccaccggacccguaacgcccucgacaaccuggugaugcugcacacaagugagcacggcgggcgggcauacagacacgcggucgaggagcuacccgagaccauggagacgcugcuguuauugggcuugaugauccucuugaccgggggcgccaugcuguuccucauaagcggcaaggggguaggcaagacaagcaucggucugaucugcgucguugccaguagcggcauguuguggauggccgacauaccgcuccaguggaucgcguccgccauaguacuagaguucuucaugauggugcugcucaucccggagcccgagaaacagagaacgccccaggauaaucagcuggccuacguagugaucgggaucuugacgcuugccgccaucguggcagcgaacgagaugggccugcuggagaccaccaaaagggacuugggcaugagcaaggagcccggggucguuuccccgaccagcuaccuggacguggaccuucaccccgcguccgccuggacgcucuacgcugucgcgaccaccgugauaacccccaugcugcggcacacgaucgaaaacagcaccgccaacgugucccuggccgccaucgccaaccaggcggucguguugaugggucuggacaagggguggcccaucucgaagauggaccugggcguaccgcuccuggccuuggggugcuacucccaagucaacccccucacccuuaccgccgcuguccugcuccuggugacgcacuacgccaucaucggcccuggacugcaggcgaaggccacccgcgaagcccagaaacggacggccgccgggaucaugaagaacccuaccgucgacgggaucaugaccaucgaucucgacccggugauuuacgacagcaaguucgagaagcagcugggccaggugaugcugcucguauugugcgcggugcagcugcucuugaugaggaccuccugggcuuucugcgaggcccugacccucgccacgggcccgaucacgaccuugugggagggcagcccagggaaauucuggaacaccaccaucgcgguguccauggcuaacauauuucgcggcagcuaccuggccggcgccggccuggcauucuccaucaugaaguccgucgggacgggcaagcgcggaaccgggucccaaggcgagacccugggggagaaguggaagaagaaguugaaccaacucagccggaaggaguucgaccuguacaagaaguccggcaucaccgagguggaccgcacggaagcgaaggaagggcugaagagaggagagaccacacaccaugccguaagucgcggaagcgccaagcuccaaugguucgucgagcgcaacauggugauucccgaggggcgcgugaucgaccugggcugcggaagaggagggugguccuacuacugugcaggucugaagaaggucaccgaggugcgcggcuacacgaagggcgggccugggcaugaggaacccgugcccaugagcacguacggcuggaacauagucaaacuuauguccgggaaggacguuuucuaccugccaccggagaagugugacacucugcucugcgacaucggagaaagcuccccaagccccaccguggaggagucccggaccaucaggguccuaaaaaugguggagcccugguugaaaaacaaccaguucugcaucaaggucuuaaacccguacaugccaacugucauagagcacuuggagcgccugcagcggaagcacggcgggaugcuggugcgcaacccccucagccggaacuccacucacgagauguacuggaucagcaacggcaccgggaacauagucuccuccgucaacauggucucccgcuuacugcugaaccgguucaccaugacguaccgccgucccaccaucgagaaggacguggaccugggcgccgggaccagacaugucaacgcggagccggagacgcccaacauggacguuaucggggaacguauccgucguauaaaggaggagcacagcuccacguggcacuacgacgacgagaaucccuacaagaccugggccuaccacggaagcuacgaggucaaggccaccggguccgccagcuccaugaucaacggcguggugaagcugcucacgaaacccugggacgucgugccaacggugacccagauggccaugaccgacaccacgcccuucgggcagcagcgcgucuucaaagagaaggucgacacccggacgcccaagccgaugcccggcacucgcaaagugauggagaucacggcugguuggcuguggagaacccugggccguaacaagcggccgcgccucuguacgcgggaggaguucaccaagaagguucgcacuaacgccgccaugggcgccguguucacggaggagaaccagugggacuccgcacgugccgccguggaggaugaggaguucuggaagcuggucgaccgggaacgugagcugcacaagcaggggaaguguggcagcugcguguacaacaugauggggaagcgugaaaagaaguuaggcgaguucgggaaggccaaggggucccgggccauuugguacauguggcugggcgcgcgguaccuggaguucgaggcccuugguuucuuaaacgaggaucauugguucagucgcgaaaauucguacuccggcguagagggggaaggccuucacaaguuaggcuacauccugagggauaucuccaagauccccgggggcgcgauguaugccgacgacaccgccgggugggacacccgcaucaccgaggacgaccugcauaacgaggagaagaucacacagcaaauggacccggagcaccgccagcucgcgaacgccauauucaagcucaccuaccagaacaaggucgugaaggugcaacgccccacgcccaagggcacggucauggacaucaucagccggaaggaccagcgaggcuccggccagguggggaccuaugggcugaacacguucaccaacauggaggcgcagcucauccggcagauggagggcgaaggggucuuaagcaagaccgaccuggagaacccccacuugcuggagaagaagaucacccagugguuagagaccaagggcgucgagcguuuaaagcggauggccaucucuggcgacgacugcguggugaagccuaucgacgaccgcuucgccaacgcgcugcuggccuuaaacgacauggggaagguccggaaggacaucccccaguggcagcccucaaagggcuggcaugacuggcagcagguccccuucugcucccaccacuuucacgagcuuauaaugaaggacggccgcaagcugguggucccgugccgaccacaggacgagcucaucggccgcgcccggaucagccagggggcuggcuggagucugaaggagaccgccugccugggcaaggcguacgcgcagaugugggcacucauguacuuccaccgccgcgaucugcggcuagcaaguaacgcgaucugcuccgccgugcccgugcacuggguccccacaagccgcacgaccugguccauucacgcccaccaccaguggaugaccaccgaggauaugcucacgguguggaaccggguuuggaucgaggacaacccguggauggaagacaaaacccccgucaccacuugggaggacgugcccuaccuggggaagcgcgaagaucaguggugcgggagccugaucgggcucacgucccgggccaccugggcccaaaacauucuaaccgcgauccagcagguccgcucccugauaggcaaugaggaguuccuagacuacaugccuucaaugaagcgguuucgcaaggaagaagaguccgagggggccaucugguaa

SEQ ID NO: 26195 - RNA, 9873 nt, Artificial Sequence
  derived and/or modified CDS sequence (opt11) from DENV-3__AY858045__SS-prME
acaagccugugccucaugaugaugcugccagcuacccuggccuuccaccucaccagccgugacggggagccccgcaugaucguggggaaaaacgagcgcggcaagagccugcuguucaagacugcuuccgggauaaacaugugcacccucaucgcgauggaccugggggagaugugcgacgacacuaucaccuacaagugcccgcugaucacagagguggaacccgaggacaucgauugcugguguaaccuuaccagcaccugggugacguaugggacuugcaaccaggccggagagcaucggagggacaaacgguccguggcccuggcgccccacgugggcaugggucuggacacgcgcgcgcagaccuggaugagcgccgagggcgccuggcgccagguugagaaaguggaaacaugggccuuccgccacccaggcuucaccauccucgcgcuguuccuggcccacuauaucgguaccucgcucacccagaaggucgucaucuuuauccugcugaugcucgugacgcccaguaugaccaugcggugcguugggguaggaaacagagacuuuguggagggccuguccggagcgaccugggucgacgugguccuggagcacggugggugcgucaccacgauggccaaaaacaagccgaccuuagacaucgagcuacagaaaacugaagccacccagcuggcgacgcuccguaagcugugcaucgagggcaagaucacaaacgugaccaccgacagccgcugucccacgcagggagaggccauccugcccgaggagcaggaccaaaauuacgugugcaagcacacuuacgucgaccgggggugggggaacgggugcggccucuuuggcaaaggcucccuuguaacaugcgccaaguuccaguguuuagagcucauugaaggcaagguuguccagcaugagaaccugaaauacaccgugauuauaacggugcauacgggggaccaacaccaggucgggaacgagacucagggggugaccgccgagaucacgccgcaagccucaaccgucgaagcgauccugcccgaguacggaacccucgggcuggaguguagcccccggaccggccuggacuuuaacgagaugauccuccugaccaugaagaauaaggccuggaugguucaccggcagugguucuucgaccugccacucccguggacaagcggcgccacaacagaaacacccacguggaacaagaaggaacuguuaguuaccuucaagaacgcccacgcaaagaaacaagaggucguggugcucgggucccaggagggggcgaugcauaccgcgcugacaggggccacagagauccagaccagcggcgggaccuccaucuucgccggccaccugaaaugcagguugaagauggacaagcuggaacuaaagggcaugagcuacgccaugugcuccaacgcuuucgucuugaagaaggaggugagcgagacgcagcacgggacuauccugaucaagguggaguacaagggugaggacgcaccaugcaagaucccguucagcaccgaggacgggcaaggcaaggcccacaauggccgauugaucaccgccaaccccgucgugaccaaaaaggaggagcccgugaacaucgaggcugagcccccguucggagaguccaacaucaucaucggcauaggggauaaggcccuuaagaucaacugguacaagaaggguagcuccauugggaagauguucgaggcuacggcccgcggcgcacggcgcauggcgauacucggcgacacagccugggacuucgggagcguaggaggaguacugaacucccugggcaagaugguccaccaaauuuuugggucggccuacaccgccaucuucuccggugucagcuggaucaugaaaaucggcaucgggguucuccugaccuggauaggccugaacuccaagaacacgagcauguccuuuucaugcaucgugaucgggaucauuacauuauaccugggcgccgucgugcaggcggacaugggaugcgugaucaauuggaaggggaaggaguuaaagugcggaagcgggaucuucgucaccaacgaggugcacacauggacggagcaguacaaguuccaagccgacagccccaagcgguuggccaccgccauagccggcgcgugggagaauggggugugcgguauccgcuccaccacucggauggagaaucugcuguggaagcagauagcaaaugagcucaacuacauccugugggaaaacaacaucaagcugacggucguagugggggauaucauaggcguccucgagcagggcaagcguacacugacgccacagcccauggaacuaaaauacagcuggaagacuugggggaaggccaagaucgugacugccgagauccagaacuccagcuuuaucaucgacggcccuaacaccccggagugucccaacgcgucacgcgccuggaacgugugggagguugaagacuacggguucggcguguucacgaccaacaucuggcucaagcugcgugagauguacacgcagcugugugaccaccgcuuaaugagcgccgcugugaaggaugagcgggccguccacgcggacaugggauacuggaucgagagccaaaagaacggcuccuggaagcuggagaaagccagccugaucgaggugaagaccuguacuuggcccaagucccacacccucuggagcaacggcgugcuggaguccgacaugauuauucccaaaucacuggccgggcccaucucccagcauaacuaucgccccggcuaccacacccagacggcugggccguggcaccucggcaagcuggagcuagacuucaacuacugcgagggcaccacggucgugauaaccgaaaacugcgggacgcggggccccucccuccgcaccaccaccguguccgggaaauugauccacgaguggugcugccggagcugcacgcuaccgccacugcgcuauaugggcgaggacgggugcugguacggcauggagauccggccgaucaacgagaaggaggagaacaugguaaagucccugguuagcgccggcuccgggaagguggacaacuucaccaugggcgucuugugccucgcgauccuguuugaggaggugaugcgcgggaaguucggcaagaagcacaugaucgcaggggugcuguucauguuugucuugcugcugucgggccagaucaccuggcgcgacauggcccgcacccucaucaugaucggcucaaaugccuccgaccggauggggaugggcgugacguaucuggcacugaucgcgacuuucgagauccagcccuucuuagcccugggguucuuccugcgcaagcucaccucccgugagaaucuauugcucggcguagggcuggccauggccaccacacugcagcugcccgaagauaucgagcaaauggcgaacgggaucgccuugggucuaauggcccucaagcugauuacucaguucgaaaccuaccagcuguggaccgcccucguaagccugacguguagcaacacgaucuucacccugaccguggcauggcgaacggcgacgcuaauccuggccgggaucucccugcuccccgugugccagagcuccagcaugcguaagacggacuggcugccuaugaccgucgccgccauggguguuccgccacugccccucuucauuuucucccugaaggacacgcugaagcgccgcagcuggccccucaaugagggggucauggcugugggcuugguguccauccuggcgagcucccuccugcgaaacgauguccccauggccggcccccugguggccggcggccuccucaucgccugcuacguuauuaccgggaccagcgccgaccugacagucgagaaggcggccgacgugacgugggaggaggaggcggagcaaaccggcgugucccauaaccugaugaucaccguggacgacgacggaaccaugcguaucaaggacgacgagaccgagaacauccucaccgugcugcucaagaccgcacugcugaucgugucaggcaucuucccuuacuccaucccggccacucuccugguauggcacacguggcaaaagcagacgcagagaagcggcguucugugggacguacccuccccgccggagacccagaaagcggagcucgaggagggagucuaccgcaucaagcagcagggcauauucggaaagacgcagguaggcgugggcguccagaaggagggcgucuuccacaccauguggcacgugacucggggcgccguccuuaccuacaacggcaagcgccuagagccuaacugggccagcgugaagaaggaucucaucuccuacgggggggguuggcggcugagcgcccaguggcaaaagggggaggaggugcaggucaucgcgguagagcccgguaagaaccccaagaacuuccagaccaugcccgguaucuuccagaccacgaccggggagaucggcgcgauugcccuggauuucaagccgggaaccucgggcucacccaucaucaaccgcgaaggcaagguggucgggcucuacggcaacgggguggugacaaagaacggcggguacgugagcggcaucgcccagacgaacgccgagcccgacggacccacccccgagcucgaggaggagauguucaagaagcguaaccugacuaucauggaccugcaccccgggucaggcaagacccgcaaguaucuccccgcgaucgugcgggaggccauuaagcgccggcugcgcacguuaauccucgccccgacccggguggucgccgccgagauggaggaggcacugaaggggcugccgauccgcuaccagaccacugccacaaaaagcgagcacacuggcaaggaaaucguggaccucaugugccacgccaccuucacaaugcggcugcugucccccgugcgcguccccaacuacaaccucaucaucauggacgaggcccacuucacugacccggcgagcauagcggcccggggguacaucucgacccgcguggguaugggcgaggcggccgcgaucuucaugaccgccacgccgcccgggacggccgacgccuucccccagagcaacgccccgauccaggaugaagaacgagauauccccgagcgcuccuggaacagcggaaacgacuggaucaccgacuucgcggggaagaccgugugguucgucccuuccaucaaggccgguaacgacaucgccaacugccugcguaagaacgggaagaaggugauccagcugucacggaagaccuucgauacggaguaucaaaagaccaagcucaacgacugggauuucguggucacgaccgacaucuccgagaugggcgccaacuucaaggccgaccgugugauagaucccagacgcugccugaagccgguaauccuaacggacggacccgagcgggucauucucgcggggcccaugcccgugaccguggcgagcgccgcccagagacggggccgcgucgggcggaacccgcagaaggagaaugaccaguauaucuucaccggccagccccugaacaacgaugaggaccacgcccacuggaccgaggcgaagaugcugcucgauaauaucaacacuccggaggggaucauccccgcccuauucgagccggagagagaaaaguccgcagccaucgacggcgaguaccggcuuaaaggcgagagcaggaagaccuucguggagcucaugcggcgcggggaucugcccguguggcuggcgcacaaggucgccucagagggcaucaaguacaccgaccggaaguggugcuucgacggggagcgcaauaaucagauccucgaggagaacauggacguggagauuuggaccaaggagggcgagaagaagaaacugcgaccccgcuggcuggacgcccggaccuacagcgauccccuggcccuaaaggaauucaaggacuucgcugcgggucgcaaguccaucgcucuagacuuggucacagaaaucgggcgcgugccgagccaccucgcccacaggacucguaacgcccuggacaaccucgugaugcugcauaccucugagcacggcgggcgggccuaccgccacgcggucgaggagcugccggaaacaauggagacgcuccugcugcucggacugaugauucugcucaccgggggcgccaugcuguucuuaaucagcggcaaagggguggggaagaccagcauugggcucaucugcguggucgccuccucagguaugcuguggauggccgacaucccacugcaguggauagccuccgcgaucgugcuagaguucuucaugauggugcugcuaaucccggagccugaaaagcagcggacgccccaggacaaccagcucgccuacgucgugaucgggauccugacgcuggccgccauaguugccgcgaacgaaaugggccuccuggagaccacaaagcgcgaccugggcaugagcaaggagcccgggguugucucccccaccaguuaccuggacguggaccugcaccccgccuccgcguggacgcucuacgccgucgcuaccaccgugaucacgcccaugcuccggcacacgaucgagaacucaaccgcgaacgucucccuggccgcgaucgcuaaccaggcggucgugcugaugggucuagauaagggguggcccaucagcaagauggaccugggcgugccacuccucgcccuggggugcuacucccaggucaacccccugaccuugacggccgccgugcugcugcucgugacccacuaugccaucaucggcccaggcuuacaggcgaaggccacgcgugaggcccagaagcgaaccgccgccgggaucaugaagaaccccacaguagacggaaucaugacgaucgacuuggacccugucaucuacgacagcaaguuugagaagcaacuagggcaggucaugcuacugguccuuugcgccgugcagcugcugcucaugcguaccuccugggccuucugcgaggcccugacccuggccaccggccccauaacgacccuuugggagggcagucccgggaaguucuggaacacgaccaucgcgguuuccauggcuaauaucuuccggggcagcuaccuugccggggccggccuggccuucuccaucaugaagucggucgggacgggcaagcgcggcaccggaagccagggugagacccucggggagaaguggaagaaacgccugaaccagcugucccgcaaggaguucgaccucuacaagaaguccggcaucaccgaaguggaccggacggaggcgaaggaggggcugaagcgcggcgaaaucacacaucacgcggugucuaggggcagcgccaagcugcagugguucguagaacgcaacaugguuauccccgaggggcgggugauagaccucggcugcgggcgcggcgggugguccuacuacugugccggacugaaaaaggucaccgaggugcggggauauaccaagggcgggccggggcacgaggaacccguccccaugagcaccuacggcuggaacaucgucaagcugauguccgggaaggacguguucuacuuaccgccggagaagugcgacacucugcugugcgacaucggcgagaguucccccucaccaaccguggaagagucgcgcaccauccgcguuuugaagaugguggagcccuggcucaagaacaaccaauucugcaucaaggugcuuaaucccuacaugcccaccgucaucgagcacuuggagcgucuccagagaaagcauggcggaaugcugguccguaacccccuuucacgcaauucuacgcacgaaauguacuggaucucgaacggcaccgggaacauuguguccagcguuaacaugguguccagacuccugcugaaccgcuucacaaugaccuaccggcggcccacgaucgaaaaggacguggaccucggcgccggcacccggcacgucaacgcggagccggagacacccaacauggacgugaucggggagcgcauccggcgcaucaaggaggagcacagcucaaccuggcacuacgacgacgaaaaccccuacaagaccugggccuaccacgggucuuacgaagucaaagccaccggguccgccucgagcaugauaaacggcguggugaagcugcugaccaagccgugggaugucguccccaccgugacccaaauggccaugaccgacaccacccccuucgggcaacagcgggucuucaaggagaagguggacacccgcacacccaaaccgaugcccggcacucggaaagugauggagaucaccgcgggguggcucuggaggacgcuggggcggaauaagcgaccccggcugugcacccgcgaggaguucacaaagaagguccggaccaacgcugccaugggcgccguauucacggaggagaaccagugggacuccgcgcgggccgccgucgaggacgaggaauucuggaaacucgucgaccgcgagcgcgagcuucauaagcaggggaagugcggcagcugcguguacaacaugauggggaagcgcgagaagaagcugggagaguuuggcaaggcgaaggggucacgcgcgaucugguacauguggcugggcgcgcgauaccuggaguucgaagcccugggguuccugaacgaggaccacugguucagcagggagaacuccuacagcgggguagagggggagggccuucacaaguuaggcuacauacuccgcgauaucuccaagauccccgggggcgccauguacgccgacgacaccgccgggugggacaccagaaucacugaggacgaccugcacaacgaggagaaaaucacgcagcaaauggacccggaacaccgccagcuggcgaacgccaucuucaaacucaccuaccagaacaaaguggugaaggugcagcggccuaccccuaaagggaccgucauggauaucauaucgcgcaaggaccagaggggcagcggccagguggguacguacggguuaaacaccuucaccaauauggaggcccagcucauccgccagauggagggggagggggugcucucuaagaccgaccuggagaauccccaccuucucgagaagaagaucacccaguggcuggagacuaagggcguggagcggcugaagcgcauggccaucuccggcgaugacugcguggugaagccuaucgacgaccgguucgccaacgcgcuccuggcccugaaugacauggggaagguccgaaaggacauaccccaguggcaacccagcaagggcuggcacgauuggcagcaaguucccuucugcucacaccacuuccacgagcucaucaugaaggacgggcggaagcugguggucccuugccgcccccaggaugagcugaucggccgggcccgcaucagucagggggccggcuggucccucaaggagaccgccugccucgggaaagccuaugcacagaugugggcccugauguacuuucaccgccgugaucuccgccuugccagcaacgcgaucugcuccgccgugcccgugcacuggguccccacaagccguaccacgugguccauccaugcucaucaccaguggaugaccaccgaagacaugcugaccguguggaaccggguguggauugaagacaacccguggauggaggauaagacgccugucaccaccugggaggacgugcccuaccucgggaagagggaggaccagugguguggcagccugaucgggcugacuagccgcgccacgugggcccaaaacauccucacugcuauacagcagguccgaucccugaucggcaacgaggaguuccuggacuacaugcccagcaugaagcgguuccggaaggaggaggaguccgaaggggccaucugguga

SEQ ID NO: 26196 - RNA, 9873 nt, Artificial Sequence
  derived and/or modified CDS sequence (opt11) from DENV-3__AY858046__SS-prME
accagccugugccugaugaugaugcugcccgccacccuugccuuccaccucaccagucgcgacggugagccgaggaugaucguggggaagaaugagaggggcaagagccugcucuucaagacggcauccgguaucaacauguguacccucaucgccauggaccugggcgagaugugcgacgacacgaucaccuacaagugcccuuugaucaccgagguggagcccgaggacaucgacugcuggugcaaccucaccaguaccugggugacauacgguaccugcaaccaggugggcgagcaccggcgugacaaacggucggucgcccuagcaccccacguaggcauggggcucgacacccgcgcucagaccuggaugagcgccgagggcgccuggcgucaggucgagaaggucgagacuugggccuuccgccaccccggguucacuauccucgcccuguucuuggcgcacuacaucggcaccucccucacccagaagguggugaucuucauccuguuaaugcucgucacucccagcaugaccaugaggugcgugggggugggcaaccgcgacuucgucgagggccuauccggcgcgacguggguggacguaguccuggagcacggcgggugcgugaccacgauggccaaaaacaagcccacccucgacaucgagcugcaaaagaccgaggccacccaacuugccacccuccggaagcugugcaucgagggcaagaucaccaacgugacaaccgacagccgcugcccaacgcaaggcgaggcuaucuugccagaagaacaggaccagaacuaugucuguaagcacaccuauguagaccggggcuggggcaacggguguggccucuucgggaagggcagucugguaaccugcgccaaauuccagugccuggagcucauagaggggaaggucgugcagcacgaaaaccuuaaauacaccgugauuaucacagugcacaccggggaccagcaucaggugggcaacgagacgcaagggguaaccgccgagaucacgccccaggccagcaccguggaggccauccugcccgaguacgguacccuaggacuggagugcucacccaggacaggccuggacuucaaugagaugauccuccugaccaugaagaacaaagcguggauggugcacaggcagugguucuuugaccugccgcuccccuggacgucgggagccaccaccgagacaccgacguggaacaagaaggagcugcuggucaccuucaaaaacgcucaugcaaagaagcaagagguggugguccucgggucccaggagggagccaugcacaccgcguugaccggggccacggagauccagaccucgggcgggaccuccaucuucgccggccacuugaagugccgccuuaagauggacaagcuggagcugaaggggaugagcuaugccaugugcuccaacgccuucgugcucaagaaggaagugagcgagacccaacacggcacgauccugauaaaggucgaguacaagggcgaggacgcgcccugcaagaucccauucagcaccgaggacggacaaggcaaggcccauaacggucggcugaucaccgccaaccccgugguuaccaagaaagaggagccugucaacauugaggcggaacccccguucggggaguccaacaucaucaucggcaucggggacaaggcacugaagauaaacugguacaagaagggcagcuccaucgggaagauguucgaagccacggcccgaggcgcacggcgcauggcaauuuugggcgacacagcgugggauuuuggcagcgugggcggggugcugaacuccuuaggcaagaugguccaccagaucuuugggagcgccuacaccgcccucuuuuccggcgugagcuggaucaugaagauugguaucggggugcugcuaaccuggaucggccucaacucuaagaacacgagcauguccuuuucgugcaucgucauugggaucauaacucuguaccugggggccguggugcaagccgacauggggugcguaauuaacuggaagggaaaggagcucaaguguggcuccggaaucuucgugaccaacgaaguucacaccuggacggagcaguacaaguuccaagcggacagccccaaacggcuagccacagcuaucgcgggcgccugggagaacgggguaugcggcauacgcagcaccacccgcauggagaaucuucucuggaagcagaucgcaaacgagcugaacuacaucuugugggaaaauaacauuaagcucacgguuguggucggggacaucaucggcguucuggagcagggcaagcggaccuuaacgccacaacccauggagcucaaguacucuuggaagaccugggggaaggcuaagaucgugacugccgagauccagaauuccucguucaucaucgacggccccaauacccccgaaugucccaacgccagccgcgcguggaacgucugggagguggaggacuacggguucgguguguucaccaccaacauauggcuuaaguuacgggaaauguacacgcaguuaugcgaucaccgguuaaugagcgccgccgucaaggacgagcgggccgugcaugccgacauggguuacuggauagaaagccagaagaacggguccuggaagcuggagaaggcgagcuuaauagaggugaagaccugcaccuggcccaagucccacacccuguggagcaacggcguccuggaaagcgacaugauuauccccaagucccucgccggucccauuucacagcacaacuaccgccccggguaccacacccagaccgcagguccguggcaccugggcaagcuggaguuggacuucaacuacugcgagggaaccaccguggugaucaccgagaacugcggcacccgaggcccgagucuucgcaccacaaccgucuccggcaagcugauccacgaguggugcugccggagcugcacccugccgccccuccgcuacaugggcgaggacgguugcugguacgggauggaaaucagaccgauaaacgaaaaggaggaaaacauggugaagucccuggugagcgcagguagcggaaagguugacaauuucaccaugggcgugcucugucucgccauccuguucgaggaggugaugcgcgggaaguucgggaaaaagcacaugaucgcggggguccuguuuauguucguguuacugcucagcggccagaucaccuggcgggauauggcccgcaccuugaucaugaucggcaguaacgccagcgaccggauggggaugggaguaacauaccucgcccucaucgccaccuucaagauccagcccuuccuggcgcugggguucuuuuugcgcaagcuuaccucccgagaaaaccuguugcugggcguaggucuggccauggcaaccacgcuccagcugcccgaggacaucgagcagauggcaaacgggaucgcccugggccucauggcccugaagcugaucacgcaguucgagaccuaccaacucuggacugccuuagugucgcugacgugcagcaacaccaucuucacccugacgguggccuggcggacggcuacccugauccuggccgggaucucccuccugcccgucugucagagcuccagcaugcggaaaaccgacuggcugccgaugaccguggccgccaugggcgucccgccucuuccacuguucauuuucucccugaaggacacgcucaagcgccgcagcuggccguuaaacgaaggggugauggccguaggccuggugucuauccucgccagcagucuguugcgcaacgacgugccgauggcaggcccccuuguggccgggggucugcugaucgcgugcuacgucauuacggggacgucagccgaucucaccgucgagaaagcugcggacgugacgugggaggaggaggcggagcagaccggcguuagccacaaccugaugaucaccguggacgaugacgggacaaugcguaucaaggacgacgaaacagagaacauccugaccgugcuccugaagaccgcccuacucaucguuagcggcauuuucccuuacucuauaccggcgacgcuguugguguggcacacauggcaaaagcagacacaacggaguggcgugcuuugggauguuccuagcccucccgagacccaaaaggcagaguuagaggagggcguuuacaggaucaagcaacagggcauuuucgggaagacacagguaggcgucgguguucagaaggaggggguguuccacaccauguggcacgucacuaggggugccgugcucaccuacaacgggaagcgccucgaaccuaacugggccagcguuaagaaggaucugaucucguacggcgguggauggcguuugagcgcccaguggcagaagggggaagagguccagguuaucgccguggagcccggcaagaacccuaagaacuuucagaccaugcccggcaucuuucaaaccacgaccggggagauuggcgcuauagcccuggacuuuaagccggggaccaguggcagccccaucaucaaccgcgagggcaaggucgugggucuauacgggaaugggguggucaccaaaaacggcggguacguaucuggcauugcccagacgaacgccgagcccgauggcccgacacccgagcuggaggaggagauguucaagaaacggaacuuaaccaucauggauuuacaccccgggucggggaagacacgcaaguaccugccagccaucgugagagaagcgaucaaacgccggcugcgcacgcucauccuggccccuacccggguaguggccgccgagauggaggaagcacugaagggguuaccaauacgcuaccagaccacagcgacaaagagcgagcacaccggcaaggagaucguggaccugaugugccacgccaccuucacgaugcggcugcucucaccuguccgcgugcccaauuacaaccugauaauaauggacgaggcgcacuuuacggacccggcgagcauagccgcgcgggguuacauauccacgcgcgugggcaugggagaagccgcugccauauucaugacagcgacgccgcccggaacggccgacgcuuucccccagagcaacgccccgauucaggacgaggagagggacauccccgagcgcuccuggaacagcggcaacgacuggaucaccgacuuugccgggaaaaccgucugguucgugcccaguaucaaagcaggcaacgacaucgcaaacugccugcgcaagaacgggaagaaagugauccagcucucgcggaaaacauucgauacggaguaccagaagacuaagcugaacgacugggacuucgucgugacgaccgacaucucagagaugggcgccaacuucaaggcggaccgggugaucgauccccggcgcugccugaagccuguaauucucacagacggcccagaacgggugauccuggccgguccaaugcccgucaccgucgcauccgccgcgcagcgccggggccgcguggggcgaaacccgcaaaaggagaacgaccaguacaucuucaccggacaaccccucaauaacgacgaggaucacgcccacuggaccgaggccaaaaugcugcuugacaacaucaacacccccgagggaauuauccccgcacuguucgagccagagcgcgagaaguccgccgccauugacggcgaguaccgguugaagggcgagaguagaaagaccuucguagagcugaugcggcgcggggaccugcccgucuggcucgcccacaagguggccuccgagggcaucaaauacaccgaccggaagugguguuucgauggggagcgcaacaaccaaauccuggaagagaacauggacguagagaucuggaccaaagagggcgaaaagaagaagcuccggccgcgcuggcuagaugcccggacguauagugauccccuggcucuuaaggaguucaaggacuucgccgccggacgcaaguccauagcgcucgaucuggugacggagaucgggcgcguuccuagucacuuagcccaccguacccgcaaugcacucgacaacuuggucaugcuacacaccuccgagcacggggggcgagccuauagacaugccguggaggagcucccagagacaauggagacacugcugcuccucggccuuaugauccuauugaccgggggcgccaugcuguuucucaucagcggcaaggguguggggaagaccagcaucgggcugaucugcgucguggccuccagcggcauguuauggauggccgacauccccuuacaguggaucgcguccgccaucgugcuggaauucuuuaugaugguccucuuaaucccggagcccgaaaagcagcggacgccccaggacaaccagcuggcguauguggugauagguauacuaacgcucgccgccauugucgccgccaacgagaugggaaugcuggagaccacaaaacgagaccugggcaugucgaaggagcccgggguuguguccccgaccagcuaccucgacguagaucuacacccugcguccgcuuggacgcuguacgccguggccaccaccgucaucacccccaugcuccggcacaccaucgagaauagcacagcgaaugucucccucgccgccauugccaaccaagccguugugcugaugggccucgacaagggguggcccaucagcaagauggaccugggcguaccucuguuggcgcugggcugcuacucccaggugaacccccugaccuugaccgccgcugucuuacugcucgucacccacuacgccaucauuggccccggucugcaggccaaggcgacacgcgaagcccagaagcggaccgccgccgggaucaugaagaaccccaccguggacgguauaaugacgauagaccuggacccggugauauacgacuccaaauucgagaaacagcucgggcaagucaugcuccuggugcucugcgccgugcagcuccugcucaugcgcaccuccugggcguuuugugaggcccugacccuggccacgggccccaucaccacacuaugggagggcucgccagggaaguucuggaacaccaccaucgcugucuccauggcgaacaucuuccggggcucuuaccucgccggggccggccuugccuucuccaucaugaaguccguggguacgggcaagcgaggcacugggucccagggcgaaacccucggagagaaguggaagaagaaguugaaccagcugagccggaaagaguucgaccucuacaagaaguccgggaucaccgaaguggaccgcacggaggcuaaggagggacugcggcggggcgaaauuacccaccacgcggucagccguggcagcgcaaaguuacagugguuuguggaacgcaacauggugauccccgagggucgggucaucgaccucggcugcgggcgcggcgggugguccuacuacugcgccggccugaaaaaggucacggaggugcgagguuacacuaagggaggaccugggcaugaagaacccguccccaugagcacauacggcuggaauauagugaagcugauguccgggaaggauguguucuaccucccgccggaaaagugugacacguuguuaugcgacaucggcgagucuucccccagcccgaccgucgaggagucucgcaccauccgcgugcugaagaugguugagcccuggcucaaaaauaaucaguucugcaucaagguccugaaccccuacaugcccaccgugauagagcaucuggagcggcuccaacgaaagcacggcgggauguuggugcggaacccccucagccggaacuccacgcacgagauguacuggaucagcaacggcacugggaacaucgucucuagcgugaacauggugucccggcuccugcugaacagguucaccaugaccuaccggcgcccuacgaucgaaaaggauguugacuuaggcgccggcaccaggcacgugaacgccgagccggaaaccccuaacauggacgucaucggugagcgcauccggcgcaucaaagaagagcacagcuccacauggcacuacgacgacgagaauccauacaagacgugggcguaucaugggagcuaugaggugaaggccaccggguccgcuucgucuaugaucaauggcguagucaagcugcuuaccaagccgugggacguggugcccaccgucacgcagauggccaugaccgauacuacccccuuugggcagcagcggguguuuaaggaaaagguggacacgcguaccccaaagccgaugccggguacucggaaggccauggagaucacagcaggauggcucuggcgaacgcugggccggaacaaaaggccccggcugugcacccgcgaagaguucaccaagaaggucagaaccaacgccgccaugggggcaguguucacagaggagaaucagugggacuccgcgcgcgccgcgguggaggacgaggaguuuuggaaacugguugauagggagcgggagcuacacaagcaggggaaauguggcagcuguguguacaauaugauggggaagcgcgaaaagaagcugggagaguucggcaaggccaaggguuccagagccaucugguacauguggcucggcgcgcgauaucuugaauuugaggcccuagguuuccucaacgaggaccacugguucagccgugagaacuccuauucuggcguugagggggagggccugcauaaacugggcuacauccuccgcgacaucucuaaaaucccaggcggcgccauguacgccgacgacaccgccgggugggacacccggauaaccgaggaugaccugcacaacgaggagaagaucacgcagcagauggacccggagcauagacagcuggcgaaugccaucuucaagcucaccuaccagaacaaggucgucaaggugcagaggccuacccccaagggaacggucauggacaucauaucccgcaaggaccagcgggguuccggccaggugggcacguacgggcucaacaccuucaccaacauggaagugcagcugauccgccagauggagggcgaagggguacucagcaagaccgaccucgagaacccccauuugcucgagaagaaaaucacccaauggcuggagacgaaggggguggagcggcuaaagcggauggccaucuccggugacgauugcguggucaagccgaucgacgauagauucgccaaugcccucuuggcacugaaugacauggggaaagugaggaaggauauaccccaauggcagcccagcaagggcuggcacgacuggcagcaggucccauucuguucccaccacuuccacgagcucaucaugaaggacgggcggaagcuagucguucccugucggccgcaggacgagcuuaucggcagggcccgcaucagccagggagccggguggagccuaaaagagaccgccugccugggcaaggccuacgcgcaaaugugggcuuuaauguacuuucaucgccgggaucuccgccuggccucaaacgccaucugcuccgcggugccugugcacugggucccuacgagucggaccacgugguccauacacgcgcaucaccaguggaugaccaccgaggauaugcugacgguguggaaccgcgucuggaucgaggacaacccguggauggaggacaagaccccagugaccacaugggaggaugugcccuaucucgguaaacgcgaggaucaguggugcggcagccugaucgggcugaccucucgcgccacgugggcccagaacauucucacugccauccagcagguccguucccugaucgguaacgaggaguuccuggacuacaugcccagcaugaaacgcuuccggaaggaggaggagagugagggggcgaucugguga

SEQ ID NO: 26197 - RNA, 9873 nt, Artificial Sequence
  derived and/or modified CDS sequence (opt11) from DENV-3__AY858047__SS-prME
accagccugugccucaugaugaugcugcccgccacccuggccuuucaccuuacgucccgcgauggcgagccccggaugaucgucgggaagaaugaacgcggcaaguccuugcuguucaaaacugcgucggggauuaacaugugcacccucauugccauggaccucggcgagaugugugacgacaccgucaccuacaagugcccucugaucaccgagguggagccugaggauaucgacugcuggugcaaccucacuagcacuugggugacguacgggaccugcaaccaggccggcgagcaucggcgggacaagcgguccguagcgcuggcgccccacguggggauggggcuggacacccgcgcgcagacauggaugagcgcagagggcgccuggcggcaggucgagaagguggagacgugggccuuucgccaccccggauucaccauccucgcgcuguuccuggcccacuacaucggcacaucccuaacccagaaaguggugaucuuuauccugcucaugcuugucacgcccagcaugaccaugcggugcgugggcgugggcaauagggacuuugucgagggccuguccggggcuaccuggguggacgugguccuggagcacggcgggugugugaccaccauggcaaagaacaagcccacccucgacaucgaacugcagaagaccgaggcaacccagcuggccacccuccgcaagcuuuguaucgagggcaaaaucaccaaugugacuaccgacagccgcugcccgacacagggcgaggccauucugcccgaagagcaggaccagaacuacgucugcaagcacaccuacguggaucggggguggggcaacgggugcggccucuucgggaaaggcucccuagugaccugcgccaaguuccaguguuuagagcucaucgaaggcaaagucgugcagcacgagaaccuuaaguacaccgugauuauuacgguucacaccggggaccagcaucaggugggcaacgagacgcagggugucacugccgagaucacgccccaggcgagcaccguugaggcgauauugccggaguacggaacguuagggcuggaguguagcccccgcaccggccuggacuucaacgaaaugauccuccugaccaugaagaacaaggccuggauggugcaccggcaaugguucuucgaccugccgcuccccuggacgagcggggccaccacugagaccccaaccuggaacaagaaggagcugcuggugaccuucaagaacgcgcacgccaagaagcaagagguggugguucucgggucccaggagggcgccaugcauaccgcccugaccggggccacggaaauacagaccagcggcgggaccuccauauuugccggccaccugaagugccgccucaagauggacaaauuagagcugaagggcaugucauacgccaugugcuccaacgcguucgugcucaaaaaagaggugagcgagacccagcacggcacgauccuaaucaaggucgaguacaagggcgaggacgcuccguguaagauaccuuucagcaccgaggacgggcagggaaaggcccacaacggacggcugaucacagccaaccccguugugaccaagaaggaagaaccaguaaacaucgaagccgagcccccguuuggggagucuaacaucaucaucggcaucggggauaaggcccugaagaucaacugguauaagaagggcagcuccauagggaagauguucgaggccacggcccgcggugcgcggcgcauggcgauacucggcgacacagccugggacuucgggagcgugggcggggugcugaacucccugggcaagaugguccaucagauuuucgggagcgccuacacggcccucuucuccggaguuagcuggaucaugaaaauuggcauugggguccuccugacguggaucggccucaauagcaaaaacacgagcauguccuucagcugcauugucaucgggaucaucacccuguacuugggugccguaguacaagcggauauggggugugucaucaacuggaagggcaaggagcugaagugcggcagugggaucuucguaaccaaugaggugcacaccuggacggagcaauacaaguuccaggccgacagcccuaagcggcuggcgaccgcaaucgccggggcgugggagaacggggucugcggcauccgcuccaccacccgaauggagaaccugcucuggaagcagaucgccaacgagcugaacuacauccugugggagaacaacaucaaacucacgguaguggugggagacauuaucggcauccuggagcagggcaagcgaacccugacgccccagcccauggaguuaaaguacagcuggaagaccugggggaaggccaagaucgugacggccgagauccagaauucgagcuucauaaucgacggcccgaacacgcccgaguguccaaacgcgucccgcgccuggaacgugugggaggucgaggacuacggguucggcguguucaccaccaacaucuggcugaagcugcgggaaauguacagccagcugugcgaccaccgccugaugagcgccgccgugaaagacgagcgggcaguccacgcggacaugggcuauuggaucgagucccaaaagaacgggagcuggaagcuagagaaagccucccucaucgaggugaagacuugcaccuggcccaagagccacaccuugugguccaacggcguccuggagagcgacaugaucaucccgaagucguuagcggggcccaucagccagcacaacuaccgccccggcuaccacacacagaccgccgggccauggcaccugggcaagcuggagcucgacuucaacuacugcgagggcacgaccgucguuaucacagagaauugcggaacccgaggccccucucugcgcacgaccaccgugagcgggaaacugauccacgaguggugcugucgguccuguacccuaccgccccuacgcuacaugggcgaggacgggugcugguacggcauggagaucaggccgaucaacgagaaggaggagaacauggucaaaagccuggugagugccggcagcgggaagguggacaacuucacuaugggcgucuuaugccuggcuauccuguucgaggagguuaugcgagggaaguucggcaagaagcacaugaucgccgggguccucuucaccuucguccugcuguuauccggccagaucaccuggcgugacauggcccgcacccuaaucaugaucggcagcaaugcauccgaucgcauggggaugggcgugacguaucuggcgcucaucgcgaccuucaagauccagccuuuccuggccuuaggguuuuucuuacgcaagcugacgagccgggagaaccugcucuugggcgucggccuggccauggccaccacgcuccaguugcccgaggacaucgaacagauggccaacgggaucgcccuggggcucauggcccugaagcugauuacccaguucgaaaccuaccagcucuggaccgcccuuguaagccugaugugcuccaauacgaucuucacccucaccguggcauggcggaccgcgacauuaauccuggccgguauuucucuccugccccugugccaguccucauccaugcggaagacggacuggcucccgaugaccguggccgcaaugggcgugccgccccugccccuguucaucuuuagucucaaggacacccugaagcgccgcuccuggccgcugaacgagggcgugauggcagucggucucguguccauacuggcguccagccuccuccggaacgacgugcccauggccggcccccuggucgcagggggccugcucaucgcaugcuacgugaucacggggaccuccgcugaccugaccguggagaaggcggccgaugucacaugggaggaggaagccgagcagacgggcgugagccacaaccucaugaucaccguggacgacgaugggacgaugcgcaucaaggaugacgagaccgagaacauccucacgguccuccugaagaccgcccucuugaucguguccggcaucuucccauacagcauaccggccacccuucucguguggcacaccuggcagaagcggacccagcgauccggcguccugugggacguccccucuccgcccgaaacccagaaggcggaacuggaggagggcguguauaggaucaagcagcagggcauacuugggaagacacaggucggcguggggguccagaaagaaggcgucuuccacaccauguggcacgugaccagaggcgccguucugacguacaacgggaagcggcuggagccgaacugggccuccgucaagaaggaucugaucagcuauggcggcggcuggaggcucuccgcccaauggcagaaaggggaagagguccaggugaucgcggucgagcccggcaagaaccccaaaaacuuccagaccaugcccggcauauuucagacuaccacgggggagaucggcgccaucgcacuggacuucaagccggggacgucaggcagccccaucaucaaccgggagggcaagguuguggggcuguacggcaacggggucgugaccaaaaacggcgguuauguguccggcaucgcccagaccaacgccgagccugacggucccacgcccgagcucgaagaggagauguucaagaagcgcaacuuaaccaucauggaccuacacccagggagcggcaagacccgaaaguaccucccggcgaucguccgggaggccaucaagcgucgacugcggacccugauccucgccccgacgcgggugguggccgccgaaauggaggaggcgcuuaaggggcugcccauccgguaccagaccaccgccaccaaguccgagcacacaggcaaagaaaucguugacuuaaugugccacgccacauucacgaugaggcuacuaucacccgugcgggugccgaacuacaaccucauuaucauggacgaggcccacuucaccgacccggccuccaucgcggcucgcggguauaucagcacgcgggucgguaugggcgaggccgccgcaaucuuuaugaccgccacgccgcccgguacagccgaugccuucccccaauccaacgccccgauccaggacgaggagcgcgauauccccgaacgcagcuggaacucgggcaacgacuggaucacggacuucgcggggaagaccgugugguuugugccgagcauuaaggccggcaacgacaucgccaacugcuuacggaagaauggcaagaaggucauccagcugucccgcaagaccuucgacacggaauaucaaaagacgaaguugaacgacugggacuucguggugaccaccgacauaagugaaaugggcgccaacuucaaggccgaccgggucaucgacccccgccggugccugaagccagugauucugacagauggcccagaacgcgugauacuagcggggcccaugcccgucacgguggccucggccgcccaacggcgcggccguguggggcgaaacccgcagaaggagaacgaccaguauaucuucaccggccagccccugaacaacgacgaggaucacgcccacuggaccgaggcgaagaugcugcucgacaacaucaacacacccgaggggaucaucccagcucuguucgagccggagcgugaaaaguccgccgccaucgacggagaguaccgccugaagggggagucccggaagacguucguagagcucaugcgccgcggggaccuccccguauggcuagcgcacaagguggcaagugagggcaucaaguacacagaccgcaaguggugcuuugacggggagagaaauaaccagauccucgaggagaacauggacgucgagaucuggacaaaggagggcgagaagaagaagcugcgcccccgguggcuggacgcccguacauacuccgacccccucgcuuugaaggaauuuaaggacuuugccgcgggccguaagucuaucgcccuggaucucgugaccgagaucgggcggguccccucccaccuggcccacagaacgcgaaacgcacuggacaaccucgugaugcugcauaccagcgagcauggcgggcgcgccuaccgucacgcgguggaggagcugcccgagaccauggagacccucuuacuccucggccugaugauccugcucacgggcggggucaugcuguuccugauaucagggaagggggucgguaagacauccaucgggcucaucugugugguugcuagcuccggcaugcuguggauggcagacaucccccugcaguggauagccagugccaucgugcuugaguucuucaugauggugcuccugaucccggagccagagaaacagagaacgccucaggacaaccagcucgcguaugucguaaucgggauccugacccuggccgcaaucguugcggccaacgagaugggccuccuggagacgaccaagcgggaccugggcaugucuaaggagcccggggucgcgagcccgaccucauaccucgacguugaccugcaccccgccagcgccuggacccuguacgccguugcgacgaccgucaucaccccuaugcuccgccauaccaucgagaauagcacggcgaacguaagucuggccgcuaucgccaaccaggcggugguccuuauggggcucgauaagggguggccuaucucaaagauggaccugggcgugccgcugcucgcccuagggugcuacagccaggugaacccccugacacucaccgcugccguccugcuucucgugacccauuacgcuaucaucggccccggccugcaggcgaaggcaacucgggaggcccagaagcgcacagcggccgggaucaugaagaaucccaccguggacggcaucaugaccaucgaccuggauccggucaucuacgacuccaaguucgagaagcagcuuggccaggugauguugcuggugcucugcgcgguucagcugcugcucaugaggacgaguugggccuucugcgaggcccugacccucgccaccgguccgaucaccacgcuuugggaaggcucucccgggaaguucuggaacaccaccaucgcggugagcauggccaacaucuuccgcggcuccuaccuggccggggccggccuggccuucagcaucaugaagucaguggggacgggaaagcgggggacggggagccagggcgagacccucggggagaaguggaagaagaagcugaaccaacuaagccgcaaggaguucgaccuuuacaagaagucaggcaucaccgagguggaccgaaccgaggcgaaggaggggcugaagcgcggagagaucacgcaccacgccgugagcagaggcuccgccaagcugcagugguucguugagcgcaauauggucauccccgaggggagagugaucgaccucggcugcggucgcggugggugguccuacuauugcgccggccugaagaagguaacggaggugcgaggcuacacgaagggcggaccggggcaugaggaacccgugcccauguccacauacggcuggaauaucgugaaauuaaugagcgggaaggacgucuucuaucugcccccggagaaaugcgacacgcuucuuugugauaucggcgaguccagccccuccccgacggucgaagagagccgcaccauccgcguucugaaaauggucgagccguggcucaagaacaaccaguucugcaucaaagugcugaacccguacaugccagccgugaucgagcaccuggagcggcugcagcgcaagcacgggggaaugcugguccgaaacccucugucccgcaauagcacucacgagauguacuggaucuccaacggcaccgggaacaucguuucauccgugaacauggucagccggcuccugcugaacagguucacaaugaccuaccggcgcccgaccauagagaaagacguggaccucggcgcgggcacccggcacgugaacgccgagccagagacgccuaauauggacgucauaggugagcgcauccggcgcaucaaggaggagcacuccagcaccuggcacuacgaugacgaaaaccccuacaagaccugggccuaucacggcuccuacgaggugaaggcgaccgguagcgcuagcuccaugaucaacggcgucguaaagcugcugacgaaaccgugggacgugguccccaccgugacccaaauggcgaugacugacacgacccccuucgggcaacagcggguguucaaagagaaggucgacacacgcacccccaagccgaugcccggcacccggaagguuauggagaucacugcugaguggcuguggcgcacccuaggccguaacaagcgcccccgguugugcacccgcgaggaguucacgaagaagguucgcaccaacgccgcgaugggggcugucuuuaccgaagaaaaccagugggacagcgcaaaggccgccguggaggaugaggaguuuuggaagcucguugaucgggagcgcgagcugcauaagcuuggcaaauguggguccugcguuuauaacaugaugggcaaacgggaaaagaagcucggggaguucgggaaggcgaagggaagccgcgcgaucugguacauguggcugggggcgcgguaccuggaguucgaggcacucggcuuccugaacgaggaccacugguucucccgcgagaacagcuacagcgggguggagggcgaggggcugcacaagcucggcuacauacugcgggacaucagcaagaucccaggcggugcaauguacgccgaugacaccgcuggcugggacacgcggaucacugaggacgacuugcauaacgaggagaagauuacccagcagauggacccggagcacagacagcucgccaacgccaucuuuaagcugaccuaccaaaacaagguggucaaggugcagcgccccacgcccaaggggaccguuauggacaucaucucccggaaggaccagcggggcaguggccaggucggcaccuacggccugaacaccuucacgaacauggaagcucaguuaauccggcagauggagggggagggcgugcuauccaagaccgaccuggagaauccccaccuccuggagaaaaagaucacgcaauggcuagagaccaaggggguugagagacucaagcgaauggccauaucaggugacgauugcgucgugaagccgaucgacgaccguuucgcuaacgcccugcuggcucugaacgacaugggcaagguucggaaggacauuccccaguggcagcccuccaaaggguggcacgacuggcagcaaguucccuucugcagucaccauuuucacgagcugaucaugaaggacggccgaaagcugguggugccuugucggccgcaggacgagcucaucgggcgcgcccggauuucccagggcgcuggauggagccugaaggaaacagcgugccugggcaaggcauacgcccaaaugugggcuuuaauguacuuccaccgccgggaccugcggcuggcguccaacgccaucugcagcgccguccccguacacugggugccaacaucccgcacaaccuggagcauccacgcccaccaccaguggaugacgacggaggacaugcucaucgucuggaaucggguguggaucgaggacaacccguggauggaggacaagacccccgugaccaccugggaggauguccccuaccuggguaagcgugaggaccaguggugugggagccugaucggccucacgucccgcgccacaugggcgcagaacauccugaccgccauccagcaggucaggucucugaucgggaacgaggaguuccucgacuauaugcccuccaugaagcguuuccgcaaggaggaggagucagagggcgccaucugguga

SEQ ID NO: 26198 - RNA, 9873 nt, Artificial Sequence
  derived and/or modified CDS sequence (opt11) from DENV-3__HQ332170__SS-prME
accagccugugcuugaugaugauccugcccgcagcccuagcguuucaucucacgagccgagauggagagccgagaaugauuguggggaagaacgagagagggaagucccugcuguucaagacugcauccgggauuaauaugugcacccucauagccauggacuugggugagaugugugacgacaccgugaccuacaagugcccccacaucaccgagguggagcccgaagacaucgauugcuggugcaaccugaccagcacuugggugaccuaugggaccugcaaccaggccggagagcaccggcgcgacaagcggagcguggcccucgcgccccacguggguauggggcuggacacccgcacccagaccuggaugagcgccgagggcgccuggcgccaagucgagaagguugagacgugggcgcugcgacacccgggguucacaauccucgcgcuguuccucgcccauuacaucggcacguccuugacccagaaggugguuaucuucauucuauuaauguuggucacgcccucuaugaccaugcguugcgugggggugggcaaccgagacuucgucgagggccuguccggggccaccuggguugacgugguccuggagcacgguggcugcguuaccacaauggccaaaaacaagcccacccuugacaucgagcugcagaagaccgaagccacgcaacuggcgacgcuccggaaguuauguaucgaaggcaagaucacuaacaucaccaccgacagccgcugccccacccaaggcgaagcaguacuaccggaggagcaggaucagaacuacgucugcaagcacaccuacguggaccggggguggggcaacggauguggccucuucgggaagggcucccuggucacuugcgccaaguuucagugccuggagcccaucgagggcaaggugguucaguacgaaaaccucaaguacacuguuaucaucacgguccacacaggagaccaacaccaggucggcaacgagacccaaggggugaccgcugaaaucacgccccaggcuagcaccaccgaggcgauccugcccgaguauggcacgcuggguuuagagugcuccccgcgcacuggccuggacuucaacgagaugauccuacucacgaugaagaacaaggccuggaugguucaucggcagugguuuuucgaucugcccuuacccuggaccucaggcgccaccaccgagacgccuaccuggaaccgcaaagaguugcugguuaccuuuaagaacgcccacgcaaagaaacaagaaguggugguauuaggcucacaggagggcgcgaugcauacagcccucacgggggccaccgaaauacagaacagcggcggcaccuccaucuucgccggacaccugaaaugccggcugaagauggauaagcucgagcugaaagguaugagcuacgccaugugcaccaauaccuucgucuuaaagaaggaagugucugagacgcagcaugguacuauccuuaucaagguggacuacaagggcgaggauguaccaugcaagauacccuucagcaccgaggacgggcaaggcaaagcgcacaacggccggcugaucaccgccaacccaguggugaccaagaaggaggagcccguaaacauagaagcagagccgcccuucggugaaagcaauauaguuaucggcaucggggacaacgcccugaagaucaacugguacaagaagggcuccucuaucgggaagauguuugaggcaaccgcacggggagcccgccggauggccaucuugggagacaccgccugggacuucggguccgugggcgggguccugaacagccuuggcaaaauggugcaccagaucuuuggguccgcguacacagcccuguucaguggaguauccuggguuaugaagaucggcaucgggguguugcugaccuggauaggccugaacucuaagaacaccaguaugagcuucucaugcauagccauagggauuaucacucucuacuuaggcgcugugguccaagccgacacggggugcgugaucaacuggaagggcaaagagcuuaagugcgggagcggaaucuucgugacuaacgagguccacaccuggacggagcaguacaaguuccaggcugauagccccaaacggcucgcaacggccaucgccggcgccugggagaacggggucugcggaauaaggaguaccacccggauggagaaccuacuguggaagcaaaucgcgaaugagcucaacuauauucugugggagaacaacaucaagcugacgguggucgugggcgacaucauaggcgugcucgagcagggaaagcgcacgcugaccccccagccgauggagcucaaguauucuuggaagaccugggggaaggccaagaucgucaccgcggagacgcagaauagcucuuuuaucaucgauggccccaauacgcccgagugccccagcgccucccgggcguggaacguuugggagguggaggacuacggauucggggucuucaccaccaacaucuggcuuaagcugcgcgaggucuauacccagcagugcgaccaccgccucaugagcgccgcuguuaaggacgaacgcgccguccacgccgacaugggcuauuggaucgagagccaaaagaacgggagcuggaaacucgagaaggccagucugauagagguuaagacgugcaccuggccgaagagucauacccuguggagcaacgggguccucgaguccgacaugauuauccccaaaucguuagcggggcccaucucucagcauaacuaccggccgggcuaucacacccaaacggcggggcccuggcacuuaggcaaacucgagcuggacuucaacuacugcgagggcacaaccgucgugauuaccgaaaacugcgggacacgcggcccuagccugcggaccaccaccgucuccgggaaacucauccacgaguggugcugccggagcugcacccugccgccuuugagguauaugggcgaggaugguugcugguaugggauggagauucgcccgaucagcgaaaaggaggagaacauggucaaaagcuuggugucagccggcagcggagaaguggacaacuucaccaugggaguacugugccuggccauccuuuucgaagaggugaugcgggggaaguuuggcaagaaacacaugaucgcggggguguuuuucaccuucguccugcugcucuccggccaaaucacguggcgcgacauggcccauacgcuuaucaugaucggcucuaacgccuccgaccggauggggaugggcgugacauaccuggcccucaucgcgaccuucaagauacagcccuucuuggcgcugggauucuuucuccgcaagcuuacaucgagggagaacuugcuccugggcguggggcuggccauggcaacgacccuccaacugcccgaggacaucgagcaaauggccaacgggaucgcgcuuggccucauggcccugaagcugaucacccaauucgagaccuaucagcucuggacggcccugaucagucugaccugcucaaacaccaucuucacgcucaccguggcuuggagaaccgcuaccuugauccuggcgggcgugagccuccugccgguaugccagagcucgucuaugcguaaaaccgacuggcugcccaugacuguggccgccaugggcgugccgccguugccgcuuuuuaucuucagccugaaggacacccucaagagacgcagcuggcccuuaaacgagggggucauggcugugggcuugguuagcauccucgccuccagcuuacugcggaaugacguacccauggcgggcccucucguggcagggggccugcugaucgcgugcuacguuaucacugggaccuccgccgaccucacgguggagaaggccgcggacgugaccugggaagaggaggccgagcagacaggcguaagccacaaccuaaugaucacuguagaugacgacgggaccaugcgcauuaaggacgacgaaaccgagaacauucugaccgugcuccuuaagaccgcccuccuuaucguuuccggcauuuucccguacagcauccccgccaccuuacuggucuggcacacauggcaaaagcagacucagcguagcgggguccuuugggaugucccaucaccgcccgaaacucagaaggccgagcuggaagaggguguguaccgcaucaagcagcagggcaucuucgggaagacccaggucgguguggggguccagaaggagggagucuuccauacgauguggcacguaacacggggcgccguccuuacguacaacggcaagcgccucgagcccaacugggccucugugaagaaggaccugaucucguacggcgggggcuggcggcuguccgcccaguggcagaagggggaagagguucaggucauagcaguggagccugggaaaaaccccaagaacuuucagaccaugcccggcacuuuccaaaccaccaccggggaaauaggcgcaaucgcccucgacuucaagccagguacuagcggcagccccaucaucaaccgcgagggcaaggugguuggacuguacgggaacgguguggucaccaagaacggaggauacgucuccggaauugcccagacaaacgccgagccggacggccccacucccgagcuggaagaggaaauguucaaaaagcggaaccugacaaucauggacuuacaucccgggagcggcaagacccgcaaguaucugccggccaucgugcgggaggcaaucaagcgccggcugcgcacacucauccuagcgcccaccaggguggucgccgcugagauggaagaggcccugaaggggcucccgauacgcuaccaaaccacugcgacgaaguccgaacacaccggccgggagaucguggaucugaugugccacgccacguucaccaugcgccugcuaagccccguacggguuccgaacuacaaucuaaucaucauggacgaggcucacuucaccgacccugcauccauagccgcgcgcggguacauaaguacccggguggguaugggagaggccgcugccauauucaugacagcgacgccucccggaacugccgaugcuuuuccgcaguccaaugcccccauucaggacgaagagcgcgauauccccgagcgcucuuggaauucaggcaacgaauggaucaccgacuucgccgggaaaacggugugguucguccccucuaucaaggccggcaaugauauugccaauugucuacggaagaacgggaagaaggucauccagcuaucacgcaagacauucgacaccgaguaccagaagacgaaguuaaacgauugggauuuuguggucacaacggacauaucagaaaugggcgccaacuucaaggccgacagggucaucgacccgagacggugucugaaacccguaauacucacagauggccccgagagggucauucucgcgggucccaugccggugaccgccgcuuccgccgcgcagcgucgcggucggguggggcguaauccacagaaggaaaacgaccaguacaucuuuaccggccagccacugaacaaugacgaggaccaugcccacuggacugaagcgaagaugcuacuggacaacaucaauacccccgaggggaucaucccggcccuuuuugagcccgaacgggaaaaaagugccgccauagacggcgaguaccgccucaagggcgaaucccguaagaccuuuguugaacugaugcgccgaggcgaccuacccguguggcucgcgcacaaggucgcuuccgagggcaucaaguacaccgacaggaaguggugcuucgacgggcaacggaacaaucagauucuggaggagaacauggacguugaaaucuggacgaaagaaggcgagaagaaaaaguugcgcccacgguggcucgaugcgcgcaccuacuccgauccccuggccuugaaagaguucaaggacuucgcggcgggccgcaagagcaucgcccucgaucuggugacggagaucgggcggguccccucccaccuggcacaccgcacccgcaaugcccucgacaaccugguuaugcugcauaccucagagcacggcggcaaggccuaccgccacgccguggaggagcuccccgagaccauggagacccuacugcuccugggccugaugaucuuacugaccgguggugccaugcuguuccucauuucgggaaaagggaucggcaagacaagcaucgggcugaucugugugauagccagcuccggcaugcuguggauggcggagaucccgcuccaguggaucgccuccgcgaucgugcuggaguucuuuaugauggugcuccucaucccagagcccgagaagcagcggacgccccaggauaaccaacuugcuuaugucguaaucggaauccugacccucgcggccaucaucgccgcaaacgagaugggccugcuggagacuacgaaacgcgaucucggcaugucuaaggagccgggggugguuuccccuaccuccuaccuggacguggaccuucaccccgccagcgccuggacccucuacgcuguagcgacgaccgucauuacccccaugcugcggcacaccaucgagaacaguacagcgaacgugagccuagccgccaucgccaaccaggcugugguacucaugggccuggacaagggguggccaauuucuaagauggaucuggguguacccuuguuggcgcuggguuguuauucgcaggugaacccccucacguuaacugcggcuguccuccuccugauuacgcauuacgccaucaucggcccgggccuucaggcgaaggcgacccgcgaggcccagaaacggacugcugcagggauuaugaaaaacccgacaguggacggcauaaugaccaucgacuuggaccccgugaucuacgauuccaaauuugaaaagcaacucggucagguuauguugcucgugcugugcgcggugcaacugcuccucaugcgcacgagcugggccuuaugcgaagcacucacucuggcgacuggccccaucaccacucugugggagggcucccccggaaaguucuggaacacaacuaucgcgguaaguauggccaacauuuuucgcggcucauaccucgccggagccggccuagcauucagcaucaugaaauccguggggaccggcaagcgcggaacuggcagccagggugagacccugggggagaaguggaagaagaagcuuaaccaguugagccgcaaggaguucgaccuguacaaaaaaucagguaucacugagguggaccgcaccgaggcgaaggaggggcucaagcggggcgagaucacucaccaugccgucagccgcgguagcgccaaguugcagugguucguggaacggagcauggugaucccggaggggcgaguaaucgacuugggcugcggucggggggguugguccuacuacugugccggccucaagaaggugaccgaagugcgcgguuacaccaagggcgggccuggacacgaggagcccguacccaugagcaccuacgguuggaauaucguuaagcuuauguccgggaaggacguguucuaccucccgcccgaaaagugcgacacgcuccugugcgacaucggggaauccuccccuaguccaaccgucgaggagucgcggacaaucagagugcugaaaaugguggaaccguggcugaagaacaaccaauuuugcaucaaaguccuaaacccauacaugccaaccgugaucgagcaucuggagagauuacagcguaagcacggcgguaugcucguucgcaauccacugucucggaacucgacccacgaaauguacuggaucucaaacggcaccgggaacauagucgccuccgucaacauggugagucgauugcugcugaaccgguucacgaugacccaccgccguccuaccauugagaaagauguggaccugggugcgggcacccgccaugugaacgccgaaccugagacgcccaacauggacgugaucggggagcgaaucaagcgcaucaaggaggagcacaacuccacauggcacuaugacgacgagaacccguacaagaccugggcguaccacggcaguuaugaggucaaggcaaccgguuccgcgagcucaaugaucaacgguguggucaaacuccuuacuaagccgugggacguggugcccauggucacacagauggcuaugacugacacgacgcccuuugggcagcagcggguguuuaaggagaagguggacacccgaaccccgcgauccaugcccggcaccagacgugucaugggcaucacggccgaauggcuauggcguacacucgggcgaaacaagaagccccgccugugcacccgugaggaauucaccaagaaagugcguacgaaugccgccaugggugcggucuuuaccgaggagaaccagugggacucugcuaaggccgccguugaagaugaagacuucuggaagcugguggaccgcgagcgggagcuccacaagcuggggaagugcggcuccugcguuuacaacaugauggggaaacgcgagaagaagcugggugaguucggcaaggccaaggguucgcgggcgaucugguauauguggcucggcgcucgguaccuugaguucgaggcucugggcuuccuaaaugaggaucacugguucucacgggagaacucuuauagcggcguugagggugagggccugcauaagcugggcuacauccuccgcgacauaucuaagauccccgggggcgccauguacgcagacgacaccgcugggugggacacccgcaucacggaggacgaccugcacaacgaggagaagaucacccagcagauggaccccgaacacaagcagcuggccaacgccaucuucaagcucaccuaucagaauaaggucgugaaaguacaaaggccgacccccacaggcacggugauggauaucaucagccggaaggaucaacggggcagcggccagguuggcaccuacggacugaacaccuucaccaacauggaggcccagcuuauucggcaaauggaaggcgagggggugcucuccaaagccgaccuggagaauccucaccuccccgagaagaagaucacgcaauggcuggagaccaagggcguggagcgccugaagcgaauggcgauaagcggugaugacugcguggucaaaccaaucgacgaccgcuucgcgaacgcccugcuggcucugaacgacauggguaaagugcggaaggacaucccgcaguggcagcccuccaagggcuggcacgacuggcagcagguccccuucuguucucaccacuuccacgaacugaucaugaaagacggucgcaagcuugucgugcccugcaggccucaagacgaauuaaucggccgcgcccggaucagucagggggcaggcuggagccugcgcgagacggccugccucggcaaggcauacgcgcagauguggucccugauguacuuccaccggagagaucuucggcucgcuagcaacgccaucugcuccgccgugccaguccacugggugccgaccucgagaacgaccugguccauucacgcccaccaccaguggaugaccaccgaggauaugcuaacgguguggaaccgcgucuggauugaggacaaucccuggauggaggacaagacgccggucacaaccugggaaaacgugcccuaccuagggaagcgugaggaccaguggugcggcagucucaucgggcugaccagccgcgccaccugggcgcagaacauaccuaccgcuauccaacagguccggucccugaucggcaacgaagaguuucucgacuacaugcccagcaugaagcgguuccggaaggaggaggagagugagggggccaucugguga

SEQ ID NO: 26199 - RNA, 9873 nt, Artificial Sequence
  derived and/or modified CDS sequence (opt11) from DENV-3__AY858038__SS-prME
accucgcugugccucaugaugaugcugccggcaacccuggccuuccaucucaccagccgggauggggagccgcggaugaucguggggaagaacgagcggggcaagagccugcuguucaaaacugccucagggauaaacaugugcacccugaucgccauggaccuuggcgagaugugcgacgacaccgugacguauaagugcccccugauaacggagguggaaccugaggacaucgacugcuggugcaaccuuacaagcaccugggugacguacgggaccuguaaccaggccggggagcaccggcgcgauaagcggaguguggcccuggcaccucacgucggcauggggcuggacacccgcacccagacguggaugagcgccgagggcgccuggcgccagguugagaagguggagacuugggccuuccgccauccgggguucaccauccucgcccuguuccuggcgcacuauauaggcaccagucucacgcagaagguugugauuuucauucugcugaugcucgucacccccagcaugacuaugcggugcguuggggugggcaaccgcgacuucguggaaggccugagcggugccaccuggguggacgugguucuggaacacggcgggugcgugacgaccauggcuaagaacaagccaaccuuagacaucgagcugcagaagaccgaggccacucagcuggccacacuacggaagcugugcaucgagggcaagaucaccaacgugacaacggacucgcgcugccccacccagggcgaagcgauccugccggaggagcaagaccagaacuacgucugcaagcacaccuauguugacagaggguggggcaaugggugcggauuauuugggaagggcucccuuguaacaugcgccaaguuccagugccuggagagcaucgagggcaagguggugcagcacgaaaacuugaaguacacagugaucaucaccguccacacaggggaucaacaccaagugggcaacgagacgcagggggucacugccgagaucacgccccaagccuccaccguggaggccauucugcccgaguacgguacgcuggggcucgagugcucuccccgcaccggacuggauuucaacgagaugauucugcucacuaugaaaaacaaggcguggaugguacaccggcagugguucuucgaccugccgcuccccuggacuuccggcgccaccaccgagacgcccaccuggaacaagaaggagcuccuggucaccuucaagaacgcgcacgccaaaaagcaggagguggugguacuggggucccaagagggcgccaugcacaccgcgcucacgggggccaccgagauccagaccuccggcgggaccucuaucuucgccggccaucugaagugccgccugaagauggacaagcucgagcugaagggcaugucguacgccaugugccugaacgcauucgugcucaagaaggaagugagcgagacgcagcaugguaccauccugauuaagguugaauacaaaggggaggacgcgcccugcaagaucccguucagcaccgaggacggacagggcaaggcccacaauggcaggcugauaaccgccaacccuguggugacgaagaaggaggaaccugucaacaucgaggccgagcccccguucggggaguccaauaucgugaucggcaucggggacaaggcgcugaagaucaacugguauaagaagggcagcuccaucgggaagauguucgaggccacugcccgcggcgcccggcgcauggccauccucggcgacaccgcgugggacuucgggucugugggcgggguccugaacuccuugggcaagaugguucaucagaucuucgggagcgccuauacggcccucuuuagcggcgugucauggauuaugaagaucggcaucgggguucugcugacguggaucggccuaaauuccaagaacacuucuauguccuucagcugcaucgccaucgggaucaucacccuuuaccugggcgccgugguccaggcggacauggggugcgucaucaacuggaagggcaaggagcucaagugcggcuccggaaucuucgugaccaaugaggugcauaccuggaccgagcaguauaaauuccaagccgacagccccaagcggcuggccaccgccaucgccggugcgugggagaacggggugugcggaaucagaucgaccacgaggauggagaaccuguuauggaagcagaucgccaacgaguuaaacuacauccugugggagaacaacauacggcucaccgugguagucggggacaccaucggcgugcugcagcaaggcaagcgcacccuaccgccccagccgauggaguuaaaauacagcuggaaaacgugggguaaggccaaaaucguaaccgccaagacccaaaacuccagcuucaucaucgauggccccaacacucccgaauggcccuccgcguccagggccuggaacguuugggaaguggaggacuacggguuuggcguguucacgaccaacauauggcugaagcugcgcgagauguacacccagcucugcgaccaucgucugaugagcgccgccgucaaggacgagcgcgccguccaugcggacaugggauacuggaucgaaucccagaagaacgggagcuggaagcuggagaaggccucccucaucgaggucaagaccugcaccuggcccaagagccacacgcuuugguccaacggcguacucgagucugacaugauuauccccaagucccucgcagggcccauuucccagcacaacuaccggccgggcuaccacacccaaacugccgggccuuggcaucugggcaagcuggaacucgacuucaacuacugcgagggcaccacgguggugaucaccgagaauugcgggacccgcggcccgucccugcggaccacuaccgucagcgggaagcugauccacgaguggugcugccgcuccuguacccuaccaccccuacgguacaugggggaggacggguguugguacggcauggaaauucggcccaucaacgagaaggaggagaacauggucaagagccuugugucggccgguagcgggaagguggacaacuucaccaugggcguccugugccuggcuauacuguucgaggaggugaugcgggguaaauucggcaagaagcacaugauagccgggguccuuuucacguucguguuacuacuauccggccaaauuaccuggcgcgacauggcccggacccugaucaugaucggcucuaacgccagcgaccgcauggggaugggcgugaccuaccuagcccucauagcgacguucaagauacagcccuuccuggccuuaggguucuuucuccggaagcugaccucucgcgagaaccugcuucugggcgucggccuggcgauggccacgacccuccagcugcccgaggacaucgaacaaauggcgaacgggaucgcccugggccucauggcccucaagcuggugacgcaguuugagaccuaccagcucuggaccgcccugguuagucugaugugcuccaacaccaucuucacgcucacgguagccuggagaaccgcaacccugaucuuggccgggauaagccucuugcccgugugccaguccagcuccaugcgcaagacggauuggcugcccaugaccguagccgcgaugggcgugccgccccucccccuguucaucuuuagccuuaaggacacccucaagcgccguuccuggccccugaacgagggaguaauggccguuggacucgugagcauucucgcguccucccugcugcggaacgacgugcccauggccggcccccucgucgccgggggccuccugaucgccugcuacgugaucaccgggacaucugccgaccucaccguggagaaggcggccgacgucaucugggaggaggaggccgagcagaccggugugagccacaacuuaaugaucaccguggaugacgacggaacgaugcggaucaaggacgacgagaccgagaacauccugaccguccugcuaaagaccgcccugcugaucguguccggaaucuucccguacagcauccccgccacccugcugguuuggcauacguggcagaagcaaacccagcgcaguggaguacucugggacgugcccagcccacccgagacgcaaaaggcggaauuggaggaaggagucuaccggaucaagcagcaaggcaucuuugggaaaacccaagucggagugggggugcagaaggagggcgucuuccacacgauguggcacgugacucgcggcgccgugcugacccacaauggcaagcgacuugagccuaacugggccucggucaagaaggaucugauuagcuacggcggcggcuggcgccuauccgcacaguggcagaagggggaggagguccaggugaucgcggucgagcccggcaagaaccccaagaauuuccagaccaugcccggcaucuuucagacgaccacgggcgagauaggcgccaucgcccuggacuucaagccagggacgagcggcagucccaucaucaaccgggaggguaaggucguaggucucuacggcaacgguguggucacgaagaacggcggguacgugucaggcauagcccagaccaaugccgagcccgacggccccacccccgagcuggaggaggagauguucaagaagcgcaaccugaccauaauggaccugcaccccgggagcggcaagacgcggaaguaccugccggccaucauccgcgaggccaucaagcggcgucuaaggacccucauacuggcccccacccgcgucgucgccgccgagauggaggaggcgcugaaggggcucccuauccgguaucagaccacggccaccaaguccgagcacaccggcaaggagauagucgaccuuaugugccacgcaaccuucacgaugcgccugcucagccccguccgggugccgaacuauaaccucauaaucauggacgaggcccacuuuaccgaucccgccaguaucgcggcccgcggguacaucagcacccguguggggaugggcgaggcggccgcgauauuuaugacggccacaccgcccgguaccgcugacgccuucccucaguccaacgcccccauccaggacgaggagcgcgacauacccgagcgcagcuggaacuccggaaacgacuggaucaccgacuucgccgggaagaccguuugguucgugccaagcaucaaggccggcaacgauaucgccaacugucugcggaagaacgggaaaaaggugauccagcucucccgcaagacguucgacacugaguaucaacggaccaaguuaaacgacugggacuucguggugaccaccgacaucagcgaaaugggcgccaacuucaaggccgaccgcgugaucgacccgcggcgcugccugaagcccgucauucucaccgacggcccugagcggguuauucuggccggacccaugccggugacagucgccuccgccgcucaacgccggggccgcguggggcggaacccccagaaggagaaugaccaauacauuuucaccggccagccccugaacaacgaugaggaucaugcccauuggacggaagcgaagaugcuccuggacaacauaaauacccccgaggggaucauaccggcccuguucgaacccgagcgugagaaguccgccgcuaucgacggcgaauaccggcucaagggcgagucccgaaagacuuuuguggagcugaugcggcgcggggaccugcccguauggcucgcgcauaaaguggccagcgaaggcaucaaguacaccgaccgcaaguggugcuucgacggggagcgcaacaaucagauccuggaggagaauauggacgucgagaucuggaccaaggagggcgagaagaagaagcugcggcccagauggcucgacgcacgcacuuauuccgauccgcuggcccucaaagaguucaaggacuucgcugcggggcgcaaaagcaucgcccucgaccuggugaccgaaaucgggcguguucccucccaccuggcucaccggacucgcaacgcccucgacaaccuggucaugcugcacacaagugagcacggcggacgggccuaccgccacgcggucgaggagcuccccgagacgauggagacccuguugcuccugggccugaugauccuccugaccgggggcgccaugcuguuccucaucagcggcaaaggaaucgguaagaccuccaucgggcugauuugcguggucgcaagcucugggaugcuguggauggccgacgugccgcuucaauggaucgccagcgcgaucguacuagaguucuucaugauggugcugcucauccccgagcccgagaagcagcggacgccccaggacaaccagcuugccuacgucgugaucgggauucugacuuuagccgccaucgucgccgcaaacgagaugggccuccuggaaaccacgaaacgcgaccucggcaugucuaaggagccgggggugguuagucccacguccuaccuggacgucgaccugcaucccgcuagcgccuggacccucuacgccguggccaccaccgugauuacgcccaugcugagacacaccaucgagaacuccaccgcaaacgucucacuggccgcuauugccaaccaggcgguugucuugaugggccuggacaagggguggccgaucuccaagauggacuugggcgucccacuccucgcgcugggcugcuauagccaggugaacccccucacucugacggccgccguacuuuuacugguaacccacuaugccauuauaggcccaggcuugcaggcgaaggcaacacgcgaggcccagaagcggaccgcagccgggauuaugaagaacccgacgguggacggcaucaugaccaucgaccuugacccugugaucuacgacuccaaauucgagaagcagcuggggcaggucaugcugcucgugcugugcgcggugcaguugcuccuaaugcgcaccagcugggccuucugcgaggcccugacguuggccacgggccccaucaccacccugugggagggcucccccgggaaguucuggaacacaacuaucgcggugagcauggccaacauuuuccgggguuccuaccuggcaggggccggucucgccuucaguaucaugaaaucgguggggaccggcaagcgcggcaccgggucgcagggagaaacccugggggagaaguggaaaaagaagcugaaccagcucagcaggaaggaguucgaccuauacaagaaguccgggauaacggagguggaccgcaccgaggcgaaggagggacugaagcggggcgagauuacccaccacgccguuagccgcggcuccgcaaagcuacagugguucgucgaacggaacauggucauaccggaggggcgcgucaucgaucugggcugugggagaggcggguggagcuauuauugcgccggccugaagaaggugaccgaaguucgcggguacaccaagggcggaccagggcaugaggaacccgugccuauguccacauacggcuggaacaucgugaagcucaugagcgggaaggacguauucuaccugccgcccgagaagugcgauacccugcugugcgacauuggcgaauccagccccucacccacugucgaggagagcagaacaauucgcgugcucaagaugguggaaccguggcucaaaaacaaucaguucugcaucaagguccugaaccccuacaugcccacggucaucgagcaucucgagcgccugcagcggaagcacggcgggaugcugguucgcaacccccucaguaggaauagcacccaugagauguacuggaucaguaacggcaccgggaauauuguuagcuccgugaacauggugagccgccugcugcucaaucgguucaccaugacccaccgccggccaaccauugagaaggacgucgaucugggcgccggcacacgccacgugaacgcggagccugaaacccccaacauggacgucaucggggagcgcaucaggaggaucaaggaggagcauuccagcacguggcacuacgacgacgaaaacccguacaagaccugggccuaucacggcucguaugaggugaaggccaccgguagugccagcuccaugaucaacggugugguuaaacuguuaaccaagcccugggacguggugcccaccguaacgcagauggccaugaccgacaccacgcccuuugggcagcaacgcguguuuaaggagaagguggacacccggaccccgcgcccuaugccggguacucggaaggucauggaaauaacggccgaguggcuguggcgcacucugggccgaaacaaacgcccccgccucugcacacgggaagaguuuaccaagaaggugcgcacuaacgccgccaugggugccguguuuacagaagagaaccagugggacagcgcgcgggcggccgucgaggacgaggaguucuggaaacugguggaccgcgagcgggagcugcacaagcucggcaagugcggguccuguguguauaacaugaugggaaagcgugagaaaaagcugggggaauuuggcaaggcgaagggcagccgggccaucugguacauguggcucggggcgcgcuaccuagaguuugaggcccugggauuucugaacgaggaccauugguucucgcgggagaacagcuacuccggagucgagggugaggggcuccacaaacugggcuacauccugcgcgacaucagcaaaaucccgggcggggccauguacgccgacgauaccgccggaugggauacccggaucacggaggacgaccuucacaaugaggagaagaucacccagcaaauggaccccgagcaccgccagcuggcuaacgccaucuucaagcugaccuaccaaaacaagguggugaagguccagcggccuacccccaaggggacgguuauggacaucaucucccgcaaggaucagcggggcagcggccaaguggggaccuacggucucaacaccuucaccaacauggaggcgcagcugauucgccagauggagggggaggggguccugaguaaggccgaccuagagaacccucaccuacuggagaagaagauaacccaguggcucgagacgaagggggucgagcggcuaaagcgcauggccaucagcggcgacgauugcguggugaaacccaucgaugaccgguuugcgaacgcguugcucgcccugaaugacaugggcaaggugcgcaaggacaucccacaauggcagcccuccaaggguuggcacgauuggcagcaaguucccuucuguucccaccauuuucacgaguugaucaugaaggacggccggaagcucgucguucccugcagaccgcaagacgagcugaucgggcgcgcccggaucucccagggcgccggguggucccugaaggagaccgcgugucucggcaaggccuacgcccagaugugggcccugauguacuuccaccgccgggacuuacgccucgcgagcaaugcuaucugcucggccgugccgguccacugggugcccaccucccggacuacgugguccauccacgcccaccaccaguggaugacaacggaggauaugcugaccgucuggaaccgcgucuggaucgaagacaacccguggauggaggauaagacgccagugaccaccugggaagaugugcccuaccugggcaagcgggaggaccaguggugcgggagccucaucggccugaccucccgggcuacgugggcucagaacauccugaccgcuauccagcagguccggucucucaucgguaacgaggaguuccuggacuacaugccgagcaugaagcgcuuccgcaaggaggaggagagcgagggagccauuugguga

SEQ ID NO: 26200 - RNA, 9873 nt, Artificial Sequence
  derived and/or modified CDS sequence (opt11) from DENV-3__AY858039__SS-prME
acaucccugugucucaugaugaugcugccggcgacccucgcguuccauuugaccagccgggacggugagccccggaugauagucgggaaaaacgagcgcggaaagucucuacucuucaagaccgccuccgggaucaacaugugcacguugaucgccauggaccugggcgagaugugcgacgacacugugaccuacaagugcccgcugauaacugagguggagccggaggauaucgacugcuggugcaaccucaccucgacuugggugacguacgggaccugcaaccaggccggcgagcaucggcgcgacaagcgguccgucgcucucgcaccacacgugggcaugggacuggacacuagagcacagaccuggaugucggcagagggcgccuggcggcaggucgagaaggucgagacgugggccuuccgccaccccggguucacaauucucgcgcuguuccuggcccauuacauuggcacaucccucacccagaagguggugaucuucauccugcuuaugcucgucacccccagcaugacuaugcggugcgugggugugggcaaucgcgauuucgucgaggggcuguccggggccacauggguggacguaguccuggagcauggcgggugugugaccacgauggccaaaaauaagccgacucucgauauugaguuacagaagacggaggccacccagcuagcgacgcuccggaagcuguguaucgagggcaaaaucaccaacgugaccaccgacucgcguugccccacgcagggcgaggccauacugccggaggagcaagaccaaaacuacgucugcaagcauaccuacgucgaucggggguggggaaacggguguggucucuucggaaaaggcucccuggugacaugcgccaaauuccagugccuggagcucaucgagggcaaggucgugcagcacgagaaccucaaauauacagugaucaucacgguccauaccggagaccagcaccaggugggcaacgagacccagggagucaccgcugagaucacaccccaggccucaaccguugaggcaauccugcccgaauauggcacccucgggcuggagugcucaccucguaccggccuggauuucaacgaaaugauacuccugaccaugaagaacaaggccuggaugguacaccggcagugguucuucgaccugccgcucccguggacguccggcgccaccaccgagacccccacguggaacaagaaagaguugcuggucaccuucaagaacgcccacgcaaagaaacaggaggucgugguccucgggucccaggagggcgccaugcacaccgcgcugaccggcgccacggagauccaaacgagcggagggaccuccaucuucgccggccaucugaaaugccggcucaagauggacaagcuggagcuaaaaggcaugagcuacgccaugugcucaaacgcguucguacucaagaaggagguuagcgagacccaacaugguacgauccugaucaagguagaguauaagggcgaggacgcccccugcaagauaccguucucgacagaggaugggcagggcaaggcacacaauggucggcuaauaaccgccaaccccgucguaacgaagaaggaagaacccgucaacaucgaggcggagcccccguucggggaguccaacaucauuauaggcaucggggacaaggcccugaagaucaacugguauaagaagggcagcuccaucgggaaaauguucgaggcuacggcucgcggcgcccggcgcauggcgauccucggagauaccgcgugggacuuugggagcgugggcggggugcuaaacucucucggcaagaugguccaccagaucuuugggagcgccuauaccgcucucuucagcgggguaagcuggaucaugaagauuggcaucggggugcugcugacuuggauaggauuaaacuccaagaacacaaguauguccuucucaugcaucgucaucgggaucauuacccuguacuugggagccguggugcaggcggacaugggcugcgucauaaacuggaagggcaaggaacuuaagugcgguuccgggaucuuugugacgaacgaggugcacaccuggacggagcaguacaaauuccaggcagacagcccuaaacggcuggccaccgcaaucgccggagccugggagaauggugucugcggcaucagguccaccacccgcauggagaaccuucucuggaagcagaucgccaacgagcugaacuacauccugugggagaacaacaucaagcucacggugguugucggggacauuaucgggguucuagagcagggaaaacgaacccugacgccccagcccauggaguuaaaauacagcuggaaaaccugggggaaggcgaagaucgugacggcugagauccagaacaguagcuucaucauagacggcccaaacacccccgaaugcccuaacgcauccagggccuggaauguuugggaggucgaggacuacggguucggaguguucacgaccaacaucuggcuuaagcugcgggagauguacacgcagcucugcgaccaccgccugaugagcgccgcggucaaggacgagcgggcuguacacgcggauaugggauacuggaucgagagccagaagaacgggucguggaagcuggagaaggcgagccucaucgaaguuaaaaccugcacauggcccaagucccacacacuguggagcaacggcguccuggaguccgacaugauaaucccgaagucccuugccgggccuauuagccagcacaauuaccgcccaggguaccacacccagacggccgggccuuggcaccugggcaagcuggagcucgauuucaacuacugcgagggcaccaccguggugaucacagaaaacugugggacgcguggccccagccuucgcacuacaaccgucuccgggaagcugauacacgaguggugcugccggagcugcacgcugccgccccuccgcuauaugggcgaggacgggugcugguacggcauggaaauccggccgaucaaugagaaggaggagaacauggugaagucacuggucucugccggcucugggaaggucgacaacuucaccaugggcguucucugccuggcuauccuguucgaagaggucaugcgcgggaaguucggcaagaagcacaugauugcuggcguacucuuuaucuucguucugcugcucaguggucagaucaccuggcgcgacauggcuaggacccugaucaugaucggcuccaacgccagcgaccggauggggaugggcguaacguaccuagcccucaucgcgaccuucaagauccagccauuccuggcgcugggguucuuucucaggaagcugaccucccgggagaaccuguuguuaggcgucggacucgccauggccaccacgcuccagcuacccgaggacaucgagcagauggcgaacgggaucgcgcuuggccucauggccuugaagcugaucacccaguucgagaccuaccaguuauggaccgcucuggugucgcugacgugcagcaauaccauuuucacccucaccguugccuggcgcacggcaacgcugauccuggcagggaucucccuccugcccguuugccagagcucgagcaugcgcaagaccgauuggcugccuaugaccguggccgcgaugggugugccacccagcccccucuucaucuucucccugaaagacacguuaaagcgacgcucuuggccgcucaacgaggggguaauggccgugggccugguuagcauccuggcguccagccuccugcggaacgaugugcccauggcgggccccuugguggccggagggcuccuaaucgccugcuacguaaucacagggacuuccgcggaucugaccguggaaaaagcggccgaugugacgugggaggaggaggccgagcagaccggcgucucgcacaacuugaugaucacgguugacgaugaugggaccaugcgcaucaaagacgacgagacggagaacauccugaccguucuccuaaaaaccgccuuacugaucgucuccggaaucuuccccuacaguaucccggcaacccuacucguguggcacaccuggcagaagcagacacagcguuccggcgugcuaugggauguccccagcccgcccgaaacccagaaggccgaacucgaagaggggguuuaccgcaucaaacagcggggaaucuucgggaaaacccaggugggcgucggcgugcagaaggagggcguguuccacacaauguggcacgucacucgcggagccguacucacauauaacgggaagcggcuggagccgaacugggccuccgugaaaaaggaccucaucagcuacggcggggguuggcgccuguccgcacaguggcagaagggggaggagguccaagugaucgcggucgaaccgggcaaaaaccccaagaacuuucagacaaugcccgguaucuuucagaccacgaccggggaaaucggcgccauagcucuggacuucaagccagggaccagcgguucacccaucaucaaccgggaaggcaaggucgugggacuguacggcaaugggguggucaccaagaacggaggcuacguguccggcaucgcccagacgaacgccgagcccgacggcccgacgcccgagcucgaggaggagauguucaaaaagcgcaaucuuacaaucauggaucugcacccggggagcgggaagacccggaaauaccucccagcgaucgugcgcgaagccaucaagcggcgccugcggacccugauccucgccccaacacgggucguggccgccgagauggaggaggcgcugaaggggcugccgauccgguaccagacgaccgccacgaagagugagcacacgggcaaggagauaguggaucucaugugccacgccacauuuaccaugcgguuacugagccccguccgggucccgaacuacaaccucaucaucauggaugaggcccacuucacggacccggccuccaucgcggcgcgcggguauaucucgacacgggucggcaugggcgaggccgcagcgaucuucaugacagcgacgccgccugggacggccgacgccuucccccaauccaacgccccgauccaggacgaggagcgcgacauccccgagcgcagcuggaacucggguaacgacuggaucaccgacuuugcugguaagaccgucugguucgugcccaguaucaaggccgggaacgauaucgccaacugucugcggaagaacgggaagaaggugauacagcugucccggaagaccuucgacacggaguaccagaaaaccaagcucaacgacugggacuucguugugaccaccgacaucagcgagaugggcgccaauuuuaaggccgaucggguuaucgaccccaggaggugcuugaaaccggucauccugacggauggcccggagcgcgugauacuagcggggccuaugcccguaaccgucgcguccgcagcccagcggagagggcggguuggccgcaacccgcagaaagagaacgaucaguacaucuucaccggccagccucugaacaacgacgaagaucacgcacacuggacugaggcgaagaugcuucucgauaauauuaacacacccgaggggaucauccccgcccuguucgagcccgagcgagagaaguccgccgccaucgauggcgaguaccgccugaagggcgagucccggaagaccuuuguugagcucaugcgccgcggggaccuucccgucuggcuggcgcacaaaguggccucugagggcauaaaguauaccgaccgcaagugguguuuugacggggaacggaacaaccagauccucgaggagaacauggacgucgagaucuggacgaaggagggagagaagaaaaagcugcgcccccgguggcuggacgcaaggaccuauuccgacccgcuagcgcugaaggaguucaaggacuucgccgcaggcagaaagagcaucgcccuggaccucgugacggagauugggcggguuccgucccaccuugcccacagaacccggaaugccuuagacaaccuggucaugcugcacacuagcgagcacggagggcgggccuaucggcacgcgguggaggagcugcccgaaacuauggagacccuccuucugcucggccugaugauccugcucacaggaggcgccaugcuguuccugaucagcggcaagggggugggcaagacguccauaggucucauuugugugguggccagcucaggcauguuauggauggccgacaucccccugcaguggaucgccuccgcgaucguccucgaguucuucaugauggucuuacugaucccagagccugagaagcagcgaacaccccaagacaaccagcucgccuacguggucaucgggauccugacgcuggccgcgauugucgcugcaaacgagaugggccugcuggagacuaccaagcgugaccuugguauguccaaggagccugguguggugagcccaaccuccuaccucgacgucgaccugcaccccgccucagcguggacgcuguaugcggucgcgaccacugugauuacccccauguugcggcacacgaucgagaacucuaccgccaacgucucccuggccgcgaucgccaaccaggcuguggugcugaugggccucgauaagggguggcccauaucuaagauggaccugggcgucccacugcucgcccuggggugcuauagccaggugaacccacugacccuuacugcggccgugcuauuacucgucacgcacuacgccauuaucggacccggccugcaggccaaggccacccgggaggcacaaaaacgcaccgccgcagggaucaugaagaaccccaccguggacggcaucaugacgaucgaccuggacccgguaaucuacgacuccaaguuugaaaagcagcucggacaagucaugcugcucgugcucugcgcggugcagcugcuguuaaugcggaccagcugggccuucugcgaggcccugacccuggcgaccggccccaucacgacccucugggagggauccccagggaaauuuuggaauaccaccauagcggucagcauggccaacaucuucagaggcuccuaccuggccggggccggccuggcguucagcauuaugaagaguguggggacggggaagcggggaaccgggagccagggcgagacccucggggagaaguggaagaagaaacuuaaccaacugagccgcaaggaguucgaccucuacaaaaaguccggcaucaccgagguggaucgcacagaggccaaggaaggacugaagcgcggcgagaucacccaucacgccguaagccggggguccgcuaaguugcagugguucguggaacgcaacaugguuauccccgaaggaagagucauugaccucggcugcggacgcggaggguggagcuacuauugugcaggccugaagaaagugaccgaggugcggggcuacaccaagggcgggccagggcaugaggaaccuguccccauguccaccuacggcuggaacaucgucaagcugaugagugggaaggacgucuucuaccucccacccgaaaagugcgacacgcucuugugcgacauuggcgaguccagccccucgcccaccgucgaggaaagccgcaccauccgaguacugaagaugguggaacccuggcuaaagaauaaccaguucugcaucaaaguccugaaccccuauaugcccaccguaaucgaacacuuagagcgguuacaacguaaacacggcgggaugcuggugcggaacccccugucccgcaauucgacacaugagauguauuggauauccaauggcacugggaacauagucagcuccgugaacauggugagccggcucuuacuaaaccgcuucaccaugaccuaccggcgccccacgaucgagaaggaugucgaccucggcgcuggaacccggcaugugaacgcggagccggaaacgcccaacauggauguuaucggggagcgcauccggcgaauaaaggaggagcauucgagcacauggcauuaugacgacgagaaucccuacaagacaugggccuaccacgguuccuacgaggucaaggccacggggagcgccagcuccaugaucaacggcgugguaaagcugcugaccaagccgugggacguggugcccaccgucacgcaaauggcaaugaccgauaccaccccguucggucagcagcggguguucaaggagaaaguagacacacgcacacccaagccuaugcccggcacacggaaggucauggagaucaccgcagaguggcucuggcgcacucuuggcagaaacaagcgcccucggcugugcacccgcgaagaguuuacgaagaaaguccgcaccaaugccgccaugggggccguguucacagaggagaaccaaugggauagcgcgcgugccgcggucgaggacgaggaguucuggaagcugguggaucgggagcgggagcugcauaagcugggcaaaugcggguccugcguauacaacaugaugggcaagcgcgagaagaagcucggggaguuuggcaaggccaaggguagccgcgcaaucugguacauguggcugggagcgcgcuaccuggaguucgaggcccucggguuccugaacgaggaccacugguucucccgggagaacagcuacuccggggucgagggggagggccugcacaaacuuggcuacauccugcgcgacaucagcaagauuccaggcggggcaauguaugcagacgacacggccggcugggacacgcggauuaccgaggacgaccugcacaacgaggagaagauaacacagcagauggacccggagcaccgccaguuggcuaacgcgauauucaagcugaccuaccagaacaagguggugaagguccagagacccacccccaaggggacggugauggacaucauuucccggaaggaccagcggggcagcggccagguggguacguacggcuuaaacaccuucaccaacauggaggcccaacucaucagacagauggagggggagggcguccugagcaagaccgaccuggagaacccccaccucuuagagaaaaagaucacccaaugguuggagaccaagggcguagagcgguuaaagcguauggcuaucagcggcgacgacugcgucgucaagccgauagacgacagguucgccaacgcgcuguuagcccucaacgacaugggcaaggugcgcaaggacaucccucaguggcagcccuccaagggauggcaugacuggcagcagguccccuucugcagccaccacuuccacgaacugaucaugaaggacggccgaaaacuggucgugccgugccgaccucaggaugagcucaucgggcgugcaagaauuucccaaggcgcgggguggagccugaaggagaccgccugccugggcaaggcguacgcccagaugugggccuugauguacuuccaucggcgugaucugcgccuggccuccaacgcgaucugcucugccguaccgguacacugggugccgacuucccggacuacguggagcauacacgcccaccaucaguggaugacgacugaggacaugcucacgguauggaaucgcgucuggauugaggauaacccuuggauggaggacaagacgcccgucacuacgugggaagacguacccuaccugggcaagcgggaggaccaguggugcgggagucugauuggccucaccucacgugccacgugggcacaaaauauccuaaccgcuauacagcagguccgcagcuugaucgggaacgaggaguuccucgacuacaugcccucaaugaagcgcuucagaaaggaggaggaaagcgagggugcaaucugguaa

SEQ ID NO: 26201 - RNA, 9873 nt, Artificial Sequence
  derived and/or modified CDS sequence (opt11) from DENV-3__JN368477__SS-prME
accagucugugccucaugaugaugcugcccgcuaccuuagccuuccaccucaccucucgggacggcgaaccgcggaugaucguggguaagaaugagcgcggcaagucccugcuguuuaagaccgcuuccgggaucaauaugugcacgcucaucgcgauggaccucggcgagaugugugacgacaccgucaccuacaaguguccgcugauagccgagguggagccugaggacaucgacugcuggugcaaccucaccagcaccugggugacguacgggacuugcaaccaagccggcgagcaccggcgagacaagcggagugucgcccuggcgccacacgugggcaugggccuggacacccgcacccagaccuggaugagcgccgaaggggcguggcgccaagucgagaaggucgagacgugggcgcuccgccacccgggguucaccauacuugcacuguucuuagcccacuacauuggaaccucccugacucagaagguagugauauucauccugcucaugcuggucacgccgaguaugaccaugcguugcguaggcguggguaaccgcgacuucgucgagggccuguccggggccacguggguggacgugguccuagagcacggcggguguguuaccacgauggccaagagcaagcccacccuggauaucgagcugcagaagaccgaggccacccagcucgcgacgcugcggaagcugugcaucgagggcaagaucacgaacauuaccaccgacuccagaugccccacgcaaggugaggccacccugcccgaggagcaagaccagaacuacguaugcaagcacaccuacgucgaccggggguggggcaacggguguggccuguucgggaagggcagccuugugacaugugcuaaguuccagugccucgagcccaucgagggcaaaguaguccaguaugagaaucugaaguauaccgugaucaucaccgugcacaccggggaccagcaucaggugggcaacgacacccagggugugaccgucgaaaucaccccacaggccuccacuguggaagccguacuaccagaguacggcacccuugggcucgagugcagcccgcgcaccggccuggauuuuaaugagaugauccuccugacgaugaagaacaaggcguggaugguacaucgacagugguuuuucgaccugccccuccccuggaccucuggggccaccaccgaaacgcccacuuggaaccgcaaggagcugcuugugaccuucaagaacgcccacgcuaaaaagcaagagguugucgugcucgggagccaggagggugcuaugcauaccgcacugaccggggcgaccgagauccagaacaguggugggaccagcaucuucgccgggcaccugaagugcaggcugaagauggacaagcuggagcugaaaggcauguccuacgcaauguguuugaacaccuuugugcugaagaaggaggucagcgagacccaacacgggaccauccugaucaaagucgaguauaagggcgaggacgccccgugcaagauccccuucagcaccgaggacgggcaggguaaggcacacaacggccgccugauaacggcaaaucccguggucacgaagaaggaggagccggugaacaucgaggccgagccgccauuuggggaauccaacauugugaucgggauuggggauaaggcccucaagaucaacugguacaagaagggcagcuccaucggaaaaauguucgaggccacggcuagaggcgcccgccggauggccauccuaggugauaccgccugggacuuugguagcgucggaggcgugcugaacagucucggcaaaauggugcaccagaucuucgggagcgccuauaccgcucuuuucaguggggucagcuggaucaugaagaucggcaucggggugcuacucacuuggaucggccugaacuccaagaacaccucaaugucauucagcugcaucgugaucggaauuaucacccuauaccucggcgccgucgugcaggccgacaugggguguguuaucaauuggaagggaaaggagcugaaguguggaaacgggaucuucgucacaaacgaagugcacaccuggaccgagcaguacaaguuccaagccgacuccccaaagcgucuggcgacggccauugccggugcaugggagaacggggugugcggcauccgcagcaccacgcgcauggagaaucuccuuuggaagcagaucgcaaacgagcugaacuacauccucugggaaaacaacauaaagcugacggucgucgugggggacaucaucggggucuuggagcagggcaagcgcacccucacaccccagcccauggagcugaaguauaguuggaagaccugggggaaggcgaaaaucgugaccgccgagacccagaacagcuccuucaucauugacggccccaacacucccgagugcccaagcgccucacgagcuuggaacgugugggaggucgaggacuacgguuucggcguguucacuacaaauaucuggcugaagcuccgcgaaguauauacccagagcugcgaccaccgccugaugagcgcagccaucaaggacgagcgcgccguccacgcagacaugggcuacuggaucgagucccagaagaacggaagcuggaagcuagagaaggcguccuuuauagaggugaaaacguguaccuggcccaagagccacacucucugguccaacggcgugcucgagagcgauaugaucauccccaaaagccuggcgggacccaucucucagcacaaccaccggccgggguaccacacccagaccgcugggcccuggcaccucggcaagcuggagcuggacuucaacuauugcgagggcaccacgguagugaucgcugagaacugcgggacccgcggcccuucgcugcggacgacgacgguaagcggcaaacuuauccacgaguggugcugccgcuccugcacccugcccccacuccgguauaugggagaggacgggugcugguacggcauggagaucaggcccauuaacgaaaaagaggaaaacauggucaagaguuuggucuccgccggaagcgggaagguggauaacuucacgaugggcguccugugucucgccauucuguucgaagaggugaugcggggcaaguucggcaagaagcacaugaucgcgggcgugcuguuuaccuucguguuacugcugagcggccagaucacguggagggacauggcucacaccuuaauaaugauugguagcaacgcuagcgaccggauggguaugggcgugacccaccuggcccugaucgcaaccuucaaaauccagcccuucuuagcacugggguuuuuccugcgcaagcuaacguccagggagaaccugcugcuugggguaggucuugccauggccaccacccugcaacuccccgaggacaucgagcagauggccaacgguauagcgcuaggcuugaugacccugaaacugaucacgcaauucgagaccuaucaacuguggacagcgcucgucucccugacuugcuccaauacgaucuucacccugacaguggcauggcgcacggccacacucauccuggccggggucagccugcucccacugugucagagcagcuccaugcggaagacagacugguuacccaugaccguggcggcaaugggcgugccgccccuuccucucuucaucuucagccugaaagacacgcccaagcgucgcucauggccacucaacgaggggguuauggccgugggcuuggucuccauacuugccuccucacuccugcggaacgacguuccgauggcgggcccccuaguugccggugggcugcugaucgccugcuauguuaucacgggaacuucugcugaccugacugucgagaaggccgccgacgugaccugggaggaggaggcggaacagacgggggugucucauaaccucaugaucacggucgacgaugacggaaccaugcguaucaaggaugacgaaaccgagaacauccugaccgugcugcucaagacggcucugcucaucguguccggaaucuuccccuacucuauccccgcaacccuccuggucuggcacaccuggcaaaaacagacgcagcgguccggcgugcucugggacgugccuagcccucccgagacgcagaaggccgagcucgaagagggugucuacagaaucaagcagcagggaaucuuugggaagacccaagugggcguggggguccagaaggagggcguguuccacaccauguggcacgugacccggggcgcaguccugacucacaacgggaagcgccuggaacccaacugggccuccgugaagaaagaccugaucuccuacggcggaggcuggcgccuguccgcccaauggcagaaaggggaagagguacaggucaucgccguggagccaggcaagaacccgaagaacuuucagacaaugcccggcaucuuccagaccaccacgggggaaauaggggcaaucgcgcuggauuucaagccaggcaccagcggcagcccgaucaucaaccgcgagggcaaggugguugggcuguaugggaacgggguggugaccaagaacggcggguacguauccggcaucgcccagacgaacgccgagccugacggccccacgcccgaguuggaggaggaaauguucaagaaacggaaccuuaccaucauggaccugcauccggggagcggcaagacccgcaaguaucuccccgccaucgugcgagaggccaucaaacgccggcugcgcaccuuaauacucgcgccuacgcggguggucgccgccgagauggaagaagcccuaaaggggcuaccgauccgcuaccaaacuaccgccacaaagagugagcacaccgggcgggagaucguggaccucaugugucacgcgaccuucacuaugcgucugcucagcccggugcggguccccaacuacaaucucgucaucauggacgaggcgcacuucaccgaccccgcaagcaucgcggcacggggcuacaucagcacgagaguagguaugggcgaggcggcggccaucuucaugaccgccaccccgcccgggaccgcggaagccuucccccagucaaacgcacccauccaggaugaggagcgcgacauccccgagcgcaguuggaacuccggcaaugaguggaucacggauuucgucgggaagaccguuugguucgugcccagcaucaaagccggcaaugacaucgcgaacugcuuacggaagaacgguaagaaggucauccagcucucacgcaagaccuucgacaccgaauaccagaagacgcggcucaacgacugggacuuugugguaacaaccgacauaagcgagaugggcgcgaacuuuaaagccgaccggguaaucgacccccggcgcugccugaagcccguaauccugaccgauggcccugagcgggugauccucgcgggaccgaugccugucacggccgccuccgcagcacagcggaggggccgcguugggcggaacccccaaaaggaaaaugaucaguacauauucaccgggcagccccucaacaacgacgaggaccacgcccauuggaccgaggccaagaugcugcuagacaacaucaacacaccggaggggauaauccccgcccuguucgagcccgaacgugagaaguccgcggcaaucgacggcgaauacagacucaaaggugaguccaggaagaccuuugucgagcuaaugagacgcggggaccugcccguguggcuugcccacaaagucgccuccgagggcauuaaguauacagaccggaaguggugcuucgacggggagcgcaauaaccagauccuagaggagaacauggauguagagaucuggacgaaggagggcgagcggaagaaacugcgcccgcgauggcuggacgcgcggaccuacuccgauccucucgcccuaaaggaguucaaggacuucgccgccgggaggaaaagcaucgcccuggaccucgugacugaaaucgggcgggugcccucccaucuugcccaccgcacgcgaaaugcccuugauaaccucguuaugcuccacacauccgaacacggcggcagagccuaccggcaugcuguggaggagcugccggagacaauggagacgcuucugcugcucggccugaugauccuguugaccggcggggcuaugcuguuccugauaagcgggaaggggauaggcaagacuucaauagggcucaucugcgucauaguaaguuccggcaugcuuuggauggcggaugugccccugcaguggaucgccagcgccaucgugcucgaguucuucaugaugguccuccugauccccgagccggagaagcagcgcaccccgcaggacaaccaacucgccuacguggugaucgggauccugacccuggccgcgaucgucgcggccaaugagaugggacucuuagagacaaccaagcgggaccuggggauguccaaggagcccggagucgugagucccaccucguaccucgaugucgaccugcaccccgcuagcgccuggacccuguacgcgguggccacgaccguuaucacuccgaugcuccgccauaccaucgagaacuccacagccaacgucuccuuagccgcgaucgccaaccaggccgugguucuaaugggccucgacaaaggcuggcccaucuccaagauggaccuggguguaccccugcucgcccuggggugcuauagccaggugaacccccugacccucaccgccgcggugcuucugcucguaacccacuacgccaucaucggcccgggcuuacaggccaaggccacgcgggaggcucagaaacgcaccgcggccgguaucaugaagaaccccaccguggaugguaucaugaccaucgaccuggacccggugaucuacgacuccaaguucgaaaagcaguuaggccaggucaugcugcucgugcucugcgccgugcagcuauuacucaugcggacuagcugggcccuaugcgaggcucugacccucgcgaccggccccaucaccacacugugggagggcuccccggggaaguuuuggaauaccaccaucgccgucagcauggccaacauauuccgaggaucguaccucgccggugcaggccucgccuucagcaucaugaaguccguggggaccgggcguaggggcacugggagccagggcgagacgcugggugagaaguggaaaaagaagcucaaucagcucagccggaaggaguucgaccuguauaagaaguccggcaucacggagguugaccgcacagaagcaaaggaagggcugaagcggggcgaaaccacccaccacgcugucucgcgcggauccgccaagcuccagugguuuguggagcggaacauggugauccccgaggggcgcgucaucgaccuaggcugcgggcgcggcggguggagcuauuacugcgcaggccugaagaaggucacagaggugagaggcuauacaaagggcggccccgggcacgaggagccagucccaauguccacauacggcuggaacaucgugaagcucaugagcggaaaggacguguucuaucugccacccgaaaagugcgacacgcuccugugcgacauuggcgagucaucccccuccccgaccgucgaggagagccgcacaauccgggugcucaaaaugguggagccguggcuccgcaacaaccaguuuugcaucaaaguccugaaccccuacaugcccaccgucaucgagcaucucgagcgucuacagagaaaguacggcgggauguuagugcggaacccgcucucccguaacuccacgcacgaaauguacuggauuuccaacggcaccgggaacaucguuuccuccgucaacauggucagucggcugcuguuaaaccgcuuuaccaugacccaccgucgcccuacgaucgaaaaggauguggaccugggcgccggcacccggcacgugaacgcggagcccgagacaccgaauauggaugucauaggggagagaaucaagcggaucaaggaggagcacuccagcaccuggcauuacgacgacgagaaccccuacaaaacgugggcguaccacggcuccuacgaggugaaggcgaccgggagcgcgagcuccaugaucaauggcguugucaaacugcugaccaaacccugggacguggugccgauggucacccagauggccaugacugauaccaccccguucgggcaacagcgugucuucaaggagaagguggacacccguacaccccgccccaugcccggcacucggaaagucauggagaucaccgccgaguggcuguggcguacccugggccgcaacaagaagccgcggcuuugcacgagagaagaguucacgaagaaggugcggacgaacgccgccaugggugcgguguucacagaggagaaccagugggauagugcccgcgccgccgucgaggacgaggaguucuggaaacugguggacaaggagcgggagcuccacaaacucggcaagugcggguccugcguguacaacaugauggguaagcgcgagaaaaaguuaggggaauuuggcaaggcuaagggcagccgggccauaugguacauguggcugggggcccgcuacuuggaguucgaagcucugggauuccugaacgaggaccacugguucucccgagagaauagcuacucuggggucgagggcgaggggcugcacaaguuaggcuauauccugcgcgacauaagcaagauccccggaggggcgauguacgcugacgacacggccggaugggacacacggaucaccgaggaugacuugcacaacgaggagaagaucacccaacagauggaucccgggcaucggcagcuggccaacgccaucuucaagcugacguaccagaacaaaguugugaagguccagcgcccgacgccgaaggguaccgugauggacauaaucucccggaaggaccagcggggcagcggccaggugggcaccuaugggcuaaacaccuuuacuaacauggaggcacagcuaguccgccagauggagggcgagggggugcuuagcaaagcggaccuagaaaacccccaccuccuggaaaagaagaucacucaguggcucgaaacgaagggcguggagaggcuuaaacgcauggccaucagcggagacgacugcguagugaagcccaucgaugaccgguucgccaacgcccugcucgcccugaacgauauggggaaggugcgcaaggacaucccgcaguggcagcccucaaagggcuggcacgacuggcagcaaguccccuuuugcucccaccacuuucaugagcugaucaugaaagacgggcggaagcucguggugccgugccgcccccaggacgagcugauaggccgcgcgcggaucucccagggggccggcuggagccugaaggagaccgccugucucggcaaggcauaugcccagauguggagucugauguacuuccaccgccgggaucugcgccucgcgagcaaugcaauaugcuccgccguccccgugcauuggauccccacaagccggaccaccuggagcauccaugcccaccaccaguggaugacgacggaggacaugcugaccguauggaaccgcguguggaucgaggacaacccauggauggaggauaagacccccguuacaacgugggaggacgugccguaccuagguaagcgggaggaccaguggugcgguucccucaucgggcugaccagccgcgccaccugggcccagaacauccugaccgcgauccagcagguccggucccuuaucggcgacgaggaguuccucgauuacaugcccagcaugaagcgcuuucggaaagaagaggagacggagggugccaucugguga

SEQ ID NO: 26202 - RNA, 9873 nt, Artificial Sequence
  derived and/or modified CDS sequence (opt11) from DENV-3__EF643017__SS-prME
accagucugugccucaugaugauucugcccgcggccuuggcguuucacuugaccucgcgagauggggagccucggaugaucguggggaagaacgagcgcgguaagucguugcuguuuaagaccgccagcgggauuaauauguguacccucaucgccauggaucugggcgagaugugugacgacaccgucaccuacaagugcccccacaucaccgaaguggaacccgaggacauagacugcuggugcaaccugaccucuaccugggugacauacggcacgugcaaccaggccggggagcgccggcgggacaagcgcagcguugcccucgcuccccacgugggcaugggguuggacacccggacccagaccuggaugagcgccgagggcgccuggcgucagguggagaaggucgaaacgugggcacugcggcacccgggguuuaccaucuuagcuuuauuucucgcucacuacaucggcaccucccucacucagaaggucgugaucuuuauccugcugaugcucgucaccccgagcaugaccaugcgcugcguggggguggguaaucgagacuucguugaaggguuauccggggcgacuugggucgacgucgucuuagagcacggugggugcgugacgacgauggccaagaacaagcccacauuagacaucgagcugcagaagacugaggccacccagcuggcuacgcuccgcaagcugugcaucgagggcaagauaaccaauauaacaacugauucuaggugccccacgcagggagaagccguguugccagaggagcaggaccagaacuacgucugcaagcacaccuauguggaccgcgggugggguaacgggugcggccucuucggcaaaggcucccuggugaccugugccaaguuccagugccuggagcccaucgaaggcaaggucgugcaguacgagaaccucaaguauacggucaucaucacuguccauacgggagaccagcaucaggugggcaacgagacccaggggguaaccgccgagaucacuccccaagcuagcaccacggaggcuauccugccggaguacggcaccuuagggcucgagugcagcccgcguacuggccuggacuucaacgagaugauccugcuaacgaugaagaacaaggcauggauggugcacaggcagugguucuuugaucugccccuucccuggaccagcggcgccacaaccgagacgcccaccuggaaccggaaagagcuccuggugacauucaaaaacgcucacgcaaagaaacaggaagucguggugcuggggucccaggagggcgcaaugcacaccgcuuugacgggggcaaccgagauccagaacaguggcggcaccucgaucuucagcggccaccugaagugccgccugaagauggacaagcucgagcugaagggcauguccuacgccaugugcaccaauacguucguccugaagaaggaggugucagaaacccaacacgggacgauccucaucaagguagaguaucggggcgaggacgcgccuugcaagauccccuucagcaccgaagacgggcaaggcaaagcgcacaacggccgccugaucacggccaaccccguugugacgaagaaggaggagcccgugaacauugaggccgagccgcccuucggggaguccaauaucgucaucggcaucggggacaacgcccugaagauaaacugguacaagaaggggagcagcauugggaagauguucgaggcgaccgcacgaggagcccgucgcauggccaucuuaggugacacagccugggacuucgggagcgugggcggggugcucaacucacugggcaagaugguccaucagaucuucgggagcgcguacacggcccuguucaguggcguaagcugggucaugaaaaucggcaucgggguccucuugaccuggaucgggcugaacuccaaaaauacuagcauguccuuuagcugcauugccauagggaucaucacccucuaccugggcgcagugguucaggcggacauggggugcguaauaaacuggaaaggcaaggagcugaagugcggcuccgggauuuucgugacuaacgaggugcacaccuggaccgagcaguacaaguuucaggcugacagccccaagcggcucgcgaccgccauagccggcgccugggagaacgggguuugcggcauccgcuccacgacacggauggagaaccugcuguggaaacagaucgcgaacgaguuaaacuacauccugugggagaauaacauuaagcuaaccguuguggucggggacaucauaggcgugcucgaacagggcaagagaacccuuacgccccagccgauggaacugaaguacagcuggaagaccuggggaaaggccaagauagugaccgccgaaacccaaaauucguccuucauuauagauggccccaacacccccgaaugccccagcgccagcagggccuggaacgucugggagguugaggacuacggguucggcguguucaccaccaacauauggcucaagcugagagaggucuacacacagcugugugaccaccgacuuaugagcgccgccgugaaggacgaacgagccgugcacgccgacaugggcuacuggaucgagucccaaaagaaugggucuuggaagcuggagaaggcgucccugaucgagguuaaaaccuguacguggcccaagucccacacccucugguccaacggggugcuggagagcgacaugaucacgcccaagucccuggccgggccuauuucacagcacaaccaccggccgggcuaucacacccagacggccgggcccuggcaccucggcaagcuggagcucgacuucaacuacugugaggguaccacgguggucauaaccgagaacugcgggacgcgaggccccucccucaggacaacaacggucagugggaaacugauccaugaguggugcugcagauccugcacgcugcccccgcuccgguacaugggcgaagacgggugcugguacggcauggagauccguccaauuagcgagaaggaggaaaacaugguaaagucccugguaagcgcuggcuccggcaagguugacaacuuuaccauggggguucuguguuuagccauccucuuugaggaggucaugcgggggaaguucggcaagaagcacaugaucgcggggguguucuucaccuuugugcuacuccugagcggccaaauaaccuggcgcgacaugacacacaccuugaucaugaucggcuccaacgccagcgauagaauggggaugggcgucaccuaccucgcccugaucgcaacguucaagauacagcccuuccuggcccucggguucuuucugcgcaaacugacgagccgggagaaccuucuccugggcgugggccucgcgauggcgaccacacugcagcugcccgaggacaucgagcaaauggccaacggcaucgcccucggccugauggcgcucaaacucaucacacaguucgagacguaccagcuguggaccgcccugaucucgcugaccugcagcaacacgauguucacccugacugucgcuuggcgcaccgccacccugauccucgcuggagucucccugcuaccagugugucagagcuccucuaugcgcaaaacggacuggcucccaauggcgguagcggccaugggcgugagcccccucccccucuuuaucuucagccucaaggacacccugaagcgccgcuccuggccgcugaacgagggggugauggcagucggccucgugagcauccuggccuccagccugcucaggaaugacguccccauggcuggcccucuggucgccgggggccugcucaucgccugcuacguaaucaccgggacuuccgccgaccugacgguggagaaggccgcggauauaacccgcgaggaggaggcagagcaaacuggugucagccacaaccuaaugaccaccguggacgaugacggaacuaugcggauuaaggacgaugagaccgagaauaucuugaccguguuacugaagacagcauuacugaucguaaguggcguauuucccuacagcaucccggccacgcugcucguguggcauacuuggcagaaacagacccagcgcuccggcguucucugggacgugcccuccccgcccgagacccagaaggccgagcuagaggaggggguguaccggauuaagcagcaaggcaucuucgggaaaacucaggucggcgugggggugcagaaagagggcgucuuccacaccauguggcacgugaccagaggggcggugcucacauacaacgggaaacggcuggagccgaacugggccuccgugaaaaaggaccugaucucguacggcgggggauggcgccucagcgcccaguggcagaagggggaggagguccaggugauagcugucgagcccggcaagaacccuaagaacuuccaaacgaugccuggcaccuuucagacgaccaccggggagauuggugcgauugcccuggacuucaagccggggacgucugguucucccaucaucaaccgggagggcaaggugguggggcuauacgguaacggagucgucaccaagaacggcggguacgugaguggcaucgcccagaccaaugccgagcccgacgguccgacgccggaacuggaggaggagauguuuaagaagcguaaucucaccaucauggaccugcaccccgguagcggcaaaaccaggaaguaccugcccgccaucgucagggaggcaaucaagcggcgccuucggacccugauccuggccccgacucgcguugucgccgccgagauggaggaggcccuuaaggggcugcccauucguuaccagacaacagcgacuaaguccgagcacacggggcgcgagaucgucgaccugaugugccacgccaccuucaccaugcggcuccugagcccagugcgcgugccaaacuauaaccugauaauaauggaugaggcccacuucaccgacccggccuccauagccgcgcggggguacaucucuacgcgagugggcaugggcgaagcugcagcuaucuucaugaccgcgacgccgccggguaccgccgacgccuucccccaauccaacgccccgauccaggacgaggagcgcgacauacccgaacggagcuggaacuccggcaacgaguggaucacggacuuugccgggaagacagugugguucgugccuagcaucaaggcgggcaacgacaucgcuaacugcuuacgcaagaacgggaagaaggucauccaguuaucccggaagaccuucgacacugaguaccagaagaccaaacuuaacgacugggacuucgucguaaccaccgacauuucggagaugggcgccaacuucaaagccgacaggguuaucgauccccggcgcuguuuaaagccggugauccugaccgacggccccgagcgggugauccuggcagggccaaugcccguuaccgccgccucggccgcucagcggcggggccgcgucgggcggaacccgcagaaggagaacgaccaguacaucuuuacgggacagccccucaacaacgacgaggaccacgcacacuggaccgaagcgaagaugcuccuggacaacaucaacaccccggagggaaucauacccgcgcuuuucgagccggaacgcgagaaauccgccgccaucgacggcgaguaccgucugaagggcgagucccgcaaaaccuucguggagcucaugcgaagaggggaccucccggucuggcucgcgcacaagguggccagcgaaggcaucaaguauacggaucggaagugguguuucgacgggcagcgcaacaaccagauccuagaagagaacauggacguagagaucuggaccaaagaaggagaaaagaagaagcuccgccccagguggcuggacgcccgcacauacuccgacccacuggcccucaaagaguuuaaggacuucgccgcgggccgcaaaagcauugcauuggaccuggugacggagaucgggcgcguucccagccacuuagcccaccggacgcgaaacgcgcuggauaaccuggucaugcugcacacguccgagcacggcggucgggccuaucgccacgccguggaggagcugcccgagacaauggagacucuucuccugcugggccuaaugauccuacuuaccggcggggccaugcuguucuuaaucagcgggaaggggaucggaaagaccuccaucgggcuaauuugcgucauagccagcuccggaaugagcuggauggcagagaucccccuccaauggauagccuccgcgauagucuuagaguucuucaugaugguacugcucaucccugagcccgagaagcaacggacgccccaggauaaccaacuggccuacgugguaauagggauccugacccucgcugccaucauugcggccaacgagaugggccuccuagaaaccacgaagcgagaucucgggaugagcaaagagcccgggguggugucuccuacaagcuacuuagacgucgaccugcaucccgccucggccuggacucuuuacgccgucgcgacgaccgugaucacccccauguugcggcacaccaucgagaacuccacggcgaacguuucucuggccgcuaucgccaaucaagcugucgugcuaaugggucuggauaaggguuggcccaucagcaagauggaccugggcgugccgcuccuggcccuugggugcuacagccaggugaacccacucaccuuaaccgccgccgugcuguuacugaucacacacuacgccaucaucggucccggcuugcaggcuaaagccacgcgcgaggcccagaagcggacugccgccggcaucaugaagaaucccaccgucgauggcaucaugacaaucgaccuagacccggugaucuacgacucgaaauucgagaaacaacugggccaggugaugcugcucguucuaugugcggugcagcuucuccucaugcggacguccugggcucugugcgaagcccucacgcucgcgaccggucccaucaccacacuuugggagggcagccccgggaaguuuuggaacaccaccaucgcgguguccauggccaacaucuuccggggcagcuaccucgccggggucgggcuggccuucagcaucaugaaauccgugggaaccggaaagcgcggcacggguagccaaggcgagacucugggggaaaaguggaagaagaaacucaaccagcugucccgaaaagaguucgaccuguacaagaaguccggcaucaccgagguagaccguaccgaggccaaggaggggcucaagcggggcgaaaucacccaccaugcggucucccggggcagcgccaagcugcaaugguucguggaacggaacaugguaauccccgagggacgcgucaucgacuuaggcugcggucgcggcggaugguccuacuacugcgccggccucaagaaagugacugaggugcguggcuacaccaaaggcgguccggggcacgaggagcccgugcccaugucaaccuaugguuggaacauuguuaaguuaauguccgggaaggacguauucuaucugccgccggagaagugcgacaccuuacuaugugacaucggagaauccucgcccucucccaccgucgaggagucccgcaccauccggguuuuaaaaaugguggagcccugguugaagaacaaccaguucuguaucaagguccucaacccguacaugcccacaguaaucgagcaccuggaacgccugcagaggaaacauggcgggaugcuugugcgcaauccccugagcagaaacuccacccacgagauguauuggaucagcaacggcacagggaacauaguagccuccgugaacauggugagccgccugcuccugaaucgguucacuaugacccaucgucggccgacaaucgagaaggacguggaucugggcgccggcacuaggcacgugaaugcggagccagagacacccaacauggacguaauuggagaacgcaucaagcgcaucaaagaagaacacaacucaaccuggcacuaugacgacgagaaucccuacaagacgugggccuaccacggaagcuacgagguuaaggccaccgggucugcauccaguaugaucaacggcguggucaagcuccugacaaaaccgugggacguggugcccauggucacccaaauggcaaugaccgauacgacccccuucgggcaacaaaggguguuuaaggagaaaguggacacccgcacaccacggucaaugcccggcacgcgccgggucauggguaucacagcggaguggcuguggcgcacacuggggcgcaacaagaagccuagacuguguacgcgcgaggaguuuacuaagaaaguucggacuaacgccgccaugggcgcuguauucaccgaggaaaaccagugggauagcgcgaaagccgccguagaggaugaggacuucuggaagcugguggaccgagaacgggaacuccacaagcuggggaagugcggguccugcgucuacaacaugauggggaaacgcgagaagaagcucggcgaguucgguaaggcuaaaggaucccgcgccaucugguacauguggcugggcgcgcgcuaccuggaguuugaggcccuggguuuccucaacgaagaccacugguucucccgggaaaauucauacuccggcgucgaaggagagggccugcacaagcugggcuacauccuccgcgacauuagcaagauucccggaggcgcaauguacgccgacgacaccgcagggugggacacccggaucaccgaggacgaccugcacaacgaagagaagauaacccagcaaauggaccccgagcaccgccaacuggcgaaugccaucuucaagcucaccuaccagaacaagguggugaagguccagcggccuacacccacgggcaccgugauggacaucaucucccggaaggaccagcgggguucgggccaggugggcaccuacggccuaaacacuuucacgaacauggaggcccagcugauccgccagauggagggcgaggggguccucuccaaggccgaccuggagaacccccaucuccccgaaaagaaaaucacacagugguuagaaaccaagggcguggagcggcugaagcguauggccaucagcggggacgacuguguggucaagccgaucgacgaccguuucgcgaacgcccuuuuagcucugaacgauaccgggaaggugcgcaaggauaucccccaguggcagcccuccaaaggcuggcacgacuggcaacaaguccccuuuuguucucaucacuuccacgaguugaucaugaaggaugggcggaaacucgucguaccgugccgcccgcaggacgagcugaucggccgcgcccgaaucucccagggggccggguggagcuugcgugagacggcaugccucggcaaggccuacgcacagauguggucccugauguacuuccaccggcgagaccugcggcucgccagcaaugcgauuugcagcgccgugcccguccauuggguacccaccucucgcaccaccuggagcauccacgcucaccaccaauggaugacaaccgaggacaugcuaaccguauggaaccgggucuggaucgaggacaacccguggauggaggacaagacccccgugacgacaugggagaacgugcccuaccuggggaagcgcgaggaccagugguguggcucauuaaucggguugaccagccgggccaccugggcccagaauaucccuacagcgauccagcagguccgcucccugauaggcaacgaggaguuccucgacuacaugccaagcaugaaacgguuccgcaaggaggaggagagugagggggccaucugguga

SEQ ID NO: 26203 - RNA, 9873 nt, Artificial Sequence
  derived and/or modified CDS sequence (opt11) from DENV-3__DQ675519__SS-prME
accuccaucugccugaugaugaugcuccccgcaacccuggcguuccaccugaccagcagggauggcgagccccguaugauuguggguaagaacgaacgcgggaagagccuccuguucaaaaccgccuccggcaucaacaugugcacccugaucgcgauggaucucggcgagaugugcgacgacacagugaccuauaaguguccucugaucaccgagguagagcccgaggacaucgacugcuggugcaaccuuaccagcaccuggguaacauauggcaccugcaaucaggcgggcgagcaccggcgagacaagcguucgguggcccuggcgccccacgugggcauggggcuggauacccgaacacagacuuggaugagcgcggaaggcgccuggagacaagucgagaagguagagaccugggccuuccgccauccgggguucacaauccuagcccuguuccuugcgcacuacaucggaaccucccugacacagaagguggugaucuuuauccucuugaugcuggugacacccagcaugaccaugcggugcgucgggguaggcaauagagacuucgucgagggccucuccggugcuaccuggguggacguuguccuggaacacggcgggugcguaaccaccauggcuaagaacaagcccacgcuagacaucgaacuucaaaagacggaggccacgcagcuggccacgcugcgaaaguuaugcaucgaagguaaaaucaccaacgugacuaccgacagccgcugucccacccagggugaagcgauccugccggaggaacaggaccagaacuacgugugcaagcacaccuacguggaccgggggugggggaacggguguggccuauucgggaaagguucgcucgucaccugugcgaaguuucagugccuggagagcaucgaggguaagguugugcagcaugagaaccugaaguauacggugauaaucacgguccauacgggagaccagcaccaggugggcaacgagacgcaggggguaacugcugaaaucacgccccaggcuucuaccguugaggccauccuaccugaguacggaacccuggggcuggagugcaguccucgaacaggccucgacuucaacgaaaugauccuacugacgaugaagaauaaagcguggaugguacaccggcagugguucuucgaccucccucugcccuggacguccggagccaccacugagacgccgaccuggaacaagaaggagcuucucgucacguucaagaacgcccacgccaaaaaacaggaggugguagucuuagggagccaggaaggcgcuaugcacaccgcgcuuaccggggccaccgagauccagaccuccggaggaacuagcauauuugcuggccaucuuaagugccgccugaagauggacaagcuggagcuuaagggcauguccuacgcgauguguuuaaacgcuuucgugcugaagaaagaagugucugagacucaacaugguaccauccucaucaagguggaguacaagggugaggacgcgcccugccggaucccguucagcaccgaggacgggcagggcaaagcccacaacggacgccuuaucaccgccaacccagucgugacgaagaaggaggagccagucaacaucgaggcggagccuccguucggggaguccaacaucgugaucggcaucggggacaaggcgcugaagaucaacugguacaagaagggcagcaguaucgggaagauguucgaggcaaccgcccggggugcccgccggauggccauccucggugauacugcaugggacuucggaagcguuggaggggugcucaauucccugggcaagaugguucaucagaucuuuggguccgccuacacagcacucuuuuccggugugucauggaucaugaaaaucggcaucgggguccuccugacguggauuggacugaacuccaagaacaccagcaugucauucagcugcaucgugauagggaucauaacccucuaccugggcgcaguaguccaggccgauaugggcugcgugaucaauuggaaggggaaggaguuaaagugcggcaacgggaucuucguaaccaacgagguucauacuuggaccgagcaguacaaguuccaggcggacucgcccaagagacuggccacugccaucgccggcgcgugggagaacgggguuugcgggauccgcucgacuacgcggauggagaacuuacucuggaagcagaucgcuaacgagcucaauuacauucugugggagaacaacaucaaguugacgguggucguuggagacaucauuggcgugcucgagcagggcaagaggacccuuacuccccagcccauggaauuaaaguacuccuggaagacgugggggaaagccaagauaguaacggcugagacccagaacaguagcuucauaaucgacgguccgaacacacccgagugccccagugccaguagagcguggaaugugugggagguggaggacuacggguucggggucuuuacgaccaacaucuggcucaagcugcgcgaaguguacacccaacucugcgaccaccggcugaugagcgcggccgugaaggacgaacgcgccguucacgcggauaugggcuacuggauagagucacagaagaacggguccuggaagcucgaaaaggcgucacugauagaagugaagaccugcacuuggccgaaaucccauacuuuauggucaaacggcguguuggaauccgacaugauuaucccaaagucgcucgccgggccuauaucccagcacaaccaccggcccggcuaccauacccagacagcggggccguggcaccucgggaagcuggaacuggacuuuaacuauugugaggguaccacgguggugaucaccgagaacugcgggacccgcggccccucgcuucgcaccaccaccguguccgguaaguuaauccacgaguggugcugucgcagcugcacccuaccgccccuccgguacaugggcgaagacggaugcugguacggcauggaaauccgcccgaucaacgaaaaggaggagaacauggucaagucccuggucagcgcgggcuccggaaagguggauaacuucacuaugggcguccuuugccucgccauucuguucgaagaggucaugcgggggaaguucggaaagaagcacaugauagcgggggucuuauucacguucgugcuccugcugagcgggcaaaucaccuggcgcgacauggcacacaccuugaucaugaucggcuccaacgccagcgaccggauggggaugggagugacguaccuggccuugaucgccacuuucaagauacagcccuucuuggcccugggauucuuccugagaaagcucacgucacgggagaacuuacugcucggugugggccuugcgauggcgaccacccugcagcuucccgaggacaucgagcagauggccaacggggucgcgcugggccuaauggcccuaaagcuuauaacacaguucgagaccuaccaguuauggaccgcccucgugagcuugaugugcagcaacacuauauuuacgcugaccgucgcuuggcgcaccgcaacauugauccuggcgggcauauccuugcucccggucugccagagcuccagcaugcggaagacggauuggcuuccgaugacuguggcggccaugggcgugccgccucugccacucuucaucuucucccugaaagauacccugaagcgucgcaguuggccgcucaacgaaggggucauggcuaucggucugguauccauccuggccucgucccuacugcggaacgacguacccauggcgggcccgcucgucgccgggggccuccugaucgccuguuacgugaucacugggacgucggccgaccugaccgucgaaaaggccgcggacgugacuugggaggaggaggccgaacagaccggcgugucccacaaccucaugaucaccgucgacgacgaugggacgaugcgcauaaaggacgacgagaccgaaaacauucuaaccguccuguugaagaccgcccuacugaucguuucagguaucuuccccuacuccauaccggccacgcuccuggucuggcauacauggcagaagcagacccagcggucuggcgugcuaugggacgugccuagcccgccggagacccagaaggcugagcuagaggaggggguuuaccgcaucaagcagcaagguaucuucgggaaaacacagguuggcguagguauccagaaagagggcgucuuccauaccauguggcaugugacccggggcgcggugcugacccauaacgggaagcgccuggagccgaacugggccucggucaaaaaggaccuuauuaguuacggcgggggguggcgguugagcgcacaguggcaaaagggggaggagguccaggugaucgcagucgagccugguaaaaaccccaagaacuuucagacgaugcccggcauauuccagacgaccaccggggagaucggcgcgauagcucuggacuucaagccggggacauccggaucacccauaauaaacagagaggguaaggugguggggcucuacgguaacggcgucguuacaaaaaacggcggauacgugagcgguaucgcccagaccaacgcggagcccgacggcccgacccccgaacuagaggaggagauguucaagaagcguaaucuaacuaucauggaccugcaccccggguccggcaaaaccagaaaguacuuaccgaccauagugagggaggcuaucaagcggcggcugcgcacucugauacucgcgccuacgcggguaguggccgccgagauggaggaggcucugaagggguuaccaauucgcuaccagaccaccgcuacuaaaagcgagcauacgggaaaggagaucgucgaccucaugugucacgcgaccuucacaaugcgccugcugucccccgugcgcgugccaaacuacaaccugaucaucauggacgaggcccacuucacugauccggccucuaucgcagcccggggguauaucagcacgcgaguuggaaugggagaggccgccgccauuuucaugaccgccacuccgccugggaccgcggacgcuuucccccaaagcaacgccccgauacaggacgaggaacgggacaucccagagcgcuccuggaacagcggcaacgaguggaucacggacuucguaggaaagaccguuugguucguccccucgaucaaggccggcaacgacaucgcuaacugccuccgcaagaacgggaagaaggugauccaacugagccggaagacauucgacacagaguaccaaaagacuaagcucaacgacugggauuucguggucaccaccgacauuuccgagaugggagcgaauuuuaaggccgacagggugauagacccccggcguugcuugaagccggugaucuugaccgauggccccgaaagagucauccucgcugggccaaugcccguaacgguggccagcgcagcgcagcgccggggcagagucgggcggaacccccagaaagagaacgaccaguacauauuuacuggccagccgcugaacaaugacgaggaucacgcucacuggaccgaggccaagauguuacuagauaauaucaacacccccgaggggaucauccccgcccuguucgagccggagcgugagaaaagugccgcgaucgacggcgaauacagacugaagggcgaaucacgcaagaccuucguggagcucaugcggcguggggaucuacccguuuggcuggcgcauaagguggccucagagggcaucaaguauacggaccggaaauggugcuucgacggcgagcggaacaaccagaucuuggaggagaacauggacguugagaucuggacgaaggagggugagaagaagaagcugcggccccgauggcuggacgcccggacuuauagcgaucccuuagcccuuaaagaguuuaaagacuucgccgccggaagaaagucuaucgcgcuggacuugguaacagagaucggacgcgugccgagccaccuggcguaucggacgagguccgcgcuggacaaucucgucaugcuacacaccagcgagcacggaggccgggcguaccgccaugcaguagaagaacugcccgagaccauggagacccuccugcuuuuaggauugaugauccugcuuacagguggggccauguuguuccugauaagcggcaaggggauuggaaaaacauccaucggccucaucugcgugguggcaucgucuggcaugcuguggauggcugacgucccacugcaguggaucgccagcgccauugugcucgaguucuucaugaugguccugcugaucccagagcccgagaagcagagaacaccccaagacaaccagcucgccuaugucgugaucggcauccugacccuggccgcaauuguagccgcaaacgagaugggccucuuggagacgacgaaacgggaccugggcauguccaaggagccaggggucgugagcccgaccuccuaucucgauguagaucugcaccccgccagcgccuggacacuguaugcgguugccacgaccguaaucacacccaugcuccggcacaccauagagaacucaaccgccaaugugagcuuagccgcaaucgccaaccaagccguagugcugaugggucucgacaagggguggcccaucuccaagauggaucugggcgucccccugcucgcacugggaugcuacagccagguaaacccucugaccuuaaccgccgcgguacugcuccucgugacgcacuacgcuauuaucggacccggcuugcaggccaaggccacgcgagaagcccagaagcggacagcggcagggauuaugaagaaccccaccgucgauggcaucaugaccauagaccuagacccgguaaucuaugacaguaaguucgagaagcagcucggccaggugauguuauuaguacucugugccgugcagcuguuacuaaugcgcaccucaugggccuucugcgaggcacugacccucgcgaccggcccaaucacaacguugugggaaggcucccccgggaaguuuuggaacacgaccauugcuguguccauggcaaacaucuuccguggcuccuaccuggccggcgccggccuggccuucaguaucaugaaguccguggggaccggcaaaaggggcaccgguagccagggagagacucucggggagaaguggaaaaagaagcugaaucagcugagccggaaggaguuugaccucuacaagaaguccggcaucacugagguugaccgcaccaaggccaaggaaggacucaagcggggcgagaccacgcaucacgccgugagcagagggucugccaagcugcagugguucgucgaaaggaacauggugauucccgaggggcgggugauugacuuagguugcgggcggggcggguggagcuacuacugcgcggggcugaagaagguuaccgaggugcgcggcuacaccaagggcggacccggucacgaggagcccgugccaauguccaccuauggcuggaauaucgucaagcugaugucaggaaaggacguauucuaccucccgcccgagaaaugcgacaccuuacugugcgacauuggcgagagcagccccucgcccaccguagaggagagccggaccauucgcgucuugaagaugguggagcccuggcucaagaauaaccaguucuguaucaaggugcugaacccauacaugcccacagucaucgagcaccucgagcgccuccagcgcaaacacggugggauguuggugcgcaacccccugucccggaacagcacgcacgaaauguacuggauuuccaacggcaccgggaacauagugagcuccgucaacaugguuagccgcuuacuccugaaccgauucacuaugacccacaggcgacccacuaucgagaaggauguugaccucggcgccgguacccgccacgucaaugccgagccugaaacccccaacauggacgucaucggggagcguauccgccguauuaaagaggaacacuccuccacauggcacuaugacgacgagaacccauauaagacgugggcauaccacggcucauaugagguaaaagccacggggucugcgagcuccaugauuaacggcguggucaaguuacugaccaagccgugggacgucgugcccaccguaacucagauggcuaugaccgacaccacccccuucgggcagcagcgcguauucaaggagaagguggauacgcgaacgccccgcccuaugcccggaacccggaaggucauggaaaucaccgccgaguggcuauggcgcacccugggucgaaauaagcgcccgcgucugugcacacgcgaagaguucaccaagaagguccgcaccaacgcugccaugggggcaguguucacggaagagaaucagugggauagcgcacgggccgcgguggaggacgaagaguucuggaagcuugucgaccgugagcgggaacugcacaaacugggcaagugcggguccugcguguacaacaugaugggcaagagagagaagaaacucggggaguuugggaaggcgaagggcucucgggcgauaugguauaugugguuaggggcccgguaccuggaguuugaagcccucggcuuccugaaugaggaccacugguucucaagagagaacagcuacucaggcguggaaggcgaggggcuccacaaguuaggguacauauuacgcgacaucagcaagacacccggaggggccauguacgcggacgauaccgccggcugggauacucggaucacggaggacgaccugcauaacgaggagaagauuacccagcagauggaucccgagcaccgccaacucgccaaugcuauuuucaaacuuaccuaccagaacaaggucgugaaggugcagcggcccacacccaaagggaccgucauggacaucauuucccgcaaggaccagaggggcagcggccagguugguacauacgggcugaacacauucacuaacauggaggcccaauugauccgccagauggagggggaaggcgugcuguccaaagcggaccuagagaacccccaucucccggagaagaaaaucacccaauggcuggagacgaagggggucgagcgacugaagcgcauggccaucagcggcgacgauugcguugugaaacccaucgacgaccgguucgccaacgccuuacuggcccugaacgacaugggcaaaguucgcaaggacaucccccaguggcaacccuccaaaggcuggcacgacuggcaacaggugccguuuugcucucaccacuuccacgaguuaauuaugaaagacggccggaagcuggugguacccugucgcccccaggacgagcugauaggccgggcgcgaaucucccagggugcgggguggagcuuaaaggagaccgccugccugggcaaggccuacgcgcaaauguggucccugauguacuuccaccgccgggaccugcgccuggcgucgaacgcuaucuguucggcugugccggugcacugggucccgaccagcagaaccacgugguccauccacgcccaucaccaguggaugacaaccgaggacauguuaaccguguggaaucgcguuuggaucgaggacaaccccuggauggaagacaagacccccguaaccacuugggaggacgugcccuaccuaggcaagcgggaggaccaguggugcgggucucugauaggccugaccucucgcgcaacgugggcacagaacauccucacagccauccagcagguccggucccugaucgggaacgaggaguuccuggacuacaugccguccaugaagcguuuucggaaggaagaggaauccgagggcgccaucugguga

SEQ ID NO: 26204 - RNA, 9873 nt, Artificial Sequence
  derived and/or modified CDS sequence (opt11) from DENV-3__DQ675521__SS-prME
accagcuuuugucugaugaugaugcuccccgcgaccuuagcguuccaccugacgucccgggacggcgaaccgcggaugaucgucgggaagaaugagcgaggcaagagccuccucuucaagaccgcguccgggaucaauaugugcacgcugaucgccauggaccucggcgaaaugugcgacgacacggucaccuauaagugcccccugauugccgagguggagccugaagacaucgauugcuggugcaaucugaccagcacgugggugacguacgguacgugcaaccaggccggcgagcaccggcgcgacaaacggagcgucgcccucgccccacacgugggcauggggcucgacacccgcacccaaaccuggaugucugccgagggcgccuggcggcagguagagaagguagagacgugggcgcugcgccauccuggguucaccauuuuagcguuauuccucgcccacuacaucgggacuucccucacccagaaggugguaauuuucauccugcuaaugcuagugacgccaagcaugacuaugcgguguguggggguuggcaaccgagacuucguugaaggccuguccggggccacuuggguggacgugguccuggagcacggcggcugcgugaccacgauggccaaaaacaagcccacccucgauaucgagcugcagaagaccgaggcuacacaguuggcaacacuccggaaguugugcaucgagggcaagaucaccaacaucacaaccgauagccguugccccacgcaaggcgaggccaucuugccggaggagcaggaccaaaacuacgugugcaaacacaccuacguagaccggggguggggcaacggguguggccucuuuggcaagggcagccugguuaccugugccaaguuccagugcuuagagcccaucgaggguaaggugguccaauacgagaaccucaaauacacggugauaauaacggugcacaccggggaccagcaccaggucgggaacgacacccagggcgucaccguugagauuacgccccaggcaagcaccguggaggccguacugccggaauacggcacccucgggcucgagugcuccccgcgcaccggguuagauuucaacgaaaugauucugcucacaaugaagaacaaggcguggaugguucaccggcagugguucuucgaucugccccugcccuggacaucuggggccacaaccgagacucccacguggaaccgcaaagaacuucugguuacauucaagaacgcccacgcaaagaagcaggaagugguggugcuggggucccaggagggggcaaugcacaccgcuuugaccggugccacggagauacagaauagcggcgggaccuccauauucgccggacaccuaaagugucggcugaagauggacaagcucgagcugaagggaaugagcuacgccaugugccugaacaccuucguucugaagaaggagguguccgagacccagcacgguacgauuuuaauaaagguggaguacaagggcgaggacgccccaugcaagauccccuucagcaccgaggauggucagggcaaggcgcacaauggucgacugaucacggccaaucccguggucaccaagaaggaagaacccgugaacaucgaagccgagccacccuucggggagagcaauaucgugaucggcaucggagauaaggcccugaaaauuaacugguauaagaaaggcagcagcaucgggaagauguucgaggcgacagcccggggcgcccggcggauggccauacucggcgacacugccugggacuuuggguccgucggcggggugcugaacucacugggcaagaugguucaccaaaucuucggaagcgcguacaccgcccucuucagcggcguauccuggaucaugaagaucgggaucgggguccugcugaccuggauugggcucaacucgaaaaacacguccaugaguuucucuugcauagucaucgggaucaucacccuguaccugggcgccguugugcaagcggauauggggugcgugaucaacuggaagggcaaggagcucaagugcggcagcgguaucuucgucacgaacgagguucacaccuggacggagcaauacaaguuccaggccgacucacccaagcguuuagccaccgccaucgcuggcgccugggagaacggcgugugcggaauccgcagcacaacacggauggagaaccugcuguggaagcaaauugccaacgagcugaauuacauccugugggagaacaacaucaaacucacggucguugugggggacaucauaggcguccuggaacaggguaagcgcacccuuacaccccagccgauggagcucaaguacucauggaagaccugggggaaggcgaagauagugacugccgagauccagaacaguagcuucauuaucgacggccccaacacacccgaaugccccagcgccucacgggcauggaaugucugggaggucgaggacuacggguucggcguuuucacgaccaacaucuggcugaaguuacgcgaaauguauacgcaguccugcgaccaccgguuaaugagcgcagccaucaaagacgaacgcgccgugcacgccgacaugggguacuggaucgagucccagaagaacgggagcuggaagcuagaaaaggcauccuucaucgaggucaagaccugcacguggccgaagucucacaccuuaugguccaauggcgugcucgagagcgacaugaucaucccgaaguccuuggcagggcccaucagccagcauaaccaccggccgggauaccacacccaaacggccgggcccuggcaccugggcaagcucgagcuggauuuuaacuacugcgaggguacaacugucgugauuacggagaacugcgggacgcgcggccccucccugcggaccaccaccguaucugggaagcucauccacgaguggugcugucgcuccuguacuuugcccccguuaagguacaugggugaggacggcugcugguacggcauggagauccgccccauaaacgagaaggaggagaacauggugaaaagccucgucucagccggcagugggaagguggacaauuucaccaugggcguacugugccuggccauccucuucgaggaggucaugcggggaaaguucggaaagaagcacaugaucguggggguacuguucaccuucguccugcuucugagcggccagaucaccuggcgugauauggcccacacgcucauaaugaucggcagcaacgcgucggaccggaugggaaugggcgugaccuaccuugcccugauugccacuuuuaaaauacagcccuucuuagcccucggguucuuucugcgcaaacugaccagccgagagaaccuacugcugggcgugggccucgccauggcgaccacccugcaacugcccgaggauaucgaacagauggcaaaugggaucgcccucggccugaugacccugaagcucaucacucaguucgagaccuaucagcuguggaccgcccugguaagccuaaccugcuccaacacuaucuucacacuuaccguggcuuggcgcaccgcgacccugauccucgccggggucucacugcugccguugugccaguccagcaguaugcgaaagaccgacuggcuaccaaugaccguggcggccaugggggugcccccuuuaccacucuucaucuucagcuuaaaggacacucccaaacgccgcuccuggccucugaacgagggggucauggcggugggccucguuagcauucuggccaguagccugcuccggaacgaugucccuauggccggcccccugguggccggaggccugcucauugcuugcuacgugaucaccgggacguccgcugaccugaccguggagaaggcggccgacguuaccugggaggaggaggccgagcagacgggcgugagccacaaccugaugauaacgguagacgaugacgggaccaugcgcaucaaagacgacgaaaccgaaaacauccucacuguguugcugaaaacagcucuccugauaguuucuggcaucuucccuuacagcauacccgcgacgcugcucgucuggcauaccuggcaaaagcagacccagcgguccggcguauugugggaugugcccagcccgcccgagacccagaaggccgagcuggaggagggggucuaucgcaucaaacagcagggcaucuucgggaagacacaggugggcguggggguccagaaagaagggguguuccacaccauguggcacgucacccgcggcgcuguccucacccacaacggaaagcggcuggagcccaauugggccuccgugaaaaaggaccuaauaagcuauggcggaggguggcggcuauccgcccaauggcagaagggggaggagguacaggucauagcgguggagcccggcaagaauccgaagaacuuccagacgaugcccggcauuuuccagaccaccacaggcgagaucggggccaucgcccuggacuucaagcccgggaccucggggagcccgaucauaaaccgcgaggggaagguggucggucuuuauggcaacggggugguuaccaagaacggcggguacguaucuggcaucgcccagaccaacgcagagccagacgguccuacucccgagcuggaggaggagauguuuaagaagcggaaccucacgauuauggaccuucauccugggagcggcaaaacucgcaaauaccuacccgcuauugugcgggaagccaucaagcgcaggcuccgcaccuugaucuuggccccuacucgagucguugcggcggaaauggaggaggcacucaaggggcucccgaucagguaccagacgaccgccaccaaauccgaacacaccggccgcgagaucguggaccugaugugccacgcaaccuucaccaugcgccuccugagucccgugcgggugcccaacuacaaccuuauaauuauggacgaggcgcacuucacggaccccgcuuccauagccgcucgcggguauaucagcaccagggugggcaugggcgaggccgcugcgauuuucaugacggccacacccccggggaccgccgaagccuucccccaguccaacgcgcccauacaggaugaggagcgugacauucccgagcgcagcuggaacucaggcaacgaguggaucaccgacuucgucgggaagacgguuugguuugucccgagcaucaaggccgguaaugauaucgcgaacugccuaaggaagaacgguaagaaagugauccagcugucccgaaagacauucgacacagaguaccagaagacccggcugaacgacugggacuuugucgucaccaccgacaucagcgagaugggcgccaacuucagggccgaccgggucaucgaccccagaaggugccucaagcccgucauccugaccgacggucccgagcgugugauccuggcagggccgaugcccgugaccgccgccagcgcggcacaacgccguggucgugucgggcggaacccacaaaaggagaacgaccaauacaucuucacgggccagccccucaacaaugacgaggaccacgcucauuggaccgaggcuaagaugcugcuggacaauaucaauacgccagaggggaucauacccgcucuguucgagcccgagcgagagaaaagcgcagccauugauggcgaauaccgccugaagggggaaucccggaaaacguucguugagcugaugcgcagaggggaccuacccgucuggcuagcgcauaagguggcgagcgagggcaucaaguacaccgaccgcaaguggugcuuugacggcgagcggaacaaucaaauccuggaggagaauauggauguggagaucuggacgaaggagggcgagcgcaagaagcuacgcccgagguggcuggaugcacggacguacucugacccccuagcccucaaggaguucaaagacuucgcggccgggagaaagagcauagcccucgaccucgucacggagaucggccgcguacccucccaccucgcucaucggacccggaacgcccuggacaaucuagugaugcuccauacgagcgagcacggcgggcgggcguaccgucacgccgucgaggaguuaccggaaacaauggagacccugcuccuguugggccuaaugauccugcugaccgggggugcaaugcuauuccugauaucuggcaaaggaauaggcaaaaccucgaucggacuuaucugcgugauugugagcuccggcauguuauggauggccgauguuccacuacaguggaucgcguccgcaaucguucuggaguucuucaugauggugcuccucauuccggagccugagaaacagcgaaccccgcaagacaaccagcuggccuacgucgucaucggcauccucacgcuagccgcgauaguagcggcaaaugagaugggccugcucgaaaccacgaagcgcgaccugggcauguccaaggagcccggcgucgugagucccaccuccuaccuagacguggacuugcaccccgccagcgcuuggacacuguacgcaguugcgacgacggugaucacgccgaugcugcggcacacaaucgaaaacuccaccgcgaacgugagucucgccgcgauugccaaucaggcggucguccugaugggcuuggacaagggguggcccaucucaaagauggaccuuggcgugccucugcuggcccucgggugcuacagucaggucaauccccugacacucaccgccgccguucuccuguugguuacucacuaugccaucaucggcccggggcuacaagccaaagccacucgcgaggcucaaaagcggacagccgcugggauuaugaagaaccccacugucgauggcaucaugaccaucgaccuggaccccguuaucuacgacuccaaguucgagaaacagcuggggcagguaauguuacugguucugugcgcgguacaguuacuucucaugcguaccucgugggcccucugcgaggcccugacauuagcaacgggaccgaucaccacccucugggagggauccccggggaaguucuggaacacgacuauagccguaagcauggcuaauauuuuccggggguccuaccuggccggagccggacuugccuucagcauuaugaaguccgucgggaccggccgccggggcacggggagucagggcgagacccucggugaaaaguggaaaaagaaauuaaaucaauuaagccgcaaggaguucgacuuauacaagaaauccggcauuacugagguggaccggacagaagcgaaggaggggcugaaacgcggcgagaccacccaucacgccguaagccggggcucggccaagcugcagugguucgucgagcgcaacauggugauccccgaaggucgcguaaucgaccuagguugcggaagaggaggguggucuuacuauugcgccggucugaagaagguaacggaggugaggggcuacacgaaagggggccccggccacgaggaacccguucccauguccaccuauggcuggaauaucgugaagcuaaugucuggcaaggacguuuucuaccuaccacccgaaaagugcgauacccugcugugcgacaucggcgaguccagccccuccccaacgguggaggagucgcggaccaucaggguccugaaaaugguggagcccuggcucaagaacaaccaguucuguauuaaagugcuuaaccccuacaugcccaccguaaucgagcaccuggagcgacuacagcgcaaguacggcgggaugcuggugcgcaacccacugucccgcaauuccacccacgagauguacuggaucuccaacggcacagggaacauuguguccucggugaacaugguuagccgucuccugcucaaccgcuuuaccaugacucaccggaggccuaccauagagaaggacgucgacuuaggcgccgggacgcggcacgugaacgcggaacccgagacaccgaacauggacgugaucggugagcgaaucaagcggaucaaggaggagcacucuagcaccuggcacuacgacgaugagaaucccuacaaaaccugggcguaucacggcucguaugagguaaaggccacagggagcgccagcuccaugauuaacggcgugguaaaacugcucaccaagccaugggacguagugcccauggugacccagauggccaugaccgacacgacuccuuucggucaacagcgcguguucaaagagaagguggacacacggaccccucguccaaugcccggcacgcggaaggugauggagauuaccgccgaguggcucuggaggacacuuggccgcaacaagaagccccgucuguguacccgggaggaguucacuaagaaggucaggaccaacgccgcgaugggggcaguguucacggaggagaaccagugggacagcgcgagagcggccguggaggacgaggaguucuggaaacucguugaccgagagcgugaguugcacaaacugggcaagugcgggucgugcguguacaauaugaugggaaaacgggagaagaaacuuggggaguucggcaaggccaagggaagccgcgccauaugguacauguggcugggggcgcguuaccuggaguucgaggcccucggcuucuuaaacgaggaccacugguucagcagagagaacagcuacucuggaguggagggcgaggggcugcauaagcugggcuauauccugcgggacaucagcaaaaucccgggcggggccauguacgccgaugacaccgccgggugggauacgcgaaucaccgaggaugaccuccacaaugaggagaaaauaacccagcagauggaucccgagcaucgacagcucgcguccgcgaucuuuaaacugaccuaucagaacaaggucgugaagguccagcgucccacgccgaaagggacgguaauggauaucaucagccggaaggaccagcgcggcuccggucagguggggaccuacgguuugaacacauuuacuaacauggaggcccagcucgugcggcagauggagggggaagggguccugagcaaggcggaccuggaaaacccacaccuucuggagaaaaagauaacucagugguuggagaccaaagguguggaacgccugaagcggauggccaucaguggcgacgacugcguggucaagccgaucgacgacagguuugcgaacgcgcugcuggcccuaaacgauaugggcaaggugcggaaggacaucccgcaguggcagccaagcaagggguggcaugacuggcaacaggugccauucuguucccaccacuuucaugagcuuauuaugaaggacggucgcaagcugguugugccuugccgcccgcaggacgagcucaucgggcgggccagaauuucccagggcgccggguggucccugaaggagacagccugccugggcaaggcuuacgcucagauguggagccucauguacuuucaccggcgcgaucugcgacuggccuccaacgccauuuguagcgccgugccgguccacugggugccuacaucucgcaccaccugguccauccacgcgcaccaucaguggaugaccacugaagauauguuaacgguguggaaucggguauggauugaggacaaccccuggauggaggauaagacccccguaaccaccugggaggacgugccauacuuggguaagcgcgaggaccaguggugcgggucacugaucggccugacgucucgggcgaccugggcacagaacauccugacggccauccagcagguccgcagccugaucggggaugaggaguuucucgacuacaugcccuccaugaaaagauucagaaaggaggaagagagugagggugccaucugguga

SEQ ID NO: 26205 - RNA, 9873 nt, Artificial Sequence
  derived and/or modified CDS sequence (opt11) from DENV-3__DQ675522__SS-prME
accagcuucugucucaugaugauguugcccgccaccuuggcguuccaccugacgucccgugacggcgaaccgcggaugaucguugggaagaacgagcgcggcaagagccugcuguucaagacugccuccgggaucaauaugugcacacugauugccauggacuugggcgagaugugcgacgacacggucacguacaagugcccccucaucgccgagguugagcccgaggacauagacugcuggugcaacuugacgaguaccuggguaacuuacggaacgugcaaccaggcaggcgagcaucggcgagacaaacggagugucgcucuagcgccccacguagguauggggcucgacaccaggacccagacguggaugagcgccgagggcgccuggcgucagguggaaaaagucgagacuugggcccugcgccaccccggguuuaccauccucgcgcuguuccuggcccauuacauaggaaccucccugacccagaaggugguaaucuucaucuuauugauguugguuacacccagcaugaccaugcggugcgugggcgucggcaaccgcgacuucgucgaagggcuguccggggccaccugggucgacguuguccuggaacacggcgggugcgugaccacgauggccaaaaacaagcccacuuuagacaucgagcugcagaaaaccgaggccacacagcuggcgacacuccguaaauuguguaucgagggcaagaucaccaacaucaccaccgacagucgcugccccacgcagggcgaagcuauccucccggaggagcaggaucagaacuacgugugcaagcacaccuacgucgaccggggguggggcaacgggugcggccucuucgggaagggcucccuggugaccugcgccaaauuccagugccuggagcccaucgaagguaagguaguccaauaugagaaccucaaauacaccgugaucauaacggugcacaccggugaccagcaccaggucggcaacgauacccaaggggucaccgucgagauuacaccccaagcuagcaccguugaggcgguacugcccgaguacggcacgcugggucucgagugcuccccucgcaccggucuugauuucaacgaaaugauccugcucaccaugaagaacaaggcguggauggugcaccggcagugguucuucgaccugccccugcccuggacgagcggcgccaccaccgagacccccacauggaaccgcaaggaacuccuggugacauucaagaacgcucacgccaagaagcaggagguuguggugcuuggaucccaggaaggugccaugcacacugcgcucacuggcgcgacggaaauccagaacagcggagggacuagcauuuucgccggccaucucaagugccgacugaaaauggacaagcucgagcugaaggguaugagcuacgccaugugccugaacaccuucgugcucaagaaagagguuuccgagacccagcacgggacgaucuugaucaaggucgaauauaagggcgaggacgccccgugcaagaucccuuucucgacggaggacggucagggcaaggcgcacaauggccgccugauuaccgccaaucccguaguaacaaagaaggaggaacccgugaauauugaggccgagccgcccuucggggagagcaauaucgugaucggcauuggggauaaagcccugaagaucaacugguacaagaaaggaagcagcaucgggaaaauguucgaggcgaccgcccggggagcccggcggauggcaauccugggcgacaccgccugggacuucggauccguaggcggggugcugaacagccuggggaagaugguacaccagaucuucggcagcgcguacacagcccucuucagcggcguuuccuggaucaugaagauuggcauugggguacuguuaacuuggaucggccucaauagcaagaacacguccaugaguuucuccuguaucgugaucggcauaauuacccuguacuugggcgcgguaguacaggccgacauggggugugugaucaacuggaagggaaaggagcucaagugcggcagcgguauauuugucaccaacgaggugcacaccuggacggagcaguacaaauuccaagccgacucccccaagcgcuuagcgaccgccauagcuggcgccugggaaaacggagugugcgguauaagaagcaccacccggauggaaaaccugcucuggaaacaaaucgcgaaugaauugaacuacauccucugggagaacaacaucaaacucacggucgugguaggggacaucaucggcgucuuggagcaaggcaagcgcacccugaccccccagccgauggaacucaaauacuccuggaagaccugggggaaggcgaagaucgugacggccgaaauccagaacagcuccuucauaaucgacggaccaaacacccccgaaugcccgagugccucccgggccuggaacgugugggagguugaggacuacgguuucggcguguucaccaccaacaucugguuaaagcugcgcgagauguacacgcagagcugcgaccaccggcucaugucugcugccaucaaggacgagcgagccguccaugccgacaugggcuacuggaucgagucccagaaaaacgggagcuggaaacuggaaaaggccucauucaucgaggucaagaccuguacguggcccaagagccacacccucugguccaauggcgugcucgagagcgacaugaucauccccaagucccuggcggggcccauuagccagcacaaccaccggccgggcuaucacacucaaaccgccggcccguggcaccuggguaagcucgaacuggacuucaacuauugcgaggguacaacaguggucauuacugagaauugcgggacacgcggacccucccugagaaccaccaccgugagcgggaaguugauacacgaguggugcugucguuccugcacacugcccccgcugcgguauaugggggaggacgguugcugguacggcauggagauccgccccaucaacgagaaggaggagaacauggugaagagccucgucuccgcuggcucaggaaagguggauaacuucacuaugggcgugcugugucuggcuauacucuuugaggaggucaugcgggggaaguucggcaaaaagcacaugaucguuggagugcuguucacuuucguccuauugcuuuccggccagaucaccuggcgcgacauggcccacaccuugauaaugauuggcagcaacgcguccgaucgcauggggaugggcgucaccuauuuagcccugauugccacuuucaagauccagccuuuccuagcacucggguucuuccugcgcaagcucaccagccgggagaaccuccugcuuggcgugggccucgccauggccacgacccugcagcugcccgaggacaucgagcagauggccaaugggaucgcccucggccugaugacccugaagcucauaacucaguucgaaacguaccagcuauggacugcgcuggucagccucaccugcucgaacacuauauucacgcugaccguggcauggcguaccgccacucugauccucgccggcgucagccuucugccacucugccaaucuucguccaugcggaagacggauuggcugcccaugaccguagccgccaugggagucccuccccugccgcucuucaucuucagccucaaggauacacccaagcgccggucuuggccacugaacgaaggggucauggccgugggcuuagugagcaucuuggccaguagccugcuccggaacgacgucccuauggcuggcccgcuggucgccggcggcuugcucaucgcgugcuauguaaucaccgggacgagcgcggaccugaccgucgaaaaggccgccgacgugaccugggaggaggaggcugagcagaccggagugagccacaaccugaugaucacggucgaugacgacgggaccaugcgcauaaaggacgacgagacugagaacauccucaccgugcugcugaagaccgcccugcugaucguguccggcauauucccguacagcauacccgcgacacugcucguuuggcacacuuggcagaagcaaacccagcguaguggugugcugugggaugugcccagcccuccugagacccagaaagcugagcuggaggaggguguguaccgcaucaagcagcagggcaucuucggcaagacgcaggugggcguggggguccaaaaggagggcguuuuccacaccauguggcacgugaccaggggcgcuguccugacucacaaugggaaaagacuggagcccaacugggccuccgugaaaaaagaucugaucagcuacggcgggggcuggcgcuuguccgcacaauggcagaagggcgaggaagugcaagucauagcugucgagcccggcaagaacccgaagaacuuucagacgaugccuggcaucuuucagaccaccaccggggagaucggagccaucgcccuggacuucaaacccgggacgagcggcagcccgauaaucaaccgcgagggcaagguggucggacuauacggcaacgguguggugaccaaaaacggcgguuacgucuccggcaucgcucagaccaacgcagagccggacggccccacccccgaacuggaggaggaaauguuuaagaagcggaaccucacgaucauggacuuacacccggggagcggcaagaccaggaaguaccugcccgccaucgugcgggaggcgauuaagcggagacuccgcacccugauauuggccccgacucggguggucgccgcggagauggaggaggcccucaaagggcugccuauacgcuaccagacuaccgccaccaaguccgagcacaccggcagagagaucgucgacuugaugugccacgccacguucaccaugcgccuccugagcccuguccgcguccccaacuacaacuugaucaucauggacgaggcccacuucaccgaucccgcgagcaucgccgcucgaggguauauaucaacccggguuggcaugggcgaggccgccgcaauauucaugacagccacgccuccggguaccgcugaggcauucccucagaguaaugcacccauucaggacgaggagcgcgauaucccugagcgcagcuggaauucugguaacgaguggauuacagacuucguggggaagacggucugguucgugccgucaaucaaggccggcaacgacaucgcuaauugccuccggaaaaaugggaagaaggugauacagcugucuagaaagaccuucgacacagaguaccagaagacucggcugaacgacugggacuuugucgugacgaccgacaucucagagaugggcgcgaauuucaaggccgaccgcgucaucgacccuaggcgcugccucaagcccgucauccuaaccgacgguccggagcgagugauccuggcugggccuaugcccgugaccgccgcguccgccgcacagcgucgggggcgcgucgguaggaauccucagaaagagaacgaccaguacaucuucacuggccagccccucaacaacgacgaggaccacgcgcacuggaccgaggcaaagaugcugcuggauaacauaaauaccccggagggcauaauccccgcacucuucgagcccgaaagggagaagagcgcagccaucgacggcgaguaccggcugaaaggagagucccgcaagacauucguggagcugaugcggcgcggggacuuacccgucuggcuggcgcauaaaguggccagugagggcaucaaguacaccgaccggaaguggugcuucgacggcgaacgcaacaaucagauccuggaagagaauauggacguggagauauggacgaaagagggcgagcgcaagaagcuccgcccacgcuggcuggacgcccggacguauuccgaccccuuggcccuuaaggaguucaaggacuucgcggcaggccgcaagagcaucgcccuggaucuggucaccgagaucggucgggugcccagccaccucgcccaccguacccggaaugcccuggacaaucuggugaugcuccacacgagcgagcauggcgggcgcgcguaucggcacgcggucgaggagcugccugaaaccauggagacgcugcuccugcugggacucaugauccugcucaccgguggcgccauguuguuccugaucagugggaaggggaucggcaaaacgucuauagggcugaucugcgugaucgugagcuccggcaugcucuggauggccgacguuccccugcaguggaucgccagcgcgaucguauuggaguucuucaugauggugcuccugauccccgagcccgagaaacagcgaaccccacaggacaaccaguuggccuacgucguaauugggauacucaccuuggccgccaucguggcggcgaacgaaaugggccugcuugagaccacgaaacgggaccuagggauguccaaagagcccgggguggugucaccaaccuccuaccuggacguggaccugcaccccgccagugccuggacucuauaugccgucgccaccacgguuauuaccccgaugcugcgccacaccauugaaaacagcacagcuaacgugagccucgccgcgaucgccaaccaagccgucguguuaaugggccuggacaagggguggccgaucuccaaaauggaccucggcgugccuuuacuagcccuugggugcuacagccaggucaacccccugacacucaccgccgccgugcuccuccuagucacacacuacgccaucauaggcccgggccuccaggcgaaggccacccgggaggcccagaaaagaaccgccgccgguaucaugaagaacccgacaguugacggcaucaugaccaucgaccuggacccggugauuuacgauagcaaguucgagaagcagcuggggcagguuauguuacuggucuugugugcggugcagcuccugcugaugcggaccagcugggcccucugcgaggcccugacgcuggccaccggcccaaucaccacccuuugggaggguuccccggggaaauucuggaacacaaccaucgcagugucuauggcgaacaucuuccgcgguuccuaccucgccggagccggacuggccuucagcaucaugaaauccgucgggaccggccggcgcggcaccgggucccagggcgaaacgcucggggagaaauggaagaagaagcucaaccagcucagccggaaagaguuugaccuuuacaagaaguccggcaucaccgagguggaucgcaccgaagcgaaagagggacugaagcggggcgagaccacgcaccacgccgugagccgcggcuccgccaaguugcagugguucguagagcguaacaugguuauccccgaagggagagugauagaccucggcugcgggcgcggcggauggagcuauuacugcgcaggcuugaagaagguuacggaggugagaggcuacaccaaggguggcccuggucacgaggaaccggugccgauguccacauacggcuggaacaucgucaagcugaugagcgggaaggauguguucuaccucccccccgagaagugcgacacucugcugugcgacaucggcgaauccagcccauccccgacgguagaggagagccgcacuauccgggugcugaaaauggucgagcccuggcucaagaacaaccaguucugcaucaaggugcugaaccccuacaugccuaccgucaucgaacaccuggagcgccuccagcggaaguacggugggaugcuggugcgcaacccgcugucccggaacucgacccacgagauguacuggaucucuaacgguacggggaacaucgugucguccguaaauauggugagccgccuccuguuaaacagguucaccaugacccaccgccggcccaccaucgagaaggacgucgaccucggcgccggcacgcgccacguaaacgcagagcccgagaccccgaacauggacgugaucggugagcggauuaagcggaucaaggaggagcacuccagcaccuggcacuacgacgacgagaaccccuauaagaccugggccuaucauggguccuaugaaguuaaggcgacggggagcgcuucuuccaugauuaacggaguggugaagcuacugaccaagccgugggacgucgugcccauggugacccagauggccaugacugacacaacgccguucggccagcagcgggucuucaaagagaaggucgacacccgcaccccacgacccaugcccggaacgcgcaagguaauggagauuaccgcggaguggcucuggcggaccuuaggccgcaacaagaagccacgcuuaugcacccgcgaggaguucacgaagaaggugcgcacgaacgccgccaugggggcaguauucaccgaagagaaccagugggacagcgcccgugcggcgguggaggacgaagaguuuuggaaacucgucgaccgcgagcgggagcugcacaaacuuggcaagugcgguuccugcguguacaacaugaugggcaaacgugagaagaagcucggagaguucggcaaggccaagggcagccgggccauaugguacauguggcugggcgcgcgcuaccuggaguucgaggccuuaggauuccucaacgaggaccacugguucucccgggagaacagcuacuccggaguggagggugaagggcugcacaaguuagguuacauacuucgcgacaucagcaagauccccgggggggcgauguacgccgacgacaccgccggcugggacacccggauaaccgaagacgaccuacacaacgaggagaaaaucacccagcagauggaucccgagcaccgccagcucgccucagccaucuuuaaacugaccuaccaaaauaagguagugaagguccagcggcccacuccgaaggggaccgucauggacaucaucagccgcaaggaccagcggggcuccggccagguggguaccuacggccugaacacuuuuacgaacauggaggcccagcucguacgccaaauggagggcgagggcguccugagcaaggccgacuuagaaaacccccaucuccuggagaagaagaucacgcaauggcuggaaaccaaggggguggagcggcuuaagaggauggccaucuccggcgacgacugcguugucaagccgaucgacgaccgguucgcaaacgcucugcuggcucucaacgacaugggcaagguccgcaaggacauuccccaguggcagccuagcaagggguggcacgauuggcagcagguacccuucugcucccaccacuuccacgaauuaauuaugaaagacggccgcaaguuggucgugcccugucgaccccaggacgagcucauugggcgcgcccguaucucacagggcgccggguggucauuaaaggagacagcgugucuggguaaagccuacgcccagauguggagccucauguacuuucacaggcgggaccuacgccuggccucaaacgccaucugcucggcgguuccaguacacugggugccuaccagccggacgaccugguccauucacgcucaccaccaauggaugaccaccgaggacaugcucacuguguggaaucgcgucuggaucgaggacaacccguggauggaggauaagacaccggugaccacaugggaggacgucccguaccugggaaagagggaggaccaguggugcggcagccugauuggccucaccucccgcgccaccugggcccaaaacauccugaccgcgauccaacagguccggagccugaucggggacgaggaguuccucgauuacaugcccuccaugaagcgcuuccguaaggaggaggagagcgagggcgccaucugguga

SEQ ID NO: 26206 - RNA, 9873 nt, Artificial Sequence
  derived and/or modified CDS sequence (opt11) from DENV-3__DQ675527__SS-prME
accaguuuuugccugaugaugaugcuccccgcaacacuggccuuucaucucaccucacgugacggagaaccccgaaugauagucgggaaaaacgaacgcggaaaaagucuccuauucaaaacggcauccggaaucaacauguguacccucauagccauggaucucggagaaaugugcgacgauaccgugaccuacaaaugcccccucauagcagaaguugaaccggaagacaucgacugcuggugcaacuugacgagcacaugggugacauaugguaccuguaaccaagcaggagagcaucgaagagauaaacguagcgucgcauuggcaccccacguggggauggggcuugauacaagaacacaaaccuggaugucggcagagggggcuuggcgacaaguggaaaaaguagaaaccugggcgcuccggcauccaggcuucacuauccuggcuuuguuccuagcccacuacauuggaacuucauuaacacagaaaguuguuauuuuuauacuacuuaugcucgucacaccaagcaugacuaugcggugcguaggggucgggaaccgggauuucguagaaggucuaagcggcgcaacauggguagacgugguucuggaacacggagguugcguuaccacaauggcgaaaaacaaacccaccuuagacauugaacugcaaaagaccgaggcaacacaguuagcaacgcuaagaaaacucugcauagagggcaaaauaacaaacauuacgacagacuccaggugcccaacccagggggaggcgauacucccggaagaacaggaucaaaacuauguuugcaaacacaccuacguagaucgagggugggggaauggaugcggauuguucggaaagggaagccuagucacaugcgccaaguuccaaugccucgagcccauagaaggaaaggucguccaguacgagaaccucaaguacacugugauaaucacuguucacaccggugaccaacaccaggugggaaacgauacacaaggugugacgguggagaucacgccgcaagcaaguacgguugaagcaguccuacccgaauauggaacguuaggccucgaaugcaguccgcgcaccggucucgacuucaacgaaaugauauugcucacgaugaagaauaaggcauggauggugcaccgacagugguucuucgaccugcccuugccguggaccagcggagccaccaccgagacacccaccuggaacagaaaagagcugcuggucacguuuaagaacgcccacgcaaagaaacaggaagucguuguccuaggcucgcaggagggagcgaugcacacggcgcucacaggcgccaccgaaauucaaaacucagggggaaccagcaucuucgcaggccaccuaaaaugccgauugaaaauggacaagcuagagcuuaagggcauguccuacgcaaugugucuaaauacguucguacucaagaaagaaguaagugaaacgcaacaugguaccauccugauaaagguagaauacaaaggagaagacgcaccaugcaaaauacccuucagcacggaggacggccaaggaaaagcacacaauggacgacuaaucacagccaacccggucgucacuaagaaagaagaaccagugaacaucgaggcagaaccaccuuucggugagagcaacauugugauaggaauaggagacaaagcgcugaagaucaacugguauaagaaagggaguuccauaggcaagauguucgaagcuacagcacguggagcgcgacgaauggcaauccuuggggauacugccugggauuuuggcuccguuggagguguguugaacucccuagggaaaaugguccaucagauauucgguucagcuuacacggcacucuuuucaggcguuuccuggauuaugaagauaggaaucgggguucugcuaaccuggaucggccuuaacaguaagaacaccuccaugucuuucucaugcauaguaaucggcaucauaacacuauaucuuggagcagucguccaagccgacauggggugcguaauaaacuggaaagguaaggaacucaaaugcggaucggggauauucgugacuaaugagguacacacuuggacugaacaauacaaguuccaagccgacagccccaaacggcuagcgaccgcgauagcuggugcgugggagaacggaguuugcgggauacguagcacaaccagaauggaaaacuugcucuggaaacagauugccaacgaacucaauuauauauugugggaaaauaacauaaaacuuacgguugucgucggggacauaauaggcguacucgagcaaggaaaaagaacccuuacuccccaaccaauggaacucaaauauagcuggaaaaccuggggcaaggcaaaaauaguaaccgccgaaauacaaaacaguagcuucauaauagacgggccgaauacacccgagugcccaucagcaagccgagcauggaacgugugggaaguagaggacuacggcuucggaguguucaccacgaauaucuggcugaaacugcgugaaauguacacgcaauccugcgaccaucggcuaaugucugcagccaucaaggaugaacgcgcaguacacgcagacaugggauacuggauagagagccagaaaaacggcucuuggaaguuagaaaaggcaucauucauagaaguaaagacguguaccuggccaaagagucauacgcucuggagcaacgggguucuugaaucagacaugaucaucccaaaaucccucgccggccccaucagccaacacaaucaucggccuggcuaccacacccaaacagccggaccauggcaccucgggaaauuagaacuagacuucaacuacugugaaggaacgaccguaguaaucacagagaacugcggcacacgaggcccaagucugcggacaacuaccguuucagggaagcucauccacgaauggugcugcagauccugcacccuacccccacuaagauacaugggagaagacgggugcugguacggaauggaaauccgucccauaaacgaaaaagaagaaaacauggucaaaucgcuaguuuccgcggggucgggcaaaguagacaacuuuacgaugggcguacucugccucgcgauccuuuucgaagaaguaaugagaggcaaauucggcaaaaagcacaugaucguaggcgugcuauucaccuucguccugcuccuaagcggccaaauuacguggcgcgacauggcccacacgcucaucaugauaggaucaaacgcgucggauagaaugggaauggguguaacguaccuugcauugauagccaccuucaaaauccaacccuuucucgcucugggguucuuccuacgaaaacuaacgucccgagaaaaccugcucuuaggggugggccucgccauggcgacaacucuccaacuacccgaggauauagaacaaauggcaaacggcauagcgcucggccuuaugacccuaaaguuaaucacacaauuugaaacguaccagcuauggacagcgcuggucagccuaaccugcucaaacacgauauucacccuaacgguggccuggcggacggcaacacuuauacucgcaggagucucacugcugccccuaugccaauccagcagcaugagaaaaacugacugguugcccaugaccguugccgcaaugggaguaccaccacucccucuguucaucuucagccucaaggacacgccgaaacggcgaagcuggccauugaacgaaggagucauggccgucggauuagugagcaucuuagcauccucgcuguugcgaaaugacguacccauggccggaccucuagucgccggcggucugcugauagcguguuacguuaucacaggaaccagcgcagaccugaccguugagaaagccgcagacguuacgugggaggaggaggcagagcaaaccggaguaagucacaaccuaaugauuaccgucgacgacgauggaacgaugcggauaaaagacgacgagacugagaacauuuugacgguacuucuuaaaacggcgcugcuaauagucaguggcaucuucccauacucaaucccagccacccuacugguuuggcauacuuggcagaagcagacgcaacgaagcggagugcucugggacguacccuccccacccgaaacucaaaaagcggaauuggaagagggagucuaucgaauaaaacagcaagggauuuucggcaaaacccaaguagggguaggaguacaaaaagaggguguauuucacacgauguggcaugugacgcgcggagcaguacucacacauaacggcaaaagacucgaacccaauugggcgaguguuaaaaaggaccuaauaucauacggcgggggauggcgcuugucagcgcaguggcaaaaaggagaagaaguacaggucaucgccguggaaccggggaaaaaucccaaaaauuuucaaacaaugccggggauuuuucaaacgaccacuggagaaaucggagcgaucgcgcuugacuucaagcccgguacaagcggcucgcccauaauuaaucgugaagggaagguaguaggccuauacggaaauggaguaguaacgaaaaacgggggauauguaagcggcauugcacaaacgaacgcugaaccggauggaccaacaccugaacuggaagaggagauguucaaaaagcgaaaccuuaccauuauggaucugcaccccggcucggggaaaacgcgaaaauaccugcccgcuauaguaagggaggcaauuaagcgccggcuuaggacacuaauacuagcgcccacccgcguuguagccgccgaaauggaagaagcacugaaggggcucccuauccgguaccaaaccacggcuaccaaaagcgagcacacggggagagaaauagucgaccuuaugugccacgccacguuuaccaugcgucucuugagccccguacgcguacccaauuauaacuuaaucauaauggacgaagcccacuucacagacccggccuccauagcagcuagaggauacaucaguacgagaguggggaugggugaggccgcagcgaucuucaugacagccacgccgcccggaacagcggaagcguucccacaaucaaaugcaccaauucaggacgaagagagagacaucccagagcgaagcuggaacuccgggaacgaguggaucaccgacuuuguaggaaagacaguuugguuuguuccaucaauuaaagcagggaacgacauagccaacugccuccggaaaaacggcaagaaaguaauccaacugagccgaaagacauucgacaccgaauaccaaaagacccguuuaaacgauugggauuucguaguuaccacugauauuagcgagaugggagccaauuuuaaagcagaccgggugauagacccacguaggugccugaagccgguuauacuaaccgacgggcccgaacgaguuauauuagcggggccaaugcccgugaccgccgccuccgccgcccaaagacgaggacgggucgggcgaaacccgcaaaaagaaaacgaccaguauauauucacuggccaaccccucaacaacgacgaagaccacgcucauuggacagaagcgaaaaugcuccuggacaauauaaacacgccagaggggauaauaccagcacucuuugaacccgagcgcgagaaaagugcugcaaucgacggcgaauacagauugaagggugaaucgcgcaaaacauucguggaacucaugaggcggggagacuuaccggucuggcuagcacacaaaguggcgucagaaggaauaaaauacacagaucgcaaaugguguuucgacggcgaacguauaaaccagauccucgaggaaaacauggacgucgaaaucuggacgaaggagggggaaaggaaaaacuuacgaccacgauggcuggacgccagaacuuauucagacccccuugcccuuaaagaguucaaggauuucgcugccggacggaaaaguaucgcacucgaccuggugaccgaaauagggaggguuccgucgcaccuggcccacagaacaagaaacgcgcuggacaauuuagucaugcugcacaccagcgaacaugggggccgggcauaucgucacgccgucgaggaacuacccgaaacgauggagacuuuacugcuguuggggcuuaugauccuucugacaggcggggccaugcuauuccuuauaagugggaaagguaucggaaagaccagcauagggcucauuugcguaauaguaagcagcggcaugcuguggauggccgaugucccccuacaguggauugcguccgcaaucguccucgaauuuuucaugaugguauuauuaaucccagaaccggaaaaacagcggacaccgcaagacaaccaacuggcguacgucguaauuggcauucugacccuggcagccauuguggccgccaacgaaaugggguuacuugagaccacaaagagagaccuaggcaugagcaaggaaccaggcgucguaagccccaccagcuacuuagacguggaccuacaucccgcgagcgcauggacccuauacgcaguagcgacgacagugauaaccccaaugcuaaggcauacgauugaaaacuccacagcuaaugucaguuuagcggccaucgcaaaccaagcaguuguucugauggguuuagauaagggcuggcccauaagcaaaauggacuugggcguacccuugcuugcccucggaugcuacagccaggugaacccacucacccugacagcugcaguacucuuacuggugacucauuacgcaaucauagggccgggguuacaggcgaaggcgacucgcgaagcgcaaaagcgcacagcggcaggaauaaugaaaaacccgaccguagaugguaucaugaccauagacuuggacccagucauauacgacucaaaguucgagaaacagcucgggcaaguaauguuacucguacugugcgcaguccagcuacugcugaugaggacaagcugggcgcugugcgaggcuuuaacacucgcgaccggacccaucacuacccuaugggaaggaucaccugguaaguucuggaauaccacaauagccguaagcauggcaaacauauucagaggcucguaccuugccggagccggacuggcauuuucaauaaugaaaagcgucggaaccggccggagagggaccggcagccagggugaaacgcucggagagaaauggaagaagaaacuuaaccaacucuccagaaaggaguucgauuuguacaaaaagucgggaauaaccgagguugaccgcacugaggcaaaagagggauugaaaaggggcgaaacgacccaccacgccgucucucguggauccgccaaacuccagugguuuguugaacgcaacaugguaauccccgagggaagagucauagaccucggaugcggaaggggaggcugguccuacuacugugcaggccucaagaaaguaacggaaguacguggauacaccaaaggcgguccgggccacgaagaaccuguacccauguccacauacggguggaacaucgucaaacugaugagcggcaaagacgucuucuaccucccaccugaaaagugcgacacucuccugugcgacauuggagaaucaagccccucuccaacagucgaagaaagccgcaccauucguguccucaagaugguagagccguggcucaaaaacaaucaguucuguaucaagguccuaaaccccuacaugccgacuguaaucgaacaccuugaacgccuacaacgcaaauauggagguauguugguccgaaacccccuguccagaaacaguacucacgaaauguacuggauaagcaacgguacugggaacauuguaucaagcgugaacauggucucccgccucuugcuuaacagauucacgaugacacauagacgaccaaccauagaaaaagacguagaucuaggcgcugggaccaggcacgucaaugccgaacccgaaaccccgaacauggacguaaucggcgaacggaucaagcgaauaaaagaggaacacucaucaacguggcauuacgaugacgagaaccccuacaagaccugggccuaccauggcaguuaugaagugaaagcaaccggcuccgcaagcaguaugauaaacggggucgucaagcuguugaccaaaccuugggauguaguccccaugguaacacaaauggccaugaccgacacaacacccuucggucagcaaagaguauucaaagagaaagucgacacaaggacuccaaggccaaugccaggcacgcguaaaguaauggaaauaacggcagaguggcuguggagaacacucggcagaaacaagaaaccacgacucugcacgcgggaagaguuuaccaagaaaguccgcacgaaugcagccaugggcgccgucuucacugaagaaaaucaaugggacucagcaagggcagcggucgaggaugaggaguucuggaagcuaguagaccgcgagcgggaguuacauaaacucggcaaaugcggaucaugcgucuacaacaugauggggaaacgagagaagaaacuuggugaguucgggaaagcaaagggcucgagggcaauaugguacauguggcugggagcacgauaccuagaauuugaggcuuuggguuuucugaacgaagaccauugguucagcagagaaaacuccuacucgggaguggagggcgagggccuacacaagcuaggguauaucuuacgagacauaucaaagauaccugguggggcaauguacgcggacgauacagccgggugggauacgagaaucacggaggacgaccuacacaacgaagaaaagauaacccagcaaauggacccugagcacagacaacuagccagcgcaaucuucaaacuuacguaccaaaauaaagucgucaaggugcaacgcccgacacccaaaggaacaguuauggacauaauauccaggaaagaccagcgaggaagcggucaaguuggaacguacggacugaacacguucaccaacauggaagcccaacucguacgccaaauggagggggaaggagugcuaagcaaggccgaccucgagaacccacacuuacucgaaaagaagauuacccaauggcuggagacuaaggggguggagagacuuaaaaggauggcgaucagcggagaugacugcgugguaaagcccaucgacgacagauucgccaacgcccugcuagcucugaacgacaugggaaaagugcgcaaagauauaccacaauggcagccaagcaaaggauggcacgacuggcaacaaguacccuuuugcagccaccauuuccacgaacuaauaaugaaggacggacguaagcuaguaguuccuugucggccccaagacgaacuaauaggcagagcacggaucucgcaaggggccggguggucgcuaaaagaaacagcaugccuaggcaaggcuuacgcucagauguggucccuaauguacuuccaucgucgagaccuccgacuggcgucuaacgccaucugcuccgcgguaccaguacacugggugccgaccucgaggaccacauggucuauucacgcucaccaccaauggaugacuaccgaagacauguugaccgucuggaauagggucuggauugaggacaaccccuggauggaagauaagaccccagugacuacgugggaggacgucccguaucuaggaaagcgggaagaucaauggugcggcucacucauaggucugacgucgcgagcaacaugggcccagaacauccuuacugcaauccagcagguccgaucgcugaucggagacgaagaguuccucgacuacaugccaucaaugaagcgcuuccgaaaagaagaggaaagcgaaggggcgaucugguaa

SEQ ID NO: 26207 - RNA, 9873 nt, Artificial Sequence
  derived and/or modified CDS sequence (opt11) from DENV-3__DQ675528__SS-prME
accagcuucugccuaaugaugaugcuccccgccacuuuagccuuucaccucacgucccgcgacggcgagccgcggaugaucguggggaagaacgagcgcggcaagagccuccuguucaagaccgcguccgguaucaacauguguacccugaucgccauggaccucggcgagaugugcgacgacacggucacguacaagugccccuugauagccgagguggagcccgaggacaucgacugcuggugcaaccugacaagcaccugggucaccuacgggacgugcaaccaggccggcgagcacaggagagacaagcgcuccgucgcccucgcgccgcacgugggcauggggcuggacacccgcacccagaccuggaugagcgccgagggggccuggcggcagguugagaaggucgagacgugggccuugcgccacccgggguucacaauccucgcacuguucuuggcccacuacaucggcacuucccucacccagaaaguggugaucuucauucugcugaugcucgucacgcccagcaugaccaugagaugcgugggugugggcaaccgcgacuuugucgagggccuguccggggccacuuggguagacgugguccuggagcacggcgggugcgugacuaccauggccaagaauaagcccacccucgacaucgaguugcagaagaccgaggcaacccagcuggcgacgcuccggaagcugugcaucgagggcaagauaaccaauaucacuaccgacagccggugucccacacagggagaggcgauccuaccagaagagcaggaccagaacuacgugugcaaacacacguacguugaccggggguggggcaacgggugugggcucuucgggaagggcucccuggugaccugcgccaaguuccagugccuggagcccaucgaaggcaaggugguccaguacgagaaccucaaguauaccguaauaaucacggugcauaccggugaccagcaucaggucggcaacgacacgcagggggugaccgucgagauaacgccccaggccagcaccguggaggccguccugcccgaguauggcacccuggggcucgagugcucuccgcgcacaggccuggacuucaacgagaugauacugcucaccaugaaaaacaaggcguggaugguccaccggcagugguucuucgaccugccccugcccuggacguccggcgccaccaccgagacccccacguggaaccgcaaggagcuccuggugaccuucaagaacgcccacgccaaaaagcaggagguugucgugcugggcucccaggagggcgccaugcauacggugcucaccggggcgacggagauccagaauagcggcgggacaucgaucuucgcaggccaccuaaagugccggcugaagauggacaaauuggaacucaaggguaugucauaugccaugugccugaacaccuucguccuaaagaaggaaguuuccgagacccagcaugggacgauacuuaucaagguggaguacaagggcgaggacgccccgugcaagauccccuuuagcaccgaggaugggcagggcaaggcccacaauggccgcuugaucaccgcgaaccccgucgugaccaagaaggaggagcccguaaacaucgaggccgagccaccauucggggagagcaacaucgucaucggcaucggggacaaggcccugaagaucaacugguacaagaagggcaguagcaucgggaagauguuugaggccacggcgcggggcgcccgccguauggcaauucucggcgacaccgccugggacuucgggagugugggcggcgugcugaacagccucggcaagaugguccaucagaucuucggguccgccuacacggcguuguucucgggcguguccuggaucaugaaaaucggaaucggggugcugcugaccuggaucggccucaauagcaagaacacguccaugagcuucuccugcaucgucaucgggaucaucacccuguaccugggcgccguggugcaggccgacaugggcugcguaaucaacuggaagggaaaggagcucaagugcggcagcggcaucuucgugaccaacgagguacacacguggacugagcaguacaaauuccaggcagacucccccaagcgccuggcaaccgcgaucgccggcgccugggagaacggggucugcggcauacgcucaaccacccggauggagaaccuucuguggaagcagauagccaacgagcuaaacuauauccugugggagaacaacaucaagcucacagugguggugggcgacauaaucggcgugcuugagcagggcaagcgcacccugaccccccagccgauggaguuaaaguacuccuggaagaccugggggaaggccaagaucgugacggccgagauccagaacagcucguucaucaucgacggccccaacacccccgagugccccagcgccucccgggccuggaacguaugggagguggaggacuacggguuuggcguguucacaaccaacaucuggcugaagcuacgagagauguacacgcagagcugcgaccaccggcucaugagcgccgcgauaaaagacgagcgcgccguccacgccgacaugggcuacuggaucgaaucccagaagaacggcagcuggaagcuggagaaggcuuccuucaucgaggugaagaccugcaccuggccgaagagccacacccugugguccaacggcguucucgagagcgacaugaucauccccaagucccuggcggggcccauuagccagcacaaccaccgaccgggcuaucacacgcagaccgccgggcccuggcaccugggcaagcuagagcuggauuucaacuacugcgaggguaccaccgucgugauaaccgaaaacugugggacccgcggccccucccugaggacgacgaccgugucggggaagcucauccacgaguggugcugccgcuccugcacguugcccccacugcgguacaugggagaggacggcugcugguacggcauggagauccgcccaaucaacgagaaggaggagaacauggucaagagccucguguccgccggaagcgggaagguggacaacuucaccaugggcguccugugccuggccauccucuucgaggaggugaugagagggaaguucggcaagaagcacaugaucguggggguccuguucacguucgugcugcuccugucuggccagauuaccuggcgcgacauggcccacacgcugaucaugauaggcaguaacgccuccgaucggauggggaugggugugaccuaccucgcgcugaucgcgacuuucaagauccagcccuuccuggcccucggguucuuccuucgcaagcugaccagccgggagaaccuccuccugggcgucggccucgccauggccaccacccugcagcuaccugaggacauugagcagauggcgaacgggauugcccucggcuugaugacccucaagcucaucacccaguucgaaacguaccagcuguggaccgcccuggugucucuaacgugcuccaacaccaucuucacgcugaccguugcguggcgcacagcgacccugauccucgccggcgugagccuccugccguuaugccaauccucauccaugcggaagacggacugguugcccaugaccguggccgccaugggcguccccccgcugccgcucuucaucuucagccugaaggacaccccaaagcgccgcuccuggccacugaacgagggugugauggccgugggccucgucagcauccuggcguccucucugcuccggaacgacgugcccauggcuggcccgcugguggccggcggccuguugauugccugcuacgucaucaccggaacguccgccgaucugaccguggagaaggcggccgacgugaccugggaggaggaggcugagcagaccggggucagccacaaccugaugaucaccgucgaugacgauggcaccaugcgcauaaaggaugacgaaaccgagaacauccucaccgugcugcugaagaccgcccuccugaucgucuccggcaucuuccccuacagcaucccggccacgcugcucguguggcauaccuggcaaaagcaaacccagcgguccggcgugcugugggauguccccagcccgcccgaaacccagaaagcggagcuggaggaggggguguaccgaauaaaacagcagggcaucuucgggaagacgcaggugggcgucggugugcagaaggagggcgucuuucacaccauguggcacgucacccggggcgccgugcucacccacaacgggaagcgccuggaacccaacugggccuccguaaagaaggaccugauuagcuacggcgggggauggcggcuuuccgcccaguggcagaagggggaggagguccaggugaucgcgguggagcccggcaagaacccgaagaacuuccaaacgaugcccggcaucuuccaaaccaccaccggggagaucggcgcgaucgcccuggacuucaagcccggaacgagcggcagcccaaucaucaaccgcgaggggaaggucguggggcuguauggcaacgggguggucaccaaaaacggcggguacgugagcggcaucgcccagaccaaugccgagcccgacggccccacccccgaacuggaggaggagauguuuaagaagcggaaccucacgaucauggaccugcacccggggagcgguaagaccagaaaguaccugccugcgaucgugcgggaagcuaucaagcgccggcuccgcacccugauccuggcccccacccgggucguggccgccgagauggaggaggcgcucaaggggcugcccauccgcuaccagacgaccgccaccaaguccgagcacacaggccgggagaucguggaccugaugugccacgccacguucaccaugagacuccugagcccgguccgggugcccaacuacaaccucaucaucauggacgaggcucauuucacggacccugccuccaucgcggcucgcggguacauuagcacacggguggggaugggcgaggccgccgcuauuuucaugaccgcaacuccgccggggaccgccgaggccuucccccaguccaacgcccccauccaggacgaggaacgcgacaucccggagcgcagcuggaacuccggcaacgaguggaucaccgacuucgucgggaagaccguuugguucgugccgagcaucaaggcgggcaacgacaucgccaacugccuccggaaaaacgggaagaaggucauccagcuguccagaaagaccuucgacacagaauaccagaagacccggcugaacgacugggacuucguggugacgaccgacaucagcgagaugggggcuaacuucaaggcagacagggucaucgacccacggcgcugccucaagcccgugauccugaccgacggccccgagcgagugauucuggcagggccgaugcccgucaccgcugccuccgccgcccagcgccggggccgagucgggcggaauccccagaaggagaacgaccaauacaucuucacgggccagccccucaacaacgacgaggaccacgcccacuggaccgaggcgaaaaugcugcuggacaacaucaacaccccggaagggauaauccccgcccucuucgagcccgaacgcgagaagucggccgcaaucgacggcgaguacagacugaaaggugagucccgcaaaaccuucgucgagcugaugcggcgcggagaucucccuguuuggcuggcccacaagguggccagcgagggcauaaaguacaccgauaggaaguggugcuucgacggggagcgaaacaaccagaucuuagaggagaacauggaugucgagaucuggaccaaggagggcgagcggaagaagcuucgcccgcgcugguuagacgcccggaccuacucggacccucuggcccucaaggaguucaaggauuucgccgcgggccgcaagucaaucgcacuggaccuggugaccgagaucggccgggugcccagucaccucgcacaccgcacgcggaacgcccuggacaaucugguuaugcuccacacgagcgagcacggugggcgcgccuaucggcacgcgguagaggagcugccggagaccauggagacccuacuccugcugggccuuaugauccugcugaccgggggcgccaugcucuucuugauaagcggaaagggcaucggcaagacuaguauagggcuuaucugcgugauagucagcucgggcauguuguggauggccgaugugccccugcaauggauugccucugccaucguucuggaguucuucaugaugguccuccugauccccgaacccgaaaagcagcgcaccccgcaggacaaccagcuggcguacguggugaucgggauccucacccuggccgccaucgucgccgccaacgagaugggccuccucgagaccacgaagcgggaccuuggcauguccaaggagcccgggguggucuccccuaccuccuaccuggacgucgaccuucaccccgcgagcgccuggacccuguacgccguggcuaccacggugaucaccccgaugcugcgccauacaaucgagaacuccaccgccaaugucagccucgcggccauugccaaccaagccgugguccugaugggccuggacaagggguggcccaucuccaagauggaccucggcgucccccugcuggcgcucggaugcuauagccaggugaacccccugacgcugacugccgccgugcuccugcugguaacccacuacgcuaucaucgggccgggccuccaggcgaaggcgacccgggaggcccagaagcgcacggccgccgggaucaugaagaaccccaccguugacggcaucaugaccaucgaucuggaccccgugaucuacgacucuaaauucgagaagcaauugggucaggucaugcuccuggugcugugugccgugcaacuccugcugaugcggaccagcugggcgcucugcgaggcccugacgcuggccaccggccccauuaccacccuuugggagggguccccgggaaaauuuuggaacacgaccaucgccgucagcauggccaacaucuuccgcggcuccuaccuggcgggggccggacuggcuuucaguauaaugaaaaguguagggaccggccggaggggcaccgggagccaaggcgagacgcuaggggagaaguggaagaagaagcuaaaucagcugagccggaaggaguucgaccucuacaagaaaagcgggaucacugagguggaccgcaccgaggccaaggaagggcugaagcggggcgagaccacacaccacgcggucagccgcggcuccgccaagcugcagugguucguggagcggaauaugguuaucccggaagggagggucaucgaucucggcugcggucgcggcggguggagcuacuacugcgccggccugaagaaagugacggaggugagaggcuacaccaaggggggccccggccacgaggagcccgucccgauguccaccuacggcuggaacauugugaagcugaugagcggaaaggacguguuuuaccucccgcccgagaagugcgacacccugcucugcgacauaggcgaguccucccccuccccgacggucgaggagucccgcacaauccggguucugaagaugguggagcccuggcucaagaacaaucaguuuugcaucaaaguccugaaccccuacaugcccaccgugaucgagcaccuggagcgccuccagcggaaguauggugggaugcuggugcgcaacccgcugucccggaacuccacccacgaaauguacuggaucucgaacggcacggggaacaucgucagcuccgugaacauggucagccgccucuuacugaaccgguucaccaugacccaccgccgccccaccaucgagaaggacguggaccucggcgccggcacgcgccacgugaaugccgagcccgagaccccgaacauggacgucauuggggagcggaucaagcgcaucaaggaggagcacuccagcacguggcacuacgacgacgaaaaccccuacaagaccugggcguaccacggcuccuacgaggugaaggccacggggagcgccagcaguaugaucaacggcgugguuaagcuucugaccaagccuugggacguggugcccauggucacucagauggccaugaccgacacgaccccguucggccaacagcggguguuuaaagagaaggucgauacccgcacuccccggcccaugcccggcacgcgcaaagucauggagaucacagccgaguggcucuggcggacccugggccgcaacaagaagccgcgccugugcacccgggaggaguucacgaagaaggugcgcaccaacgcggccaugggagccguguucaccgaggagaaccagugggacagcgcccgggcggccgucgaagacgaggaauucuggaagcucgucgaccgcgagcgggaacugcacaagcugggcaagugcggauccugcguguauaacaugaugggcaagcgcgagaaaaagcucggggaguucggcaaggccaagggcucccgggccaucugguacauguggcugggggcccgcuaccuggaguuugaggccuugggcuuccugaacgaggaccacugguucucccgggaaaauagcuacuccgggguugagggcgaggggcugcacaagcucggcuacauuuuacgcgacaucagcaaaauccccgggggggccauguacgccgacgacaccgcgggcugggacacgcggauuaccgaagacgaccugcacaacgaggaaaaaauaacacagcagauggacccggagcaccgccagcucgccuccgcgauauucaagcucaccuaccagaacaagguggugaaaguccagcggccgacgccgaaagggaccgugauggacauuaucagccgcaaggaccagcguggcuccggccagguugggacuuacggccugaauaccuucacaaacauggaggcccagcucgugcgacagauggagggggagggcgugcuaagcaaggccgaccucgagaacccccaccuucuggagaagaagaucacgcaguggcuggagaccaaggggguggagcggcuaaagcgcauggccaucuccggcgacgacugcgucgugaagcccaucgacgaucgguuugcgaacgcguuacuggccuugaacgauaugggcaaaguucgcaaggacaucccccaguggcagccgagcaagggguggcacgacuggcagcagguccccuucugcagucaccacuuccacgagcugaucaugaaggacggccggaagcugguggugcccugccgcccccaggacgaacucaucgggcgcgcccggaucagccagggagccggguggucccugaaggaaacggccugccugggcaaggcguacgcgcagauguggagccucauguauuuucaccgccgggaccugcgccuggccuccaaugccaucugcagcgcggucccggugcacugggugcccaccagccggacaaccugguccauccacgcgcaccaccaguggaugacaaccgaggacaugcucacggucuggaaccgcguguggaucgaggauaaccccuggauggaggacaagaccccuguaacuaccugggaggacgucccguaccugggcaagcgggaggaccaguggugcggcucccugaucggccucacuucucgcgccacaugggcccagaacauccugaccgccauacaacaggugcggagccugaucggggacgaggaguuccuggacuacaugcccuccaugaagcgcuuccggaaggaggaggagagcgagggcgcgaucugguag

SEQ ID NO: 26208 - RNA, 9873 nt, Artificial Sequence
  derived and/or modified CDS sequence (opt11) from DENV-3__DQ675530__SS-prME
accagcuucugucugaugaugaugcuccccgcuacacuggccuuccaccuuaccucccgagacggcgagccgcggaugauuguagggaagaaugagcguggcaaaagccucuuguuuaaaaccgccuccgggaucaauaugugcacccugaucgcgauggaccuaggggaaaugugcgacgacacggucacguacaaaugccccuugaucgcugagguggagcccgaggacaucgacugcuggugcaacuugacuuccaccugggugacguaugguacgugcaaccaggccggggagcaucgccgagauaagaggagcgucgcccucgcgccccauguggggaugggucuggacacccgaacucagacauggaugagcgccgagggagccuggagacagguggagaaagucgagacuugggcccugaggcacccgggguuuacgauacucgcucuguuuuuagcccacuauauuggcaccucccccacgcagaaggugguaaucuucauccucuugaugcugguaacucccucuaugaccaugcggugcgugggggucggcaacagggauuuuguugagggccucuccggugccaccugggucgacguuguccuagagcacggcggaugcguaacuacgauggccaagaauaagcccacccuggacaucgagcuccagaagaccgaggcaacccagcuggccacgcugcguaaauuaugcaucgagggaaaaauuaccaacaucaccaccgacagccgguguccgacgcagggcgaggccauacuccccgaggagcaggaccaaaauuacgugugcaagcacacuuacguugaccgggggugggggaacggguguggccuguuugggaagggcucccucguaacgugcgccaaguuucaaugcuuagagccaaucgaggggaagguuguccaauacgagaauuuaaaauacaccgugaucaucacagugcacaccggggaccagcaccaggucggaaaugacacacagggugugaccgucgagauaacuccucaggccagcaccguggaggccgugcuaccggaauacgggacccucggacuggagugcagcccccgaaccgggcuagacuucaacgagaugauacugcugaccaugaaaaacaaagcguggaugguccaccgacagugguucuuugaccucccccugcccuggacgagcggagccaccaccgaaacuccgacguggaauaggaaggagcuacucgugaccuuuaagaacgcccacgccaagaagcaagaggugguagugcuggguagccaagagggcgccaugcacaccgcgcugaccggggcuacggagauacagaacucuggcgggaccuccaucuucgccggucaccucaagugccggcucaagauggacaaguuagaguugaaggguaugagcuacgcaaugugucugaacaccuucguacugaagaaggaaguauccgaaacccagcacgggaccauacucaucaagguggaguauaagggcgaagacgccccuugcaagauccccuucuccaccgaagauggucaaggcaaggcucacaacggucgccugaucacagccaaccccguugucaccaagaaggaggagccgguaaacauugaggccgaaccgcccuucggggagagcaacaucgugaucggcaucggggacaaggcccugaagaucaacugguacaagaagggcuccagcaucgggaagauguucgaagcuacggcucgaggcgcacgcaggauggccauccuuggcgacaccgccugggacuucgggagugugggcggcgugcucaauagccugggcaaaaugguccaccagaucuucggguccgccuauacugcccuauuuucaggcgucuccuggaucaugaaaauaggcaucggggugcuccugacauggaucggccugaacagcaagaacaccuccaugagcuucagcugcaucgugaucgggaucaucacccuauaccugggugcggugguucaggccgacauggggugcguuaucaacuggaaaggcaaggagcugaagugcgggagcgggaucuuuguaaccaacgaaguacauaccuggacggagcaguacaaguuccaagccgacucgccgaagcgccucgcgacggcuaucgccggcgccugggagaauggggugugcggcaucaggucgaccacccgcauggagaauuuacuguggaagcagaucgccaacgagcucaacuacauccugugggaaaacaacaucaagcugacggucgucgucggcgauauuauaggcguccuagagcagggcaagaggacccugaccccgcagcccauggaauuaaaguacuccuggaagacaugggggaaagcgaaaaucgugacggccgagauucaaaauuccuccuuuaucauagacggcccgaauaccccggaguguccgagcgccucuagagcauggaacgugugggaggucgaggacuacggguucggcguuuucacaaccaauaucuggcucaagcugcgcgaaauguacacccaauccugcgaccauagacugaugagcgccgccaucaaggacgagcgugccgugcaugccgacaugggcuacuggaucgagucccagaaaaacggcuccuggaagcuggagaaggccuccuucauagaagucaagaccuguacguggcccaagagccacacacugugguccaacggcgugcuggagagcgacaugaucaucccaaagucccuggcugggccgauaagccagcauaaccaccggcccggcuaccacacgcagacggccggaccuuggcaccugggcaaacuugaguuagacuuuaacuacugcgaagguaccaccguggucaucacagaaaacugugggacgcgcggccccucccuccgaaccacgaccguaucugggaaacuuauucaugaguggugcugccgcaguugcacccucccgcccuuacguuacaugggugaagacgggugcugguauggcauggagauccggcccauuaacgagaaggaggagaauauggugaagagucuggucuccgccgggucugggaaaguggauaacuucaccaugggcguccucugccuggcuauacuguuugaggaggucaugcgggggaaguucggcaagaagcauaugaucguggggguacucuucaccuucguucuauugcucuccggccaaaucaccuggcgggacauggcccauaccuuaaucaugauaggcagcaaugcguccgaucggaugggcauggguguaaccuaccuugcccucaucgcgacuuuuaaaauccagcccuuccuggccuugggguucuuccuccgcaaguugacgagccgggagaacuugcucuugggcgugggcuuggccauggcaacgacccugcagcugccggaggacauagagcaaauggccaaugggaucgcccuaggccucaugacucuaaagcugaucacccaguuugagacguaucaacucuggaccgcguuaguaagucuaaccugcucuaauacuaucuuuacgcucacuguggcguggcgcaccgccacccuaauacuggccggggucaguuuacugccacugugccagucaucauccaugcgcaagaccgacuggcucccgaugaccguggccgcuaugggggucccaccgcugccccuguucauauucagucucaaggauaccccuaagcgccgcuccuggccccugaacgagggggucauggcggugggcuuagugagcaucuuggccagcagccugcugcgcaacgaugucccgauggccggcccgcucguggccgggggccugcugauagcaugcuacgugaucacuggcacguccgcagaucucacgguugagaaggccgcugacgugaccugggaggaggaagccgagcaaacgggggugagccacaaccugaugaucacggucgaugaugacggcaccaugcggaucaaagacgacgagaccgaaaauauacugacggugcuucuuaagaccgcucuacucauugucuccggaaucuuccccuacagcaucccugcgacacuccuggucuggcauaccuggcagaagcagacccagagguccggcgugcugugggauguacccagucccccggagacccaaaaggcugaacuggaggagggggucuaccguauaaagcaacaaggcaucuucgguaaaacgcaagugggcguagggguccagaaggaggggguguuucacaccauguggcauguuacccggggcgccguacugacacacaacggcaagcgccuugagccuaacugggcgagugugaagaaggacuugaucagcuacggcgggggcuggcggcugagcgcccaguggcagaagggggaagaaguucaggucaucgcgguggaaccaggcaagaacccgaagaauuuccagacuaugcccgguauuuuccagacaaccaccggcgagaucggagccauagcgcucgacuucaaaccggggacaagcggaucgccgaucauaaaccgcgaaggcaagguugucgggcuauacgggaaugguguggugaccaaaaacgguggcuacguuucaggcaucgcacagacaaacgcagaacccgaugggccgacuccggagcuggaggaagagauguucaaaaagcgaaaccugacgaucauggaccuacaccccggcagugggaaaacccgaaaguauuuacccgccaucgugagggaggccaucaagcggcggcugcgcacccucauccuggcuccgacccggguggucgcggcggaaauggaagaggcccugaagggguugccgauuagauaccagacgacggccaccaagucggagcauacuggccgggaaauaguugaccugaugugccacgcuacguucaccaugagacuccucagcccugugcggguccccaacuacaaccugauuauaauggacgaggcccacuucacagauccugcgagcauagccgcgcggggguacauaagcacgcggguggguaugggcgaggccgccgcgaucuuuaugacggcaacgccgccugggaccgccgaagcauucccccaguccaacgcgccaauucaggacgaagagagagacaucccagaacgcuccuggaacuccggcaaugaguggaucaccgacuuuguagggaagacgguuugguucgucccaagcauaaaagccggaaacgacaucgcuaacugcuugcggaaaaacgggaagaaggucauccagcucucccgcaagaccuucgauaccgaauaucagaaaacacgacuuaacgauugggauuucgucgugacaaccgacauuucagagaugggcgccaacuuuaaagccgaccgcgucauugacccacggcgcugccugaaacccgucauccucacggauggcccggagagggugauccuggcggggcccaugccagugaccgccgccagugcagcccagcgccggggacgcgucgggcgaaacccgcagaaagagaacgaucaguacauuuucacggggcagccgcugaacaacgacgaagaccaugcgcauuggaccgaggccaaaaugcuucuagacaauaucaacacccccgaaggaaucaucccggcccuguucgaaccggaacgcgaaaagagcgcugccaucgauggcgaauaucgucucaagggcgagucgaggaagacauucguggagcugaugcggcguggggaccugccugucuggcucgcccacaaaguugcgagcgaaggcauaaaguacaccgaucggaaguggugcuucgauggagagcguaacaaccagauccuugaggagaacauggacguagagaucuggacgaaggagggcgagcgcaagaaacugcgcccccgcuggcucgacgcccggacauauucagacccccuugcccugaaggaguuuaaagauuucgcggcugggagaaagagcauagcgcuggauuuagugaccgagaucgggcgcgugccuucccaucuggcgcacagaacccguaaugccuuagacaaccuggugaugcugcacacuuccgagcacggcggucgcgcguaucggcacgccgucgaggagcuccccgagaccauggagacacugcuucuccugggccugaugauccuccugaccgggggugccaugcuguuucuuauaagcgggaaggggauaggcaagacgucaaucggccugaucugcgugauugugagcuccggaaugcuuuggauggccgacguaccccuccaauggaucgccagcgcaaucgugcuggaguuuuucaugauggugcugcucauccccgagccagaaaagcagcggacgccccaagacaaccagcuggccuacgucgugauagggauccucacccuugccgccaucguggcagcgaacgaaaugggacuacuggagaccaccaagagagaccuugggaugagcaaagaacccggagucgugagccccaccuccuacuuagauguggaccugcauccggcgagcgccuggacgcucuacgccguugcgaccacggugaucacccccaugcugcgccauaccaucgagaacucaaccgcgaacgugagccuggccgcgaucgccaaccaggccgucguccuuaugggccuggacaaaggguggcccaucaguaagauggaccugggcgugccucuccuggcccuggggugcuauucgcaagucaacccccucacgcugacagccgccguccugcuccugguaacccauuacgcaauuaucggacccggccuucaagcgaaagcaacccgagaggcgcagaagcgcaccgccgccgggaucaugaaaaaccccaccgucgauggcauaaugaccaucgaucucgaccccguaaucuacgauucaaaguucgagaagcaguuaggucaggugaugcugcuuguccugugcgcugugcagcugcuccuaaugcggacaucaugggcgcugugugaggcccucacgcuugccaccggcccgauuacaacacuuugggagggcuccccaggcaaguuuuggaauacgaccauugccguuucgauggcgaacaucuuccgcgguucuuaucucgccggcgcuggacuggcguuuagcaucaugaaguccgucgggacuggacggcgcggaacaggcagccagggcgaaacacucggugaaaaguggaaaaagaagcucaaccagcugagccggaaagaguuugaccuguacaagaaguccggcauaaccgagguggauaggaccgaggcgaaagaggggcucaaaaggggugagaccacgcaucaugccgugagccgcggauccgcaaagcugcagugguucgucgaacgcaacaugguuauccccgaaggucgcgugauugaccuaggcuguggacgcggcggguggagcuacuauugcgcgggccucaaaaaggucacggaggugcgaggguacaccaaagggggccccggucaugaggaaccggugcccaugucgaccuacggcuggaacaucgucaagcugaugagcgggaaggacguauucuacuuaccacccgaaaaaugcgacacacuacugugugauaucggcgaaucgagcccgucaccgacgguggaggaaagccgcaccauacggguacugaagauggucgagcccuggcucaagaacaaccaguucuguaucaaagugcucaacccuuacaugccgaccgucaucgaacaccuugagcgccugcagcguaaguacggcgggaugcucguccgaaacccgcuguccagaaacagcacccacgaaauguacuggaucagcaacggcacagggaauaucguuagcuccgucaauauggugagcagacugcucuuaaaccgcuuuacaaugacccaccguaggcccaccaucgagaaagacgucgaccugggcgcgggcacgcgccauguuaacgcugagccagagacacccaacauggacgugaucggcgagcggaucaagcgcaucaaagaggaacacucuagcacauggcacuaugacgaugagaacccuuacaagaccugggccuaccacggcucuuacgaagucaaagcuacggguucagcaagcuccaugaucaacggaguugugaaacuacugacgaagcccugggacguaguaccgaugguaacccagauggcaaugaccgacacgacccccuuugggcagcagcguguguucaaggagaagguggacacccgcacaccccggccuaugccuggcacgagaaaggugauggagauaaccgcggaguggcucuggcggacccuggguagaaacaagaagccccgacugugcacccgugaggaguuuacgaaaaagguccgaacgaaugcagccaugggggccguauucaccgaggagaaccaaugggacuccgcgcgggcugccgucgaggacgaggaguucuggaagcugguggaucgagagcgggaguuacacaagcuaggcaagugcgggaguugcguguacaauaugaugggcaagcgcgagaagaagcugggggaguucggaaaggccaagggcagccgggccauaugguacauguggcucggugcucgcuaccuggaguucgaggcccuggguuuccucaacgaggaccacugguucuccagggagaauagcuauuccgggguggaaggggagggguuacacaagcuggguuauauccuccgggacauuaguaaaauccccggcggggccauguaugccgacgauacugccggcugggacacgcggaucacggaagacgaccugcacaaugaagagaagaucacccagcagauggaucccgagcaccgacaacucgcguccgccauauucaaguugaccuaucaaaacaagguugugaagguccaaaggccgacgcccaaggggaccgugauggacaucauuagcaggaaggaucagcggggaagcggccaggucgggaccuacggacugaacaccuucaccaacauggaagcgcaguuaguccgccagauggaaggggagggcguccucucgaaagcagaucuagagaacccgcaccuucucgagaagaaaaucacgcaguggcuggaaaccaaagggguggaacggcugaaacgcauggccauauccggggacgacugcguugucaagccuaucgaugaccgguucgcaaacgccuuacucgcccuaaacgacaugggcaagguccgcaaggauaucccgcaguggcaacccagcaaaggauggcacgacuggcagcaggucccuuucugcucccaccauuuccacgaguugauuaugaaggacggccggaaacuggucgugccaugucgcccgcaggacgagcugaucgggcgugccagaaucagccagggagcaggcuggucgcucaaggagacagcuugccugggaaaagccuacgcccaaauguggucacugauguauuuccaccgacgggaccugcgccuggcguccaacgccaucugcagcgcugugcccguucacugggugcccaccagcaggacaaccugguccauccaugcgcaccaccaauggaugaccacagaagacaugcugacgguuuggaaucggguuuggauugaggacaaccccuggauggaggauaagacuccugugaccaccugggaggacgugcccuaccugggaaagcgggaggaccaguggugugggagccugauaggucugacgagucgcgccacgugggcgcaaaauauccucaccgcgauccagcaaguccggaguuugaucggugacgaggaguuccuggacuacaugcccuccaugaagagauuccgcaaggaggaggagagcgagggagccaucugguag

SEQ ID NO: 26209 - RNA, 9873 nt, Artificial Sequence
  derived and/or modified CDS sequence (opt11) from DENV-3__DQ675533__SS-prME
acaagccugugccucaugaugauccugcccgcugccuuagcguuccaccucaccucgcgggacggggagccccggaugaucguggggaagaacgagcggggcaagagccuccuguucaaaacggcaagcgguaucaacaugugcacccucaucgccauggaccugggugagaugugcgacgacaccgugaccuacaagugcccacacaucaccgagguggagcccgaggauauagacugcugguguaaccugacaagcaccuggguaaccuacgggacuugcaaccaagccggcgagcaucggcgcgacaagcggagcguggccuuagcgccccacguugguaugggacuggacacccgcacccagaccuggaugagcgcugagggcgccuggcgccagguggagaaggucgagacgugggcccugcgccauccaggauucacaauucuugcgcuguuccuggcucacuacaucggcaccucccucacccagaaagugguuaucuucauacugcugaugcucgucacgcccagcaugaccaugcggugcgugggcgugggcaaucgcgacuuugucgagggccuuuccggggccacuuggguggacgugguccuggaacacggcgguugcgugacgacgauggccaagaacaagcccacccucgacaucgagcuucagaagaccgaggccacacagcuggcgacgcuccggaagcuguguauagaggggaagauaaccaacaucaccaccgacucccgcugccccacgcagggcgaagccgugcugccggaagagcaggaccagaacuacgucuguaagcacaccuacguggaccggggguggggcaacgggugcggacucuucgggaagggcucccuggugaccugcgcaaaguuccagugccuagagcccauugagggaaaggucgugcaguacgagaaccuuaaguacaccgugaucaucacgguccacacgggggaucagcaccaggucggaaacgaaacccagggggucaccgccgagaucacaccccaagccagcacccaugaggcgcugcuacccgaguauggcacccucggauuggagugcuccccccgcaccggccuggauuucaacgagaugaucuugcucaccaugaaaaacaaggccuggauggugcaccggcagugguucuuugaccuuccccuucccugggccagcggagccacgaccgagaccccgaccuggaaccgcaaggagcuguuggugacguucaagaacgcacacgcaaagaagcaggaagucgucgugcucgggagucaggagggcgccaugcauaccgcguugaccggggccaccgagauccaaaacucaggcgggacguccaucuucgccggccaccugaagugucgccuaaagauggacaagcuggaacugaaggggaugagcuacgcgaugugcaccaacaccuuuguccucaagaaggagguguccgaaacccaacacgguacgauccugaucaaaguggaguacaagggagaagaugccccgugcaagauacccuucucaacugaagacgggcaggggaaggcccacaauggccgccugaucaccgccaaccccgucgugaccaaaaaggaggagcccgugaacauugaagcggagccgccuuucggggagagcaauaucgugaucggaaucggggacaacgccuuaaagaucaacugguacaaaaagggcucaagcaucgggaaaauguucgaggcuacggcccggggggccagacggauggccauccugggcgacacagcgugggacuucgguagugugggcggggugcuaaacagccugggcaaaaugguccaccagaucuucgguuccgccuacacugcccucuuuagcggcguguccugggucaugaagauuggaauagggguccugcugaccuggaucggacucaacagcaagaacacguccaugucauucuccugcauagccaucgguauaauaacccuguaccugggagcgguggugcaagccgacauggggugcgugaucaacuggaaaggcaaggagcucaagugcggcucugggaucuuugugaccaacgaggugcacacauggacggagcaguacaaguuccaggccgacucccccaagcgccuggccaccgcgaucgcuggcgccugggagaacggggucugugggauuaggagcaccacccggauggagaaccugcucuggaaacagauugccaaugagcugaacuacauucugugggagaacaacaucaagcucacggugguggucggugacacauugggcguguuagaacaggguaagaggacucucacgccccagccuauggaguugaaguacucuuggaaaacgugggggaaggccaagauuguuacugcggaaacccagaacagcuccuucaucauagacggccccaauaccccagagugccccucggccucacgcgcauggaacgucugggagguggaggacuacgguuucggcguguucaccaccaacaucuggcugaagcugcgcgaggucuauacacagcugugcgaccaccggcugaugagcgcggccguaaaggaugagcgcgcgguccacgcagacaugggcuacuggaucgagagccaaaagaacgggucuuggaaguuagagaaagcaagucugaucgaggucaagaccugcaccuggccgaagucccauacgcucuggucaaacggcgugcucgaguccgacaugaucauuccgaagagccuagccgggcccaucucccaacacaacuaucguccgggauaccacacccagacggccgggcccuggcaccuggguaagcucgagcuggauuucaacuacugcgagggcaccacgguggucaucaccgaaucuugugggacccgcggccccagucugcggaccacgacagugagcgggaaacuuauccacgaguggugcugccgcaguuguaccuugcccccacugcgauacaugggggaggacgggugcugguacggcauggagauacgccccauaagcgagaaagaggagaacauggugaagucuuuaguaagcgcggguuccgggaagguugacaacuucaccaugggcgugcugugccuggccauccucuucgaggagguuuugagagggaaauucggaaagaagcacaugauugcggggguguucuucacguuuguguuacuccuuagcggccagaucaccuggcgcgacauggcacauacccucaucaugaucggcuccaacgccagcgaccggauggggaugggcgucaccuaccuugcacugaucgccacguucaagauccagcccuuucuggcccucggguucuucuuacguaaguugaccagucgcgagaaccuccuguuaggggugggccucgcgauggcgaccaccuugcagcugcccgaggacaucgagcaaauggccaaugggaucgcuuuaggcuuaauggcccugaaauuaaucacgcaguuugagaccuaccagcuguggaccgcccugguguccuugaccugcucaaacacgauauucacccuaaccgucgcauggcgcaccgccacgcugauccuagccggagugagucuccugccggucugccaaagcuccagcaugcggaagaccgauuggcucccuaugacuguugccgccaugggugugccgcccuuaccgcugcucaucuucucccugaaggacacccuuaaacgccgcagcuggccucucaacgaggggguuauggcggugggccugguguccauccuggccagcucccuccuacggaacgauguccccauggcaggcccccugguggcagguggccuccucaucgccugcuacgucaucacgggaaccagcgcggaucugacggucgaaaaggcggccgacgugaccugggaggaagaagccgagcagacgggcguuagccauaaccucaugaucaccguagaugacgaugggacgaugcgcaucaaggacgaugagacagagaauauccugaccguucugcucaagacggcccugcugaucgugagcggcaucuucccguacuccauccccgcgacccuccuggucuggcauaccuggcagaagcagacccagcggagcggcgugcugugggacgugcccagcccucccgagacgcagaaggccgagcuagaagagggggucuaccgcauaaagcagcaaggcaucuucggaaagacucaggugggcguggggguccaaaaggaggggguauuccacacaauguggcaugugacccgaggggccgugcugacgcacaacggcaagcgccuugaacccaacugggccagcgugaagaaggaucugauuuccuacggcgggggcuggcggcuuagcgcgcaguggcagaagggugaagaggugcaggucauugcgguggagccuggcaagaaccccaagaacuuccaaaccaugccgggaacguuccaaacgacaaccggggagaucggggccauagccuuggacuuuaagcccgggaccagcggcuccccgaucaucaaccgcgagggaaaggugguugggcuguacggcaacgggguggugaccaagaacgggggguacgucuccgguaucgcccagacgaacgcggagcccgacggccccacucccgagcucgaagaggagauguuuaagaaacguaacuuaaccaucauggacuugcaccccggguccggcaaaacccgcaaguaucucccggccaucgugcgggaggccaucaagcgccggcugcgaacacugaucuuagcccccaccaggguagucgccgcagagauggaggaggcucugaaagggcugccgauucgcuaccagaccaccgcaacaaaguccgagcacaccggccgggaaauuguggaccucaugugccacgccacuuucaccaugcgccugcuuucacccguacgagucccgaacuauaaucucauuauaauggacgaggcacacuucacggaccccgcgagcaucgccgcacggggauacaucuccacucgggugggcaugggcgaggcggcggcgaucuucaugaccgccacgccgcccgggacggccgaugccuucccgcaaagcaacgcgcccauccaggacgaggagagggauauccccgagcguuccuggaacagcggcaaugaguggaucaccgauuuugccggcaagacagucugguucgugcccagcaucaaagcuggcaaugacaucgccaacugucugcgcaagaacggcaagaaggugauucagcugagccgaaagacauucgacacggaguaccagaagaccaagcucaacgauugggauuucguggucaccaccgacaucuccgagaugggcgccaacuucaaggcggaucgggugaucgacccgcgccggugccugaaacccgucauccugacggacggccccgaacgcgugauccucgccgggcccaugccggugaccgccgccagcgccgcgcagcggcgcggcagggucgguaggaacccccagaaagagaacgaucaguacauuuucaccggccagccccugaacaacgaugaggaccacgcgcacuggacggaggccaagaugcugcucgauaacauuaauacccccgaggggauaaucccggcccucuuugagcccgagcgggaaaagucagcggcaaucgacggcgaguaccgccuuaagggcgagagccggaagacguucguggagcucaugcgccgaggggaccucccaguguggcuggcccacaaggucgccuccgaggggaucaaguacaccgaccgaaaguggugcuucgacggggagcggaacaaccaaauccucgaggagaacauggacguugagaucuggacuaaggagggcgagcgcaaaaagcuccggccccgcuggcuggacgcccgaacauacuccgacccccucgcguugaaggaguucaaagacuucgcagccggucggaagaguaucgcacuggaccucgugacggagaucgggcgcguccccagccaucuggcccaucggacccgaaaugcgcuggacaauuuagugaugcuucacacuucugaacacggcggucgcgccuaccgccaugccguggaggagcugcccgaaaccauggagacgcuacugcuacucggccugaugauccuacucaccgggggagccaugcuguuccugaucuccggcaaggggaucgguaagaccagcauugggcucaucugcguuaucgccuccagcggaaugcuguggauggcggaggugccguuacaauggaucgcauccgccauuguucucgaauucuuuaugauggugcugcugauccccgagcccgaaaaacagcgaaccccccaggacaaccagcucgcguaugugguuauugggaucuuaacucuggccgcgaucaucgcggccaacgagaugggccuccuagaaaccaccaagagagaccugggcaugagcaaagaaccgggggucguuucacccaccagcuaccucgacguugaccugcaucccgcuuccgcguggacucuguacgccguggcuaccacaguaaucacccccauguugagacacaccaucgaaaacagcaccgcuaaugugagccuggccgcgauugcaaaccaagcgguuguacugaugggucucgacaagggauggccgaucagcaagauggaccugggcguaccacuccucgcauugggcugcuauucucaggucaacccgcugacccugaccgcugccgugcugcuucucaucacgcauuacgccaucaucggccccggcuugcaggccaaggccacccgggaggcccagaagaggacggcggccgggauaaugaagaauccgaccguggacggcaucaugacaaucgaccuggaccccgucaucuacgacucuaaguucgagaagcagcucggccaggucaugcugcuggugcucugugccguccagcucuuacucaugcggaccuccugggcccugugugaggcgcugacccucgcgaccgggcccaucacgacccuuugggagggcagcccagggaaguucuggaauaccacgaucgccgugucuauggcgaacaucuuccgggguagcuacuuggccggggcgggucucgccuucuccauaaugaaguccguggggacgggcaagcgcggaaccgggagccagggcgagacgcugggugagaaguggaagaaaaagcugaaucagcucucccggaaggaguucgaccuguacaagaaguccgggaucacugaggucgaccgcaccgaggccaaggaagggcucaaaaggggagagacgacccaccacgccgugucacgcggcagcgccaagcuccagugguucguggagcggaacaugguggugccggagggacgcgugaucgaccuaggcugcgggcggggcggcugguccuacuauugcgcgggccugaagaaagucaccgaaguccgcggauacaccaagggcgggcccgggcacgaggaaccugugcccaugagcacguacggauggaacaucgucaagcugaugucggggaaggacguauucuaucucccaccggagaagugcgacacgcugcucugcgacaucggcgagagcagccccagcccgaccguggaggaaucaagaaccauccgggugcucaagaugguggagccguggcuuaagaauaaccaauuuugcaucaagguucugaaccccuacaugccuacagucaucgagcaucucgagcgccugcaaaggaaacacggagggaugcuggugcguaauccacucagccguaacucaacucacgagauguacuggaucucgaacgggaccgggaauaucguguccagcgucaacauggugucccgccuuuuauugaaccgguuuacaaugacgcaccgccggccaacuaucgagaaggauguggacuugggcgccggcacacgccacgucaacgcugagcccgagacccccaacauggacgugaucggggagcggaucaagcguaucaaggaagagcacaacagcacguggcacuaugacgacgagaacccauacaagaccugggcauaccacggguccuacgaagucaaggccacggggucggccucuuccaugaucaauggagugguuaagcugcucacaaagcccugggacgucgugcccauggucacgcaaauggccaugaccgacacgacccccuucgggcagcagcgggucuucaaggagaagguggacacgaggaccccgaggcccaugcccgguacccgcaaggugauggaaauaaccgccgaguggcuauggcggacguuaggccgcaauaagcggccucggcucugcacccgcgaggaguucacgaagaagguucgaaccaacgccgcgaugggggccguauucacagaagagaaccagugggauucugccaaggccgccguggaagaugaggaguucuggaagcugguugaccgcgagcgggaguugcacaagcuuggcaagugugggucaugcguguacaacaugaugggcaagcgcgagaagaaguugggggaguucggcaaggcaaagggcagccgagccaucugguacauguggcucggcgcccgcuaccucgaguucgaagcccugggcuuucuuaacgaagaccauugguucucccgggagaacagcuacuccggggucgagggugagggacuccacaaguuaggcuauauacugcgcgacaucagcaagauaccgggcggggccauguacgcggaugacacugccgguugggauacccgaaucacggaagaugacuugcauaacgaggagaagaucauccagcagauggaccccgaacaccgccagcuggcaaacgcgauuuucaaacugacguaccagaauaagguagugaaagugcagcggcccacccccacagggacugucauggauaucaucucccgcaaggaccaacggggcagcggacaaguuggaacguacggccucaacacauucaccaacauggaggcucagcugguacgccagauggaaggugagggaguccuuacuaaagccgaccucgagaacccgcaucuccuggagaaaaagaucacccaauggcucgagacgaaggggguggagcggcugaagcgcauggccauauccggcgacgauugcgugguuaaaccuaucgaugaccgauuugcaaaugcacugcucgcccugaacgauaugggcaaggugcgcaaggauaucccccaauggcagccgagcaagggguggcacgacuggcagcaggucccauucugcucccaccauuuccaugagcugaucaugaaggaugggcgcaaacuagucguccccugccgcccccaggacgagcuaauuggcagagcacgcauuucucaaggggccggguggucccugcgcgagaccgcgugccucggcaaggccuacgcgcagauguggagccugauguacuuccaccggcgcgaucugcgacuggccuccaaugccaucugcagcgccguuccaguacacugggugccgaccucccgcacaacuuggagcauccacgcacaucaccaguggaugaccacagaagacaugcuuaccguguggaaucgugucuggauagaagagaaccccuggauggaagauaagacgcccgugaccaccugggagaaugugccguaucugggcaagcgcgaggaccagugguguggcucucucaucgggcugaccucccgggcgaccugggcgcagaacaucccgaccgccauucagcagguccgcucucugaucgggaacgaggaguuccucgacuacaugcccuccaugaaacgguuccgcaaggaagaggagagcgagggcgccauaugguag

SEQ ID NO: 26210 - RNA, 9873 nt, Artificial Sequence
  derived and/or modified CDS sequence (opt11) from DENV-3__AY744677__SS-prME
accagcuuaugccucaugaugaugcuccccgcgacccuggccuuccaccucaccagccgggacggcgaaccccggaugauaguggggaaaaacgagcggggcaaaagccugcuguucaaaaccgcgagcgggauuaauaugugcacccucaucgccauggaccucggggagaugugcgacgauacugugaccuacaagugcccccugauaaccgagguugaacccgaggacaucgacuguuggugcaaccucacuucaaccugggugaccuacgggaccugcaaccaggccggcgagcaucggcgcgacaagcgaagcguagcccuggcgccccacgucggcauggggcuggauacccgcacccagaccuggaugagcgcggagggcgccuggcggcaggucgagaagguagagaccugggcguucaggcaccccggguucacgauccucgcccuguuccuggcgcacuacaucggcaccucccucacccagaagguggugaucuucauccugcugaugcuagucacacccucaaugacuaugcggugcgugggugugggcaaccgagacuucgucgagggccuguccggcgccacuuggguggacguuguccuggagcacggcgggugcgugacgaccauggcaaagaacaagccgacccucgacauugagcugcagaagaccgaggcaacgcagcuggccacccuccggaaacuauguauugagggcaagauaaccaacguuaccacggauagccgcugcccgacccagggcgaggcgauacugccagaagaacaagaccagaacuaugugugcaagcacacauauguggaccggggguggggcaaugggugcggccuauucgggaaaggcucucuggugaccugcgccaaguuccagugccuggagaguaucgagggcaaggcuguccagcacgagaaccucaaguacaccguaaucauuacugugcacacaggggaucagcaccaagucggcaaugaaacgcaaggugugacggccgagaucacuccccaggccuccaccgucgaggcgauucugcccgaguacgggaccuuagggcucgagugcagcccccggacuggucuggauuucaacgagaugauccugcucaccaugaagaauaaggcuuggauggugcaucggcagugguucuucgaccuaccgcugccuuggaccucgggggcaaccaccgagacgcccaccuggaacaagaaggagcucuuggugacguucaagaacgcccacgccaagaagcaggaggucguaguucucgggucccaggagggugcgaugcacaccgcgcucacaggugcuaccgagauccaaaccuccggcgggaccagcaucuucgccggccaccuaaaaugccgacuuaagauggauaagcucgagcugaagggcaugucauacgcuaugugucucaaugcguucgugcucaagaaggaagugagcgagacgcaacacggcaccauucuuaucaaggucgaguacaaaggcgaggacgcccccugcaagauccccuucagcaccgaagacgggcagggcaaagcccauaacgggcgccugaucacggccaacccgaucgucacgaaaaaggaggagcccgugaacauugaagcggaaccacccuucggggaguccaacauagucaucggcaucggggacaaggcgcugaagaucaacugguacaagaagggcagcucaaucgggaagauguuugaggccaccgcccgcggcgcacggcgcauggcaauccucggcgacaccgccugggacuucgggagcgucggaggggugcugaacuccuugggaaagauggugcaccagaucuucgguagcgcuuacaccgcccucuucuccggcgucagcuggaucaugaagaucggcaucgggguucugcugacguggaucggccugaacagcaagaacacaagcauguccuuuaguugcauagucaucgguaucaucacccucuaucucggcgcagucgugcaagcggauauggggugcgugaucaacuggaaaggcaaggagcucaaaugcggcucagggaucuucgucaccaacgaggugcauacguggaccgagcaguacaaguuccaggccgacagccccaaacggcuugccaccgccauugcaggggcgugggagaauggggugugcggcauccgcuccacaacgcgcauggagaauuuacuguggaagcaaaucgccaacgagcuuaacuacauucugugggagaauaacauuaaacuuaccauaguggugggggacgugaucgguguccuggagcagggcaagcggacacugacgccccagccaauggagcucaaguacagcuggaagacgugggggaaggcuaaaaucgugacagccgagacccagaacuccuccuuuaucauagacggaccgaacaccccggagugcccuuccgcgucgcgcgccuggaacgugugggaagucgaggacuauggguucggcguguuuaccaccaacauauggcugaagcuacgcgaaauguacacccagcucugugaccaccgccuaaugagcgccgccgucaaggacgagcgggccguccacgccgacaugggcuacuggauugagucccaaaagaacggcagcuggaaacuugagaaggccucucuaauagaagugaagacuuguaccuggccaaagagccacacccuaugguccaacggcguguuagagucagacaugaucauccccaagagcuuagcagggcccauaagucagcacaacuaccgacccgguuaccacacccagaccgccggaccuuggcaccugggcaagcucgagcucgauuuuaauuacugcgagggaaccacggucgugauaacugagaacugcgggacccggggccccucacuacgcacgacgacgguuagcggcaagcugauccaugagugguguugccggucaugcacgcugccaccccuccgcuacaugggggaggacggcugcugguacggcauggagauccggccgaucaacgaaaaagaggagaacauggucaagagccucgugucugcggggagcgggaaggcggacaauuuuaccaugggcguacucugucuggccauauuauucgaggaaguaaugcgcgggaaguuuggcaaaaagcauaugaucgcuggcgcccuauuuacguucguacugcuguuguccggccagauaaccuggcgggauauggcccacacuuuaauuaugauuggcucuaacgcuuccgaccgcaugggaaugggcguaacuuacuuggcccucaucgccacguucaagauccagccguuccuggcccuaggcuucuuccuccguaagcugaccagccgcgagaaccuacuccugggaguaggucuggcgauggcaaccacccuccagcugcccgaggacaucgagcagauggccaacggaaucgcccugggccucauggccuuaaaacugaucacgcaguucgagaccuaccaguuauggacugcgcucgugagucugaugugcuccaacaccauauucacgcugaccguggcguggcggaccgccacccugauccuggccgucaucucgcucuugccugugugccagagcucuagcaugcgcaagacggacuggcugccgaugaccgucgccgcaaugggggucccgccccucccccuguucaucuucagccuaaaagacacccucaagcgacggucguggccgcugaacgagggagugauggcugucggguuggugagcauucucgcguccagcuuucuacgcaaugacgugcccauggcgggcccccugguugccggagggcuccuaauugcgugcuacgugauaacaggcacaagugccgaccucaccguggagaaggcggccgacgucacuugggaagaggaggccgagcagaccggggugucgcacaaccucaugaucacgguggacgacgacggcaccaugcggaucaaggacgacgagaccgagaauauucuuaccguccugcucaagacugcgcuucugauugugucggggaucuuucccuauagcauuccggcuacgcuccuaguguggcacaccuggcaaaagcagacgcagagguccggcguccugugggacguccccuccccgcccgagacccagaaggccgaacucgaggagggcguguauagaauuaagcaacaggggaucuuuggcaagacucagguggggguaggcgugcagaaagagggugucuuccacaccauguggcaugugacccgcggcgcuguccugacccacaauggcaagcgguuagaaccgaacugggcgaaugucaagaaagaucucaucuccuacgggggaggguggaaguuaagcgcccaguggcaaaaaggcgaggagguccaagugaucgccgucgagcccgggaagaaucccaagaacuuccaaacgaugcccggaauuuuucagaccacgaccggggagaucggggccaucgcccuggauuucaagcccggaacguccgggucucccaucaucaaccgcgaagguaagguggugggccuauacgguaauggcgucgugacuaaaaacggggguuacgugagcgggaucgcccagaccaacgcagagccggacgggccgacccccgaacucgaggaggagauguucaagaagcggaaccugacgauaauggaccuacaccccggcuccgggaagacacgcaaguaucuccccgccaucguccgggaggcuaucaagcgccggcugcgcaccuuaauacucgccccgacccggguggucgccgcggagauggaagaggcucucaagggacugcccauucgcuaccaaacuacugccacuaagagcgagcacacgggucgggagaucgucgaccucaugugucaugcaacuuucaccaugcgcuuacucagccccgugcggguacccaacuacaaccucaucgucauggacgaggcgcauuuuacugacccggcaagcaucgcagcccgcggcuacaucuccacccgggucgggaugggcgaggcggccgccaucuucaugacggcaacgccgcccggcacugccgacgcauucccccaaagcaacgccccgauccaggaugaggagcgcgauauucccgaacgguccuggaacuccgggaacgaguggaucacagacuucgccggcaagacggugugguucguccccuccaucaaggccggcaaugacaucgccaacugcuuacggaagaacggcaagaaggugauccagcugucacgcaagaccuucgacacagaguaccagaagaccaagcuaaaugacugggacuucguagugacgaccgacauauccgagaugggggcgaacuucaaggccgaccgcguuaucgaccccagaaggugccuuaagccggugauccugacagacgggccggaacgcgucauccucgccggcccuaugcccgugacaguggccagugccgcacagcggcgcgggcgggucggccgcaacccgcagaaggagaaugaucaguacaucuucacagggcaaccccugaacaacgacgaggaccacgcccacuggaccgaagcuaagaugcugcucgacaacaucaacacccccgagggcauuauccccgcacucuucgagccggagcgcgagaagucugcggccaucgacggugaauaccgccugaagggggagagcagaaagacguuugucgagcucaugaggcggggagacuuaccagucuggcuggcccacaagguugccuccgaaggaaucaaguauaccgacaggaaguggugcuuugacggcgagcggaauaaccaaauacucgaggagaacauggacguggagaucuggacaaaggaaggugagaagaagaagcuacgacccagauggcuggaugcccgaacguacuccgacccucucgcgcucaaggaguucaaagauuuugccgccgggcggaaguccauugcccuggaucucgucacugaaaucggacgcgugccgagccaccuggcgcaccgcacccggaaugcucuggacaaccucgugaugcugcauacuuccgagcacgggggccgcgcuuacaggcacgccgucgaagaacugccagagaccauggagacgcuacuccugcuugggcugaugauccugcucaccggcggggccaugcuguucuuaaucucggggaagggcaucggaaagacaagcauaggccucauuugcgugguggccucuagcgggaugcuguggauggcggaugucccccugcaguggaucgccuccgcgauagugcucgaguuuuucaugaugguccugcugaucccggagcccgagaagcagcgcacgccacaggacaaccagcucgccuauguagugaucgggauccugacacuggccgcgaucguggccgccaaugagauggggcuacuggagaccacgaaacgggaccuggguaugagcaaggagccaggcgucgugucgccgacaagcuaucucgacguggaccugcaccccgccuccgcguggacccuguacgccgucgcgacuacggugaucacccccaugcugcgccacacgaucgaaaacagcaccgccaacgugucccucgccgcgaucgccaaccaagccgucgucuugaugggccucgacaagggcuggcccaucagcaagauggaccugggugugccgcugcucgcccugggcugcuacucccaggucaacccacuuacgcucaccgcugcggugcugcugcucgugacccacuacgcgaucaucgggcccggacugcaggccaaagccacucgggaggcccagaaacgcacggcagccggcaucaugaagaaucccacuguggacgggaucaugaccaucgaccuggacccggugaucuacgacagcaaguucgagaagcagcucggccaggugaugcuccucguccucugcgccgugcagcugcugcucaugcggaccaguugggccuucugcgaggcgcugacgcuggccaccgggccgaucaccacauuaugggagggcucgcccgguaaauucuggaacacgaccaucgccguauccauggccaacaucuuccgcgguucauaccuggccggugcggggcuggccuucuccaucaugaaguccgucggcaccgggaagcggggcaccggcagucagggggagacccucggcgagaaguggaagaaacgccugaaccaacugucacggaaggaauuugaccucuacaagaaauccgggaucacagagguagaccgaaccgaggccaaggagggcuugaagcgcggggagauuacacaccacgccgugucacguggcagcgccaagcugcagugguucgucgagcggaauauggugauccccgagggacgcgugauagaccucgggugcggucgcgggggcugguccuacuacugcgcggggcugaagaaagugacggaggugcgcggcuacacgaaaggagggccgggacacgaggagcccgugcccaugagcacguacggguggaacaucguuaagcugaugucaggcaaggacguguuuuaccucccgcccgagaaaugugacacccugcugugcgacauuggggagagcucccccagccccaccguggaggagucccggacgauccggguccuuaagaugguggagcccuggcucaagaauaaucaguucugcaucaaggugcugaaccccuacaugcccacugucaucgagcaccuggaacgccuacagcgcaagcacggcgguaugcuggugcguaaucccuugucgagaaauuccacccacgaaauguacuggaucagcaaugggaccggcaacaucguguccagcgucaacaugguguccaggcugcugcugaaccgguuuacgaugacgcacagacggccuaccauagagaaggauguggaccucggggcgggcacccgccaugucaaugcagagccggagacgccaaacauggacguaaucggagagcggauccgccguaucaaggaggaacacagcuccaccuggcacuacgaugacgagaauccauacaagacaugggccuaccauggguccuacgaggucaaggccaccgguuccgcgagcagcaugaucaacggcguggugaaacugcugacgaagccuugggacguaguacccaugguuacccagauggccaugaccgacaccacgcccuucggacagcagcggguauucaaggagaaaguggauacucggacgccccggccgaugcccgggacgcgcaagguuauggagauaacggccgaguggcuauggcgcacccugggccguaauaagagaccgcggcugugcacccgcgaagaguucaucaagaagguccgcaccaaugccgcgaugggcgccguguucacggaagagaaccagugggacuccgcgagggcggcuguggaggacgaggaguucuggaagcucguugacagagaacgggagcugcacaaacuggggaagugcggcuccugcguguacaacaugaugggaaagcgcgagaagaagcucggugaguucggcaaggcgaagggcucccgagccaucugguacauguggcuaggcgcucgguaucuggaguucgaagccuugggguuuuuaaacgaggaucauugguucagcagagaaaacuccuacagcggcguggagggggaaggccugcacaagcucggcuacauccugcgcgacaucuccaagauccccggcggcgccauguacgcggacgacaccgccgggugggacacccggaucacagaggacgaccuucacaacgaggagaagaucacgcagcagauggauccggaacaccgucagcucgccaacgccaucuucaagcugacuuaccagaacaagguagugaaagugcagcggccaacucccaagggcaccguaauggauauuaucagucgcaaggaccagagagguuccggccaggugggcacauaugggcugaacacuuucaccaacauggaggcgcagcucauccggcagauggagggcgaaggggugcugagcaaggcggaccuggagaacccccaucuccuggagaagaaggucacccaguggcuggagacaaagggcguggagcggcuaaagcgcauggcuaucuccggagacgacugugugguuaaaccaaucgacgacagauucgccaacgcucuacuggcccucaaugacauggggaaggugcgcaaggacaucccccaauggcagccuagcaaagguuggcaugacuggcagcagguccccuucugcucccaucauuuccaugagcucauuaugaaggacgggcggaaacuggucgugccgugccgcccccaggacgagcucauuggccgggcucgaaucagccagggggccggauggucccugcgcgagacggcaugccucgggaaggccuacgcgcagaugugggcccucauguauuuccaccgccgcgaccugcggcuggccagcaacgcgaucuguuccgccguacccguccacuggguacccaccagccgcaccaccugguccauccaugcgcaucaccaguggaugacgaccgaggauauguuaaccguguggaacagagucuggaucgaggacaacccauggauggaggacaagacccccguaacgaccugggaagacgugccguaccugggcaaacgcgaggaccaguggugcgggagccugaucggguugaccagccgggcgaccugggcccagaacauacugacggccauccagcagguacguucacugaucggcaacgaggaguuccucgacuauaugcccucuaugaaacgguuccggaaagaggaggaguccgagggagcuaucugguag

SEQ ID NO: 26211 - RNA, 9873 nt, Artificial Sequence
  derived and/or modified CDS sequence (opt11) from DENV-3__AY744678__SS-prME
acgagucugugcuuaaugaugaugcugcccgccacccuggccuuccaccucacuagccgcgacggcgagcccagaaugaucguagggaaaaacgagagaggcaagagccugcuguuuaagaccgccaguggaaucaacaugugcacccucaucgccauggaucugggcgagaugugcgaugacaccgugacguacaaaugcccucugaucacagagguggagcccgaggacaucgacugcuggugcaaucucaccagcaccugggugaccuacggcaccugcaaccaggccggcgagcaccggcgcgacaagcggagcguggcccuggcgccccacgugggaaugggccuggacacgcgcacccagaccuggaugucugcggagggcgccuggcgccaggucgagaaggucgagacaugggccuuccgccaccccggguucaccauccucgcccuguuccuggcacacuauaucggcacgucacucacccagaagguggugaucuucauccugcuaaugcucgugacccccagcaugaccaugcggugcgugggggugggaaaccgggacuuuguagagggccugagcggggccacuuggguggacgucguacuggaacacggcgggugcgugacgaccauggcaaagaacaagccgacccucgauaucgaacugcagaagacggaggccacgcagcuggccacacucagaaagcugugcaucgaaggcaagaucaccaacgugaccacggacagccgcugcccaacccagggcgaggcgauucugcccgaagaacaggaccagaacuacgucugcaagcauaccuacguggaccggggguggggcaacgggugcggccucuuugggaagggcucccuggugacuugcgccaaguuccagugccuggagagcaucgaaggaaaggccguacagcacgagaaccucaaguacacggugauaauuacggugcacaccggagaccaacaccaggucggcaacgagacccagggggucacggccgagaucacgccccaagccagcaccgucgaggcgauacugcccgaguacgggacccuggggcucgaguguagcccccgcaccggccuggacuucaacgagaugauauugcucacgaugaagaacaaggccuggaugguccaccggcagugguuuuucgaucugccgcuucccuggaccucaggggccaccaccgagacgccuaccuggaacaagaaagagcuccuggugacuuuuaagaacgcccaugccaagaagcaggaagucgucgugcuggggagccaggagggcgcuaugcacaccgcguugacgggggccaccgagauucaaaccucgggcgggacaagcaucuucgccggccaccuuaaaugccgccugaagauggacaagcucgagcugaagggcauguccuacgcuaugugccugaacgcguucgugcucaagaaagaggucucggagacgcagcacgggaccauucugauaaagguagaguacaaaggcgaggaugccccuugcaagaucccguuuagcaccgaggacgggcagggaaaggcacauaacggccggcucaucaccgcgaaccccaucgucacgaagaaggaggagccagugaacaucgaggcggaacccccguucggggaguccaacauugugaucggcaucggugacaaggcccucaaaaucaacugguacaagaagggcaguuccaucgggaagauguuugaagcaaccgcccgcggcgcccggcgcauggcgauccucggcgacacagccugggacuucgggucagucggcggggugcugaacucccugggcaagauggugcaccagaucuucgggagcgccuacaccgcccucuucucuggcgucagcuggaucaugaagaucggaauuggggugcugcucacguggaucgggcucaacuccaagaacaccagcauguccuucucuugcauuguaaucgggauaaucacccuguacuuaggugccgucguucaggcggacauggggugcgucaucaacuggaagggcaaggagcucaagugcggcuccgggaucuucgucaccaaugaggugcacacguggaccgagcaguacaaguuccaggccgacagccccaagcgccuugccaccgccaucgccggcgcgugggagaacggugugugcgguauccgauccaccacgcgcauggagaaccugcucuggaaacagaucgccaacgagcugaacuacauccugugggagaacaacaucaagcucaccaucgucguaggggacgugaucggcguccuggaacagggcaagcggacccucacgccgcagcccauggagcuuaaguacagcuggaagacgugggggaaggccaagaucgugacggccgagacccagaacuccagcuucaucaucgacggccccaacacucccgagugucccuccgcuagccgagccuggaacgugugggaggucgaggauuacggguucggcguguucacgaccaacaucuggcucaagcugcgggagauguauacccagcucugugaccaccgccugaugagcgccgccgugaaggacgagagagccguccacgccgacaugggcuacuggaucgagucccagaagaacgggagcuggaagcuggagaaggccucccuaaucgagguuaagaccugcacguggcccaagagccacacgcugugguccaauggagugcucgagagcgacaugaucaucccgaagucccuggccgggcccaucagucagcacaacuaccgccccggcuaccacacacagaccgccgguccguggcaccugggcaagcucgaacucgacuucaacuacugcgagggcaccacggucguaaucacagagaacugcgggacucggggcccaucccugcgaaccacgaccgugagcgggaagcugauccacgaguggugcugccguuccugcacccugccgccgcuccgcuacaugggcgaggacgggugcugguacggcauggagauccgucccauaaaugagaaggaggagaacauggucaagagccugguguccgccggcagcgggaaggcggacaacuucacgaugggcgugcucugccuggccauccuguucgaggaggucaugcgcggcaaguucggcaagaagcacaugauagccggggcccucuucacguucguucugcuguuauccggccagaucaccuggcgggauauggcccacacccugaucaugaucggcagcaacgcuucagaccgcauggguauggguguuaccuaccuggcccucaucgccacguucaagauccagcccuuccuggcccugggguucuucuugaggaaacugaccagccgcgagaaccugcuccugggcgucggccuggcgauggccaccaccuugcaguuacccgaagacaucgagcagauggccaacgggaucgcccugggucucauggcccugaagcugaucacgcaguucgagaccuaccagcucuggacggcgcugguuagucugaugugcuccaauacuaucuuuacccucaccguagccuggcggaccgccacccugauacuggccgucaucagccuguuacccguuugccaguccagcuccaugcgcaagacggacuggcugccgaugaccguggcugcgaugggggugccgccccucccccuguucaucuucagccugaaggauacccucaaacggcgcuccuggccucugaacgagggcgugauggccgucgggcuggugucuauccucgccuccagcuuucugcgcaacgacgugcccauggccggcccccuggucgccggcgggcuccugaucgcaugcuacgugaucaccgggacguccgccgaccugaccguggagaaggcagccgacguaaccugggaggaagaggccgaacagaccggggucagccacaaccucaugauuacaguggacgacgacggcaccaugcggauaaaggacgacgaaaccgagaacauucugaccgugcugcucaagaccgcgcugcugaucguguccgggaucuucccauacagcauacccgccacccuccugguguggcacaccuggcagaagcagacccagcgcuccggcguccugugggacgugcccuccccacccgagacacagaaggccgagcuggaggaggggguguaccggaucaagcagcaggggaucuucggcaagacgcaggucggggugggcgugcagaaggagggggucuuccacacuauguggcacgugacccgcggcgccgugcugacgcacaacgggaagcggcuggaaccgaacugggcgaacgucaaaaaggaccuaaucuccuacgggggaggcuggaagcugagcgcccaguggcagaagggcgaggagguacagguuaucgcggucgagcccgggaagaaccccaagaacuuucagacgaugcccgguaucuuccagaccacuaccggcgagaucggggcaauagcccucgacuucaagccugguacuuccgguagccccaucaucaaccgcgagggcaaggucguggguuuauacgggaacggcgucgugacgaagaacgggggcuacguguccgggaucgcucagacaaacgccgaaccggacggcccgacccccgagcuugaggaggagauguucaagaagcguaaccugacgaucauggaccuucaccccggcuccgggaagacccgcaaguaccuucccgccaucguccgggaggccaucaagcgccgccugcgcacccugauccucgcaccaacccgggugguggcggcugagauggaggaggcucugaaaggccugcccauccgcuaccagacgaccgccaccaaaagcgaacacaccgggcgggagaucgucgaccucaugugccacgccacguucaccaugcgccugcugucccccguacgggugcccaacuacaaccucaucgucauggacgaggcgcacuucaccgacccggccagcauagcagcccgcggcuacauauccacccggguggggaugggcgaggcggccgcaaucuucaugacggccaccccgcccggcaccgccgacgcguucccccagagcaacgccccgauccaggacgaggagcgcgacauccccgagcgguccuggaacagcgggaacgaguggaucaccgacuucgccggcaaaacgguaugguucguccccuccaucaaggccgggaacgacauagccaauugucugagaaagaacggcaagaaggugauccagcugagccgcaagaccuucgacaccgaguaccagaagacuaagcucaacgacugggacuucguggucacgacugacaucucagaaaugggggcgaauuucaaggccgaccggguaaucgacccccgucggugccugaagccggugauccugaccgacggccccgagcgcgucauccuagccggucccaugcccgucacuguggccuccgccgcgcagcggcgcgggcgggucggccgcaacccgcagaaggagaacgaccaguacaucuuuacggggcagccccuuaacaacgaugaagaccacgcccacuggaccgaggccaagaugcugcucgacaacaucaacacacccgagggcauaauccccgcccuguuugagccggagcgggagaaguccgcggccaucgacggggaguaccgucugaagggcgaaagccggaagaccuucguggaacucaugcgccggggcgaccugcccguguggcuagcccacaaagucgcuuccgaggggaucaaguacaccgaccgcaaguggugcuucgacggcgagcggaacaaccagauccucgaagagaacauggacguggagaucuggacaaaggagggggagaagaaaaagcugaggccccgguggcuggacgcgcgcacuuacuccgacccccucgcgcugaaggaguuuaaggacuucgccgccggccggaaaucgauagcccuggaccucgucacagagauaggccgcgugccgagccaccuggcccacaggacccggaacgcgcuggacaaccucgugaugcugcacacguccgagcacgggggccgcgccuaccggcacgccgucgaggagcugcccgagaccauggagacccuccugcugcucgggcuaaugauccugcucaccggcggcgccaugcuguuccugaucagcggcaaaggcauugggaaaacgagcauuggccucaucugcgugguggccagcagcgggaugcuguggauggcagacgucccccugcaguggaucgccucggccaucguccucgaauuuuucaugaugguguugcugaucccggagcccgaaaagcagcgcacgccccaggacaaccagcucgccuacguugugaucggcauucugacccuggccgcuaucguggccgccaacgagaugggauuacuugagaccacgaagagagaccugggcaugagcaaagagcccggcgucgugucaccgaccagcuaccuagacguggaccugcaccccgcaucugcguggacgcuguacgccgucgccaccacagugaucacccccaugcuccgccacaccauagagaacagcaccgccaacgugucucuggccgcgauugcgaaccaggccguaguguuaauggggcucgacaagggcuggcccaucagcaagauggaccugggggugccgcuccuagcccugggcugcuacagucaggucaauccgcugacucucaccgccgcugugcugcuguuagucacccacuacgcuaucauugggcccggccuacaggccaaggcuacccgggaggcccagaagcgcacggcggccggcaucaugaagaaccccacuguagacgggaucaugacuaucgaccuggacccggugaucuacgacagcaaauucgagaagcagcucggccaaguaaugcugcugguccucugcgccgugcagcugcuguuaaugcgcaccagcugggccuucugcgaagcgcugacgcuggccacggggcccaucaccacccucugggaaggcagccccggcaaguucuggaacacgacgaucgccguguccauggccaacaucuuccgcggcagcuaccuggccggcgcgggacuggccuucuccaucaugaaguccgucgggaccgguaagcggggcaccgguucccaaggggagacguuaggcgagaaguggaaaaagaagcugaaccagcuaucccgcaaggaguucgaccucuacaagaaguccgggaucaccgagguggaccggaccgaggccaaggagggccugaaacgcggggaaaucacccaccaugccgugucucgggguagcgccaaacugcagugguucguggagcgcaacauggugauccccgaaggccgggugaucgaccucgggugcggccgcgggggcugguccuacuauugcgcggggcuuaaaaaggucaccgaggugagaggguacaccaagggcgggccgggccaugaggagcccgugcccaugagcaccuacggguggaacaucgucaagcugaugucgggcaaggacguguucuaccucccgcccgagaagugugacacccuguuaugcgacaucggggagucaucccccagccccaccguggaagagucccgcacgauucggguccugaagaugguggaacccuggcucaagaacaaccaguucugcaucaaggugcugaaccccuauaugcccaccgucaucgagcaccuggagcgccugcagcgcaaacacggcggcaugcuggugcgaaaccccuugagccgcaacuccacccacgagauguacuggaucagcaacgggaccggaaacaucguguccagcgucaacauggugucccguuuacugcugaaccgcuucacgaugacgcaccggcgccccaccaucgagaaggacguggaccucggggcaggcacccggcaugucaaugccgagccggagacgcccaacauggacgugaucggagagaggauccggcgcauaaaggaggagcacagcuccacguggcacuaugacgacgagaaccccuacaagaccugggcguaucacgggagcuacgaggucaaggccaccggauccgcgagcagcaugauaaacggaguggucaagcugcugaccaagccuugggacgucgugcccauggugacgcagauggccaugacugacaccacgcccuuuggccagcagcgggucuucaaagagaagguggacaccaggacgccucgcccgaugcccgggacccgcaaggugauggaaauaacggccgaguggcuuuggcggacccugggccggaauaagcggccccgccugugcacgcgggaggaguucaucaagaaggugcgcacuaacgccgcgaugggcgcgguguucacugaggagaaccagugggauucugcccgagccgcuguggaggacgaggaauuuuggaagcucgucgaccgggagcgcgagcugcacaagcuggggaagugcggcagcugcguguacaauaugaugggaaagcgggaaaagaagcucggcgaguuugggaaagcgaagggcucccgcgccaucugguauauguggcugggcgcccgguaccuggaguuugaagccuuggguuuccugaaugaggaccacugguucagccgcgagaacucauacagcggcguagagggcgagggccuacacaaguugggguauauccugcgggacauuagcaagauccccggcggcgccauguacgcagacgacacggccgggugggacacccguaucaccgaggacgaccugcauaacgaggagaagauaacgcagcagauggacccggagcaucggcagcucgccaacgccaucuucaagcugaccuaccagaacaaggucgugaaggugcagcgcccaaccccgaagggcaccguuauggacaucaucucgcggaaggaccagcgcgguuccggccaggucggcacguacggccugaacaccuucaccaacauggaggcccaguugauccgacaaauggagggggaggggguguugagcaaggcggaccuggagaacccucaucuccuggagaagaaagucacccaguggcuggagaccaagggcguggagcgccucaaacggauggccauauccggggacgacugcguggucaagccgaucgaugacagauucgccagcgcccugcuggcccucaacgauaugggcaaggugcggaaggacaucccgcaguggcagcccuccaagggauggcacgacuggcagcagguacccuucuguagccaccacuuccacgagcugaucaugaaggaugggcgcaagcuggucgugccgugccguccccaggacgaacucaucggccgcgcgcggaucucccagggcgccggcuggagucugcgcgaaacggccugccuggggaaggccuacgcgcagaugugggcccucauguacuuccaccgccgggaccugagacucgccuccaacgcaaucuguagcgcugugcccguccacugggugccgaccucccggaccacuuggagcauccacgcgcaccaccaguggaugacgacggaggauaugcucaccguguggaaccgcgucuggaucgaggacaacccguggauggaggacaagacccccgugacuaccugggaggacgugcccuaccugggcaaacgggaggaccaguggugcggcagccugaucggucucacuucgagagccaccugggcccagaacaucuuaacggccauccagcagguccgcagccugaucggcaaugaggaguuccucgacuauaugccuuccaugaaacgcuuccggaaagaggaggagucugagggggccaucugguga

SEQ ID NO: 26212 - RNA, 9873 nt, Artificial Sequence
  derived and/or modified CDS sequence (opt11) from DENV-3__AY744679__SS-prME
accagccugugucuuaugaugaugcuucccgccacccuggccuuccaucuaacgagucgggauggggagccgcggaugaucgucgggaagaacgagcguggcaagagcuuacuguucaagacugccagcgggauuaacaugugcacccucauagcgauggaucugggggagaugugugacgauaccgugacauauaagugcccccuaaucacggagguggagccggaggacaucgacugcugguguaaccucaccagcaccugggugaccuaugggacaugcaaccaggccggcgagcaccggcgcgacaaacggagcgucgcacuggcuccccauguugguauggggcuggauacucgaacccagaccuggaugagcgccgagggugccuggcgccagguggagaagguagagaccugggccuucaggcacccuggauucaccauccuugcccuguuccuugcccacuacaucggaaccucgcucacgcagaaagugguaauauucaucuuacuaaugcuugucacccccagcaugaccaugcgaugugugggggugggcaaccgcgauuuugucgaagggcucuccggggccaccuggguggacguugucuuggagcacggcggcugcguaaccacgauggcuaagaacaagcccacgcucgacaucgagcugcagaagaccgaggccacacagcuggccacccuucggaagcugugcauugaaggcaagaucaccaacgugaccacggacucuagaugcccuacccagggagaagcgauccugcccgaggagcaggaccaaaauuauguaugcaagcacaccuacguugaccgggggugggguaacgguugcggauuauucgggaagggcuccuugguaaccugcgcaaaguuccagugucucgaaucaaucgagggcaagguggugcagcacgagaaucugaaauacacggugauuauaaccguccacacaggcgaccagcaucagguugggaacgagacccagggggucaccgccgaaauuacgccccaggccuccacaguggaagccaucuugcccgaauacggcacccuggggcucgaauguagccccaggacagggcuggacuucaaugagaugauccugcucacgaugaaaaauaaggcguggauggugcaccgucagugguucuucgaccugccgcugccuuggacguccggcgcuacaaccgagacccccacauggaacaagaaggagcuacuggucacauucaagaacgcccaugcgaagaaacaggaggucgugguccuggggucucaagaaggcgccaugcauaccgcucucacgggagcgacagagauccagacauccggugggacgagcauuuucgccggccaucugaaaugccgccugaagauggacaagcucgaacugaagggcauguccuacgccauguguuugaaugcguucguguugaagaaagaggugucagagacgcagcacgguacgaucuugaucaaggucgaguauaaaggcgaggacgcgcccugcaagauccccuucucgaccgaagacggacagggcaaagcucauaacgggcggcugaucaccgccaaccccaucguuacgaagaaggaggagcccgugaauauagaggccgaaccaccguucggggaaucgaacauugucauuggaaucggagacaaggcgcugaaaaucaauugguacaagaaagggucauccauaggcaaaauguucgaggccacggcccgcggcgcccggcgcauggcgauccucggugauaccgcaugggacuuugggagcguaggaggggugcucaauucccuaggcaaaauggugcaucagauuuucggcagcgccuacaccgcccucuucuccggggugagcuggauuaugaagaucggcauaggggugcugcuuacguggaucggacuuaacucgaaaaacacgagcauguccuucucuuguauugucaucggcauaaucacacuguauuuaggcgcuguagugcaggccgacauggguugcguaaucaacuggaagggccaggaacuuaagugcggaaguggcaucuucgugaccaaugaggugcacacguggaccgagcaguauaaguuccaggcggacagcccaaagcggcuggcgacugccaucgccggggcaugggagaacgggguuugcggaauccgguccaccacgcggauggagaaccuucucuggaaacagaucgcgaacgaguugaacuacauucuaugggagaacaauaucaagcucacaguggucgucggggauguaaucggcgugcucgagcagggcaagcggacccuuacaccacagccaauggaguuaaaguacucuuggaaaacgugggguaaggcaaaaauugucacugccgaaacucagaauagcucauucaucaucgacgguccgaauacaccagagugccccuccgccagcagggcguggaacgugugggagguugaggacuauggguucggcgucuuuacuacaaauauuuggcugaagcugcgggagauguauacccagcucugcgaccaucgccugaugucggccgccguaaaggacgagcgggcggugcacgcugauaugggcuacuggaucgagucucagaaaaacgguaguuggaaguuagagaaggccucccuaaucgaggucaagaccugcaccuggcccaagagccacacccugugguccaacggcgugcuggagagcgauaugaucaucccgaagucccucgccgggcccaucagccagcacaacuaucgccccgguuaccacacccagaccgccgggccguggcaccugggcaagcuggagcucgacuucaacuacugugaagguaccacagucgucaucaccgaaaacugugggacgaggggacccucacuacgaacuacgacggugagcgguaaacucauucacgaguggugcugccgguccuguacccugccgccccucagauacaugggagaggacggguguugguacggcauggagauccgcccgaucaacgagaaggaggagaacauggucaagagucugguuuccgcugguagcgggaaggcugacaauuucacaaugggcguucuuugucuggcuauccuguuugaagaggucaugcgcgguaaguucggcaagaagcacaugaucgcuggugcacucuucacguucguccugcuguuauccggccagaucaccuggcgggacauggcccacacccugauuaugauuggaucuaacgcguccgaccgcaugggaaugggcguuaccuaccuggcgcucaucgcaacuuucaaaauucaacccuuccuagcccugggguucuuucuccggaaacugaccagcagggagaaccugcuccuaggugugggccuggcgauggcgaccacccuccaacugccugaggauaucgagcaaauggcuaacggcaucgcccuuggccucauggcccugaaacucaucacgcaguucgagaccuaccagcucuggacggcccuugucucccucauguguuccaauaccaucuucacgcugaccgucgcauggcgaacggccacacucauucuggccgugaucucgcuccuacccgucugccaguccagcucgaugcgcaagacggauuggcugccaaugacuguugcugccaugggggugccgccccuuccccuuuucaucuucagccugaaggacacgcucaagcggcgcaguuggccgcugaacgaaggcgugauggccguagggcuaguuagcauccucgcuuccucuuuccugcgcaacgacgugcccauggccggacccuugguagcaggcggccuccugaucgcaugcuacgucaucacuggcacguccgcggaccugaccguggaaaaggcugccgacgucaccugggaggaagaagcggagcagaccggcguaagccacaaccucaugauuacaguagacgacgacgguacaaugaggauaaaagacgacgagaccgaaaacauccugaccgugcugcucaagacagcccuguugaucgucuccgguaucuuccccuacucgaucccagcaacgcuccugguuuggcacaccuggcagaagcagacccagcgcuccggaguccugugggacgucccauccccgccggaaacccaaaaggccgaacuggaagaaggcguguauaggauuaaacagcaggguaucuucggcaagacccaaguagggguugguguacagaaggaaggagucuuccacacgauguggcauguuacccgcggcgccgugcugacccauaauggcaaacgucuggagccgaauugggcuaacgugaagaaggaccuaaucucguaugggggcggguggaaacugagcgcgcaguggcagaaaggugaggagguccaggucauugcugucgagcccgggaagaaccccaagaauuuccaaacaaugcccggcaucuuccagaccacuacuggcgagaucggggccaucgcccuagacuucaagccggggacgucggguuccccaaucauuaaccgcgagggcaaggucgucggccuguacgggaacggcgugguaacuaaaaacgggggcuaugucagcggcaucgcccagaccaacgcggaacccgacggcccgacccccgagcuggaggaagagauguucaagaagcgcaaccuuacgaucauggaccugcaccccggguccgggaagaccagaaaguaccuccccgccaucgugcgggaggccauaaagcggcgccugagaacccuuauccucgccccaacuagaguuguugccgcggagauggaggaggcucugaagggucugcccaucagguaccagacaaccgccacuaagucggagcacaccggacgggaaaucguagauuugaugugccaugccacguucaccaugcgccuacuguccccaguaagagugcccaauuacaaccucaucgucauggacgaggcccacuucaccgauccugcuucuaucgccgccaggggauacaucuccaccagagucgguaugggggaagccgcugcuaucuucaugacggccacaccgcccggcaccgccgacgccuucccacagagcaacgcuccgauccaagacgaggaacgcgauaucccagaacgguccuggaacucugggaacgaauggaucacagacuucgcgggcaagacggucugguucguccccucaauuaaggccggcaacgauauugccaacugccugcgcaagaaugggaaaaaggucauccaacugucuaggaagacguucgacacugaauaccagaagaccaaacuuaacgacugggacuucgugguuacgaccgacauuucggagaugggggccaacuucaaggcagaccgcguaauugacccccgccggugucugaagccgguaauccugacugacgggcccgaacgggugauuuuagccggcccaaugcccgucaccguggcgucggccgcccagagacgggggagggucggccgcaacccgcagaaagagaacgaccaguacaucuuuacggggcagccacugaacaacgacgaggaccacgcgcacuggacagaggcuaagaugcugcucgacaacaucaacacuccagagggaauaaucccggcauuauucgagccggagcgggagaaguccgccgcgaucgacggggaguaucgccugaaaggcgagucccggaaaaccuucgucgagcuuaugcgccgaggugaucugcccgugugguuggcacacaaggucgccuccgaggguauaaaguacaccgaccguaaguggugcuucgacggcgagcggaacaaccagauccuggaggaaaacauggacguggagaucuggacgaaggaaggggagaagaaaaagcugcgcccccgguggcuagacgcccguacauacagcgaccccuuagcccugaaggaguuuaaggacuucgcggccggcagaaaaucaaucgcacuggaccucgugaccgagaucggccgcgucccgagccaccuggcgcacaggacccgcaacgcccuggauaaccuugugaugcugcauacgucugagcacgggggccgagcauaccgucacgcuguggaggagcuaccggagaccauggaaacccuccugcuacugggucugaugauccugcucaccggcggcgccaugcuguuucucauaucaggcaaggguaucgggaaaaccagcauaggccucaucugcgucguggccuccagcgggaugcucuggauggccgacgugccccugcaauggaucgcguccgccauaguccuagaguucuuuaugaugguguuacuaauaccagaaccugagaagcagcgcacgccccaggauaaccagcucgccuacguggucaucggcaucuuaacccuggccgcgaucguggcggccaaugaaaugggccuucuggaaaccacgaaacgagaccuuggcaugagcaaggagccgggaguugucuccccaacuucguaccucgacgucgaucuacaucccgcguccgcuuggacccuguaugcaguggccaccacggucauuacccccaugcuccgccacacuaucgagaacagcaccgccaacguaucccuggcagccaucgcgaaucaggccgucgugcugauggggcucgacaaaggcuggcccaucagcaaaauggaccuugggguaccguuauuggccuugggcuguuacucacaagugaacccgcugacgcucaccgccgcggucuugcugcuggugacgcacuacgcgauuaucgggcccggcuugcaggccaaagccacgcgcgaggcccagaaacguacggccgcggggaucaugaaaaacccuaccguugacgggaucaugaccaucgaccuggacccggugauuuacgacaguaaauucgagaagcagcucggccaggugaugcuauuagugcucugcgccgugcagcugcuccucaugcggaccuccugggccuucugcgaagcccucacgcuggccaccgggcccaucaccacccuaugggagggcagccccggcaaguuuuggaacacuaccaucgccgugucuauggccaacaucuuucgagggagcuaucuugccggcgccgggcuggcguuuucgaucaugaaguccgucggaaccgguaagcgcgggaccggcucacagggggagacucucggcgagaaguggaaaaagaaguugaaucagcugagcaggaaggaguucgaccuuuacaagaaguccggcauuacagagguagaucggaccgaggccaaggagggacugaagagaggggaaaucacacaucacgccgugucccggggcagugccaaauuacagugguucgucgaacgcaauaugguaaucccggagggccgugugauagacuuggguugugggcgcggaggguggucguacuacugcgccggccugaaaaagguaacggagguccggggcuauacgaagggcgguccgggucacgaggaacccguccccaugagcaccuauggauggaacauagugaagcugauguccggcaaggacguauucuaccugccacccgagaagugugacacccugcugugugacaucggggagagcucccccucgcccaccguggaggagucccgcacgauccgagugcugaagauggucgagcccuggcucaaaaauaaccaguuuugcauaaaggugcugaaucccuauaugccaaccgugauugagcaucuagagcgccuccagcgaaaacacggcggcaugcugguccggaaccccuuaagccggaacuccacgcaugagauguacuggaucucaaacgggaccggcaacaucguuuccagcgugaacauggucucuagguuacuucugaaccgauuuacgaugacccaucgccgcccuacgauugagaaagauguggaccucggggcaggcacccggcacgucaacgccgagccggagacgccgaacauggacauaauaggcgaacgcaucagaagaaucaaggaggagcacaguuccaccuggcacuacgacgacgagaacccuuacaagaccugggcuuaccauggaagcuacgaggucaaagcgaccggauccgccagcagcaugaucaacgggguggucaagcuguugacgaagccgugggauguggugcccauggucacccagauggccaugaccgacaccacaccguuuggccagcagcggguuuucaaagagaagguugauacgaggacgccccggccgaugccaggaacccgcaaagucauggagaucacagccgagugguuauggcggaccuugggccgcaacaagaggccucgccuauguacccgugaggaguuuaugaagaaagugaggaccaacgccgcgaugggcgcgguguucacggaggagaaucagugggacucggcgcgcgccgcaguugaggaugaggaguucuggaagcucguggaucgggaacgcgaacugcacaagcuggggaaguguggcagcugcgucuacaacaugauggggaaaagagagaagaaacuuggcgaguucgggaaagcuaagggcuccagagcgaucugguacauguggcugggcgcgcgguaccucgaguucgaagcccugggguuucuuaacgaggaccacugguucagccgcgagaacaguuacucgggcgucgagggggagggccugcacaagcucggguacauccugcgggacaucuccaagauccccggcggggccauguaugccgaugacacggcggggugggacacccgcauuaccgaggacgaccugcauaaugaggagaagaucacgcaacaaauggacccugagcacagacaacucgcuaacgcuaucuucaaacugacguaccaaaacaagguggugaaaguccagcgcccuaccccaaagggcacggugauggauauuaucagcagaaaggaucaacgcggguccggccaggugggcacuuaugggcugaacaccuucaccaacauggaagcccagcucauccggcagauggagggcgaggggguccugagcaaggccgaccuugagaacccgcacuuacuggagaagaaagugacgcaguggcuggaaacaaagggcguugaaagguugaagcguauggcaaucuccggagacgacugcgucgucaagcccauagacgaccgcuucgccaaugccuuacuggcccucaaugacauggggaagguucggaaggauauuccccaguggcagccgaguaagggcuggcacgacuggcaacaggugcccuucugcucccaccacuuccacgagcugauaaugaaagacggcaggaaauugguggugccaugccggccucaggaugaguuaaucggccgagcacggaucagccagggggcgggguggucccugagagagacggccugccugggcaaggccuacgcgcagaugugggcgcucauguacuuccaucgccgggaucugagacucgccagcaacgccaucugcuccgccgucccggugcacugggugccaaccucgcgaacaacuuggucuauccaugcacaucaccaguggaugacgaccgaggacaugcucacugucuggaaucgcgucuggaucgaagacaacccguggauggaggauaagacccccgugaguacaugggaggacgugcccuauuuagguaagagagaggaccaguggugcggcagucucaucggacucacuucacgcgccaccugggcgcaaaacaucuugaccgcgauccagcagguccggucacugaucggcaacgaggaauuuuuggauuacaugcccuccaugaaaagguuucggaaggaggaagagagcgaaggcgcgaucugguaa

SEQ ID NO: 26213 - RNA, 9873 nt, Artificial Sequence
  derived and/or modified CDS sequence (opt11) from DENV-3__AY744680__SS-prME
accucgcugugccucaugaugaugcugccugccacgcuggccuuccauuugacuagccgagacggcgaacccagaaugauuguggggaagaacgagcggggcaagagcuugcuguucaagaccgcgucuggcauaaacauguguacucucaucgccauggacuuaggugagaugugcgacgacaccgugaccuacaagugcccacugaucaccgaaguggagcccgaggacauagacugcuggugcaaucuaaccagcaccuggguaaccuacggcaccuguaaccaggccggggagcaucggcgcgauaagcggucgguugcccuggcgccacaugucggcaugggguuggacacucgcacucagacuuggaugagcgcggagggggcuuggcgccaggucgaaaagguugagaccugggccuuccgacacccuggguucaccauccuagcacuguuuuuggcgcauuacaucgguaccuccuugacccagaaggugguuaucuucauucugcucaugcucgucacccccuccaugaccaugcggugcgucggggugggcaaccgugacuucguagaaggccuguccggagccaccuggguggaugugguacuggagcacggagggugugugacuaccauggccaaaaauaaacccacccucgacaucgaacuucaaaagacggaggccacucagcucgccacgcuccggaagcuguguaucgaggggaaaaucaccaaugucaccacggacucacgcugccccacccaaggagaggcgaucuuacccgaagaacaggaucagaacuaugucugcaagcacaccuacguggaccggggauggggcaacgggugcggccucuucgggaaggguuccuuagugaccugcgccaaguuccagugccuggaaagcaucgagggaaaggcgguccagcacgagaaccuuaaguauacggugaucaucaccgugcacaccggggaccagcaccaggucggcaacgagacccagggggugacggccgaaaucacgccccaggccuccaccgucgaggcaauuuugcccgaguauggcacgcugggccucgagugcagcccacgcaccggccuggacuucaaugaaaugauucuguuaacgaugaagaacaaggccuggauggugcaccggcagugguucuucgaccugccccugccauggacguccggcgccaccaccgagacuccuaccuggaacaagaaggaauugcuggugacauucaagaacgcgcaugccaagaaacaggagguugugguuuuggguucccaggagggcgcgaugcacaccgcccucacgggggccaccgagauccagacgucuggcgggacaagcauuuucgcgggccacuuaaagugccgccugaaaauggacaagcucgaauugaagggcauguccuacgccaugugccugaacgcguucguccuaaagaaggagguuagcgagacgcagcacgggaccauccugaucaaaguggaguacaagggcgaggacgcuccaugcaagauaccguucagcacagaagacggccagggcaaggcccacaacggccgucugaucacggccaaccccauuguuacuaagaaagaggaaccagugaauaucgaggcggagccacccuucggggagucaaacaucgugaucgguaucggggacaaggcucugaaaaucaacugguacaagaaggggagcucuaucgggaagauguucgaagcgaccgcucgcggcgcccggcgcauggcgauccucggcgacaccgccugggacuucgguagcgucgggggcguucuaaacucacucgggaagaugguucaccagaucuucggaagcgccuauacagcucucuucuccggggucagcuggaucaugaagauaggcauagggguguuacugacguggaucggucucaacuccaagaacaccagcauguccuucucuugcaucguuaucgggaucaucacccuguaucugggagccguagugcaggcggacauggggugugucaucaauuggaagggcaaggaguugaaguguggcuccgggaucuucgucacuaaugaggugcacacguggaccgaacaguacaaguuccaagccgacagccccaagcggcuggccaccgcuauugccggcgcgugggagaacggggugugcgggauccgcuccacgacgcguauggagaaccuguuguggaagcagauugccaacgagcugaacuacauccugugggagaacaacaucaagcuaaccaucgucgugggggacgugaucggcguacuggagcaggggaagaggacccugacgccccaacccauggagcucaaguacucuuggaagacguggggaaaggcgaaaaucgugacagcagagacccaaaauucaaguuucauaaucgacggcccaaacaccccugagugcccuucagcgucaagagccuggaacgugugggaaguagaggacuauggguuuggcguguucacgaccaacaucuggcugaaacuucgugagauguacacccaacucugugaucaccgccugauguccgccgccgugaaagacgagcgggccguccacgcggauaugggcuacuggauagagucccagaagaaugggagcuggaaacuugagaaggccucucucaucgaggugaaaaccuguaccuggccaaagagccacacacugugguccaacggcguuuuagagagcgauaugauaauaccaaaguccuuggccgggccgaucucucagcacaacuaucgccccggcuaucacacccagaccgccgggccguggcaucugggcaagcuggaguuggacuucaacuacugcgagggaaccacgguggugaucaccgagaacugcgggacccggggccccucgcuccgcaccacgacggugagcgggaaguuaauccaugaauggugcugccgguccugcacccugccuccccuacguuacaugggcgaggacgggugcugguacggcauggagauccggccuaucaacgagaaagaagagaacauggucaagagccuggugucggccggcagcgggaaggcggacaacuucaccaugggcgugcucugucuggcaauccuguucgaggaggucaugagagguaaauucggcaaaaagcauaugaucgcaggggcccuauucacguucguccuccugcucuccgggcaaaucaccuggcgggauauggcccacacgcugaucaugaucgguagcaacgcuuccgaccgcauggggaugggggugacuuaccucgcacucaucgccaccuucaaaauccagcccuuccuggcccucggauucuuccuacggaaacugaccucacgcgagaaccuucuccuuggcgucggccuggcgauggcuaccacccuccaguuaccggaggacauagaacagauggccaacgggaucgcacugggccuaauggcuuugaagcugauuacgcaguucgaaaccuaccagcucuggaccgcguuagugagucuaauguguuccaacaccauauuuacgcucacaguggccuggaggacggccacauuaauccuagcuguaaucagccuacuucccgucugccaauccucaaguaugcgcaagacugacuggcugccgaugacgguggcagcgauggggguuccgcccuuaccccuguucauuuucucucuuaaggacacccuaaagcggcgcuccuggccucugaacgagggcgugauggcagucgggcuggugucuauucucgccuccagcuuucugcgcaacgacgugcccauggcgggcccccucgucgccggcggguuacucaucgcguguuacgugauaaccggcacguccgcggaccugaccguugagaaggccgccgacgucaccugggaggaagaggccgagcaaacuggggugagccacaaccucaugaucacggucgacgacgacggcaccaugagaauuaaggacgacgagacggaaaauauccuuaccguccugcucaaaaccgcuuugcugauaguauccgggauauuucccuacagcauaccggcgacgcuucucguguggcacacguggcagaagcagacccaacgaucaggcgugcugugggacgugcccuccccgcccgagacccaaaaggccgaacucgaggagggcguguaccggaucaagcagcaggggauauuuggcaagacacaggugggggugggugugcaaaaggaaggggucuuccauaccauguggcacgugacccgcggcgcagugcugacccacaacggcaaacggcuggaaccgaacugggcaaauguaaagaaagaucuuaucucauauggcggaggguggaaauuaagcgcacaguggcagaagggcgaggaaguucaagugaucgccgucgagcccgguaaaaaccccaagaacuuccagaccaugccaggcaucuuccagaccaccaccggcgaaauuggggccaucgcccuggacuucaagccggggacgagugggucccccaucaucaacagagagggcaagguugugggacuguaugggaacggcgucguaacgaaaaacggaggauaugugagcgggaucgcgcaaacuaaugccgagcccgauggcccgacccccgagcucgaggaggagauguuuaagaagcguaaccugacgaucauggaccuccaccccggcuccggaaagacgcgcaaauaccuuccagcaauuguccgggaagccaucaagcgccgucuucgcacacugauccucgccccaacgcgggugguggcugccgagauggaggaggcccugaagggucugccaaucagauaucagacgacagccaccaagagcgagcacaccgggagggaaaucgucgaucucaugugccacgccacguucaccaugcgccugcucuccccagugcgaguccccaacuacaaccucaucgucauggacgaggcccacuucacagacccggccagcaucgccgcacgcggcuauaucucuacccggguggguaugggagaagcggccgccaucuucaugacugccacgccgcccggcacugcugacgcguucccgcagagcaacgcucccauccaggacgaggagcgcgacauccccgaacggucuuggaacucggguaacgaguggaucaccgauuuugcaggcaagacggugugguuugugcccuccaucaaggccggaaacgacauugcaaauugccuacgcaagaacggaaagaaggucauacagcugagccguaagacuuuugacacggaguaccagaagacaaaacuuaaugauugggacuucguugucacgacugacauaagugagaugggugcgaacuucaaggccgaccgggugaucgauccucgccggugccugaagccggugaucuugaccgacggccccgagcgaguuauacucgccggccccaugcccguuaccgucgccagcgccgcgcagcgucgcgggcgggugggccgcaauccucagaaggagaaugaccaguacaucuucacggggcagccccugaacaacgacgaggaccacgcgcacuggaccgaggccaagaugcugcuagacaacaucaacaccccggagggcaucaucccagcccuguucgagcccgagcgcgagaaauccgcggccaucgauggugaguaccgccugaagggcgagagucggaagacuuuuguugagcucaugcgcagaggagaucugcccguguggcuggcccacaagguagccuccgaggggaucaaguacaccgaucggaaguggugcuucgacggagaacggaacaaccaaauccuugaggaaaacauggacguggagaucuggacgaaggagggggagaagaagaagcuacgccccagguggcuggacgcccgaacguauagcgacccuuuagcgcugaaggaguucaaagacuucgcggccggacggaaguccauagcacuggaucugguaacagaaaucgggcgcgugccaagccaccucgcccaccggacccggaacgccuuagacaaccucgugauguugcacacgucggagcaugggggccgcgccuaccgacaugccguggaggagcugcccgagaccauggagacccuccugcuacuaggucugaugauacugcucacgggcggggcaaugcuguuucugaucuccggcaagggcaucgggaagacgagcaucggccucaucugcgucguggcgucuagcgguaugcuauggauggcugacgucccccugcaauggaucgccucugccaucgugcucgaguucuucaugauggugcugcucauuccugagcccgaaaagcaacgcacgccccaggacaaccagcucgccuacguugugauaggcauccugacccucgccgcgauugucgccgccaacgagaugggguugcuggagacaacgaagcgugaccugggcaugaguaaggaaccgggcguaguguccccgacaaguuaucucgacguggaccuccaucccgccuccgcguggacccuauacgccguggcgacuaccgugaucaccccuaugcucaggcauaccauagagaacagcaccgccaacgucucccuggccgcgaucgccaaccaagccguggugcucaugggacucgacaagggauggcccaucagcaagauggaccuuggugugccguuguuggcguuagggugcuacucacagguuaacccacugacgcucacugccgcuguccuacugcuagugacccauuacgccaucaucggccccggccugcaggcaaaggccacacgcgaggcccaaaaacgcacggcggccggcaucaugaagaaccccacggucgacgggaucaugacuaucgaccuagacccggugauauacgacucuaaguucgagaagcagcuuggucaggugauguuacugguccucugcgcggugcagcuacuccucaugcggaccuccugggcuuucugugaagcgcugacgcuggccacuggacccaucacaacccucugggagggcagccccggcaaguuuuggaacacgaccaucgccguguccauggcgaacaucuuccgagggucguaucuggccggcgcgggacuggccuucucgauuaugaaaagcgugggcacugguaagcggggcaccggcucccagggggagacgcucggugagaaguggaaaaagaagcugaaucagcugucucggaaggaguucgauuuauacaagaaguccgggaucaccgagguggaucgcacggaggcuaaagagggccuaaaacgcggagagaucacccaucacgccgugucccgaggaagugcaaaauuacagugguuugucgagcgcaauauggugaucccugagggacggguaauugaccuggggugcggccgcggugggugguccuacuauugugcgggguuaaagaaggucaccgagguucggggcuacaccaagggagguccgggccacgaggaacccgugccgauguccacauacggcuggaacauagucaagcugaugaguggcaaggacgucuucuacuuaccgccagaaaagugcgacacccugcucugcgacaucggggagagcucccccagccccaccguggaggagucccgcaccauccgaguccugaagaugguagagccguggcucaagaauaaccaguucugcauuaaggugcugaaucccuacaugcccaccgucaucgagcauuuggagcgccuccaacgcaagcacgggggcaugcuuguacggaauccccugagccguaauuccacccacgaaauguacuggaucagcaacgggaccgggaacaucgucuccagcgucaacauggugucccgguuacugcugaaccgguucacgaugacccaccggcgccccaccaucgagaaggauguggaccucggugcagguacgcgacacgugaacgccgaaccggagacccccaauauggacgucaucggcgagcgcauccggcguauaaaggaggagcacucuuccaccuggcauuacgacgacgaaaaccccuacaagaccugggccuaucacggguccuacgaagucaaagcuaccggcuccgccagcucuaugaucaaugggguggugaaacuuuuaacgaagccgugggacgucgugcccauggucacccaaauggcaaugaccgacaccacucccuuuggucagcagcguguguucaaggagaagguggacacucguacgccccggccgaugcccgggacccggaaggugauggagaucacggccgaguggcucuggagaacccugggucgcaacaagaggccucgccuuugcaccagagaggaguucaucaaaaagguccgcacuaacgcugccaugggcgccguguucacagaggagaaccagugggacagcgcccgcgccgccguggaagacgaggaguucuggaagcucguagaccgggaacgcgaguuacacaaacucgggaagugcggcucgugcguguacaacaugauggggaagcgggagaagaagcucggcgaguucggcaaggcgaagggcuccagagccaucugguacauguggcugggcgcccgguaccuggaguucgaagcccuuggguuccugaacgaggaccacugguuuucaagggagaacucauacagcggcguagagggggagggccugcauaagcuaggguacauccugcgugacaucuccaagauucccggcggcgcuauguacgcggaugacacagcagggugggacacgcgcaucacagaggacgaccuccauaaugaggagaagaucacccagcaaauggaccccgagcaccggcagcucgccaacgccaucuucaagcugaccuaucagaacaagguaguuaaggugcaaagaccuaccccaaagggaacggugauggacaucaucagccggaaagaucagagagggaguggucaggugggcacauaugggcuaaacaccuuuacuaauauggaggcccagcucauccgacagauggaaggagaggggguucugagcaaagccgaccucgagaauccccaccuccuggagaagaaggucacccaauggcuggaaaccaaggguguggagcgccucaagaggauggcgaucuccggagacgacuguguggucaagccaaucgaugaccgcuucgccaacgcccuccuggcccucaacgacaugggcaaaguccguaaggacaucccucaauggcagccuagcaaaggcuggcacgacuggcagcaaguccccuuuuguucccaccacuuccaugaacugauuaugaaggauggucgcaaacuggucgugcccugcaggccccaggacgagcucauagggcgcgcgcggauuagccagggcgccggauggucucuucgcgagaccgccugcuuagggaaggccuacgcacaaaugugggcccucauguacuuccaucgcagagaucuaaggcuggccaguaacgccaucugcucggcugugcccguacacugggugccuaccagccggaccacuugguccauccacgcgcaccaccaauggaugacuacagaggauaugcucacuguguggaaccgcgucuggaucgaagacaacccuuggauggaggacaagacccccgucaccacgugggaggacgugccguaccugggcaagcgggaggaccaguggugcgggucccugauagggcucacaucccgcgccaccugggcccagaauauccugacggccauccagcagguacggagccugauuggcaacgaagaguucuuagacuacaugccguccaugaagcgcuuccggaaggaggaggagagugaaggcgccauaugguag

SEQ ID NO: 26214 - RNA, 9873 nt, Artificial Sequence
  derived and/or modified CDS sequence (opt11) from DENV-3__AY744681__SS-prME
acuucgcucugccucaugaugaugcugcccgccacccuggccuuccaccuuaccucccgcgacggggaaccccgcaugaucguggggaaaaacgaaagggguaagagcuuacuguucaaaaccgccuccgggaucaauauguguacccucaucgccauggacuuaggcgagaugugcgacgacaccgugacuuauaaaugucccuuaaucaccgaaguggagccugaagacauugacugcugguguaaccucaccucaacaugggugacuuacgggacuugcaaucaggccggcgagcaccggagagacaagagauccguggcacuggcgccccacguagguaugggguuggacacccgcacccagacauggaugagcgccgagggggcguggcggcaagucgagaaggucgagaccugggccuuccgucacccgggguucaccauccucgcacuguuucuggcgcacuacaucggaaccucacucacgcagaagguggugaucuuuauucugcugauguuggugacccccagcaugaccaugcgcugcgugggggugggcaacagggacuucgucgaaggccuguccggagcaaccuggguggacguaguccuagagcacggagggugugucacgaccauggccaagaacaagccaacccucgacaucgaacuccaaaagaccgaggccacgcagcucgccacccuccgcaaguuaugcaucgagggcaggaucacaaauguuacgacggacagccggugucccacacagggcgaagcaauccugccggaagaacaggaucaaaacuacguuugcaagcauacuuauguggaucgcggauggggaaacggcugcggccucuucgguaaaggcucauuagugacuugcgcaaaguuucaaugccuggagagcauagagggcaaggccguacagcacgagaaucuaaaguauaccgugaucauuacggugcacacuggcgaccagcaccaggucggcucggagacacagggggugaccgccgagaucacgccccaggccagcaccguggaggcgauccugcccgaguacgguacccuaggccuagaaugcaguccccggaccggucuggauuuuaaugagaugauauuacuuacgaugaagaacaaggccuggauggugcaccgccagugguucuucgaccuuccgcugcccuggacgucuggcgccaccacggaaacgccuaccuggaacaagaaggaacuauuagugaccuucaaaaacgcgcacgccaagaagcaggaagucgugguccuagggucgcaggagggagcgaugcacaccgcccucacgggggcuaccgaaauacagacuucagguggaaccagcaucuucgccggccaccugaagugucggcugaagauggauaagcucgagcugaagggcaugagcuacgcuaugugucugaacgcguucguccuuaaaaaggaggugagcgagacgcagcacgggacaauccugaucaagguggaguauaagggcgaggacgcccccugcaagauaccguucuccaccgaggacggccaaggcaaggcucacaacgggagacugaucaccgcuaaccccaucgugacgaaaaaggaagaacccgugaacaucgaggccgagcccccguucggugaauccaauaucgugaucggcaucggugauaaagcccugaaaaucaacugguacaaaaagggcucgaguaucgguaagauguucgaagccaccgcccggggcgcccgccggauggcgauucuuggcgauaccgccugggacuucggguccgucggagggguucuaaacagccugggcaagauggugcaccaaauuuucggguccgcauacaccgcccuuuucagcggaguuuccuggaucaugaaaaucggaaucggggugcuccuuacguggaucgggcucaacagcaagaacaccaguaugagcuucuccuguauuguaaucgggaucaucacguuguaccugggcgccgucgugcaggcggacauggguugcguaaucaacuggaaggguaaagagcugaaaugcggcagcgguaucuucgucaccaaugaagugcacacguggaccgagcaauauaaguuccaggccgauucacccaagcgcuuagccacggccaucgccggcgcgugggagaacgggguuugcggcaucagaagcacaacucgcauggagaaccugcuuuggaagcagaucgccaacgagcuuaacuacauccugugggaaaacaacaucaagcucaccauugucgugggugacgugauuggcguccuugagcaaggcaagcggacacugacaccgcagcccauggagcucaaauauuccuggaagaccugggggaaagccaagauagugacugcggagacucagaacagcuccuucaucaucgacggucccaauacccccgaaugccccagcgcgagcagagccuggaaugugugggagguggaggauuacggguuuggcguuuucacgacgaacaucuggcugaagcugcgcgagauguacacacagcucugugaucaccgguugaugucugcugccgugaaggacgaacgcgccguccacgcggacaugggcuacuggauagagagccagaaaaacggguccuggaagcuggagaaggcgagcuugaucgaggugaagaccugcaccuggcccaagucccauacgcuguggagcaacgguguccuggaguccgacaugaucauaccgaagucucuugccggucccaucucacaacacaacuaucgaccuggcuaccacacacagaccgccgggccguggcaccucggcaagcuggaacuggacuucaacuacugugagggcacuaccgucgugaucaccgagaauugcggaacccgcgggccgagccugaggacaacgaccguguccgggaagcucauccacgaguggugcugccgcagcugcacccuuccucccuuacgguacaugggcgaagacgggugcugguauggcauggagauacgcccaaucaacgagaaggaggagaacauggucaagucccuggugagcgccggcuccgggaaagcugacaacuuuacuaugggcgugcucugccuggcgauccuguucgaggagguaaugcggggcaaauuuggcaaaaagcacaugaucgccggcgcccucuuuacauucguccugcuacucagcggccagaucacuuggcgcgacauggcgcacacccuaaucaugaucggcuccaacgcgucggaccggauggguaugggcgugacauaccuggcccucauugccacguucaaaauccaaccuuuccuggcacugggguucuuucuucgcaagcugacuagccgggagaacuuauuacugggcgugggauuggcuauggccaccacacuccagcugcccgaggacaucgaacagauggcaaacgguaucgcucugggccucauggcccugaaguugauaacacaguucgaaaccuaucagcucuggacggcgcugguauccuuaaugugcagcaacaccaucuucacgcucaccguggcauggcgcaccgccacccugauccuggccgucaucucccuucugcccguaugccagagcucauccaugcggaagacggacuggcuucccaugacaguggccgccaugggaguucccccgcucccacucuucaucuucucuuuaaaggacacgcucaagcggcgcagcuggccccugaacgagggcgugauggcggucgggcugguguccauccuggccagcuccuuucugcggaacgauguccccauggcgggucccuuaguagcuggcgggcuccugaucgcuugcuacgucaucaccggcacgagcgccgacuugaccguugagaaggccgccgaugucacuugggaggaggaggccgagcaaaccgggguaucccacaacuugaugauaacgguggaugacgauggcacgaugcgcaucaaggacgacgagaccgaaaacauccucacuguccugcuaaagaccgcguuacuaaucguaucagggaucuuccccuacuccauaccugccacgcuccugguguggcauacauggcagaaacagacgcaacggagcgggguccugugggauguaccgagcccgcccgagacccagaaggcggagcucgaggagggcguguaccgcaucaaacagcaggggaucuucggcaagacgcaggucgggguuggcgugcagaaagagggggucuuccacaccauguggcacguaacccggggcgccgugcugacccacaacgguaagcgccuggagccgaacugggcgaacgucaagaaggauuugaucucauacggaggcggguggaagcuguccgcccaguggcaaaagggagaggagguccaggugaucgccgucgagcccgggaaaaauccuaagaacuuccagacgaugccuggcaucuuucagaccaccacuggcgagaucggcgcgauagcacuggauuucaaaccgggaacgagcgguagccccaucaucaaccgggagggcaaggugguagguuuauauggcaacggcgucgugaccaagaacgggggcuacgugucggggauagcccagaccaacgcggagcccgacggcccgacccccgagcuggaggaagaaauguucaagaaacggaacuuaacaaucauggaccugcaccccggcaguggcaagacucggaaauaccuccccgcgaucguucgcgaggccaucaagcgacgccugcggacccugaucuuagcgccaacccgcgugguggcggcugagauggaggaggcccugaagggcuugccuaucagauaccagacuaccgccaccaaguccgagcacaccggucgcgagauugucgaccucaugugccacgccacuuucaccaugcggcuucugagccccgugcgagugcccaacuacaaccucaucguuauggacgaggcucacuucaccgacccggccuccauagccgcacggggcuacauaucgacgcgcguggggaugggcgaggcggcugccaucuucaugacggcaacgccacccggcaccgccgacgcguuuccacaguccaaugccccgauccaggacgaggagcgggacaucccggagcgcagcuggaacuccgggaacgaguggaucaccgacuucgccggcaagacggugugguucgugcccagcaucaaggccgggaacgacaucgccaauugccuucgcaagaacggaaagaaggucauacaguugucccggaagaccuucgacaccgaguaccagaagaccaagcucaacgacugggauuucgugguuacgacagacaucagcgagaugggggcuaauuucaaagcggaccgagugaucgacccacggcgcugccugaaaccuguuauccuaacggaugggcccgaaagggucauuuuagccggccccaugcccgugaccguggccuccgcggcgcagcgccgcgggagaguaggucggaacccgcaaaaggagaacgaccaauacaucuucaccgggcaaccucuaaacaacgacgaggaccacgcgcacuggacggaggcaaagaugcugcucgacaacauaaacacucccgaggggaucauccccgcccuguucgaaccggagcgcgagaaguccgcggccaucgauggugaguaccgucugaagggcgaaagccgcaagaccuucgucgagcuuaugcggaggggcgaccucccuguguggcuggcccauaaggucgccucagaggggauuaaguacaccgaucggaaguggugcuucgauggcgagcgcaacaaccagauccucgaggagaacauggacgucgaaaucuggacgaaggaaggugagaagaagaaacuacggccccgcuggcuggaugcccggacuuacucggaucccuuggcgcugaaggaauuuaaagauuucgccgcuggccgaaagaguaucgccuuggaucucgucacugagauaggccgcgugccgucccaccuggcccaccggacacggaacgcucuggacaaccucgugaugcugcacacgagugagcacgggggccgggccuaucgccacgcggucgaggagcugcccgagaccauggagacccuccugcuccucgggcugaugauccuucucaccgggggagcaaugcuuuuccugaucagcgggaaggguaucggcaagacguccauaggccucaucugugugguggcaagcuccgggaugcuguggauggcggacgucccucuccaguggauagccagcgccaucgugcucgaguucuuuaugauggugcugcugaucccggagcccgagaagcaacggacgccgcaggauaaccagcucgccuaugucguuaucggcauccugacucuggcugcgaucguggccgcaaacgagauggggcuccuggagaccacgaaacgggaccucggcauguccaaggagccuggcgucguuagcccgacuuccuaccucgacguugacuugcauccagccagcgcguggacccucuacgccguugcaaccacggucaucacuccgaugcuccgacauaccauagagaacuccaccgcuaacgugagucuugccgccaucgccaaccaggcggucguucugaugggacuagacaagggcuggcccaucuccaaaauggaucuggggguuccgcugcuagcccugggcuguuacucucaggucaacccccugacgcucaccgcugcgguguuguuauugguuacccacuacgccaucauaggcccgggcuuacaggccaaggcgacccgcgaagcccagaagcggaccgcggcaggcauaaugaaaaaccccaccgucgauggaauuaugaccaucgaccuagaccccgugaucuacgacuccaaguucgagaaacaacucggccagguaaugcugcuggucuugugugccgugcagcuuuuacucaugcgcaccagcugggccuucugcgaggcccugacccuugccaccgggccgaucacuacucuuugggaaggcucccccggcaaguuuuggaacacgaccaucgcuguuagcauggcaaauauauuccgggggaguuaccuggcgggagcggggcuggccuucagcaucaugaaguccguaggcaccggaaaacgcggcaccgguucucagggugagacucucggagagaaguggaagaagaagcugaaccagcugagccggaaggaguucgaccuauacaagaaauccggcaucaccgaaguugaucggaccgaggcgaaggaggggcugaaacguggggagaucacccaucacgccgugagccgcggcuccgccaaguuacagugguucgucgagagaaacauggugaucccugagggccgagugauugaccucggguguggccgcggcggauggagcuauuacugcgcggggcugaagaaagucaccgaggugcggggcuacacgaaaggugggccgggccacgaggagccggugccuauguccacauacggcuggaacaucgugaagcugaugagcgggaaagacguuuucuaccuuccgccggagaagugcgauacgcucuuaugcgacauaggggaguccagccccuccccaaccguugaggaaagccgcacgaucagagugcugaaaaugguggagcccuggcuaaagaauaaccaauuuugcaucaagguguugaaccccuacaugcccaccgucaucgaacaccuggagcgccuccagaggaagcacggcgguaugcuggugcguaacccucugucccggaacagcacucacgagauguacuggaucuccaacgggaccggcaauaucgugagcuccgugaacauggugagccgucuccugcugaaccgguuuacuaugacccaucgccggcccaccauagagaaggacguggaucugggggccggcacccgccacgugaacgccgagccggagacgccuaacauggaugugaucggcgaacgcaucaggcggaucaaggaggaacacucauccacauggcacuacgacgacgagaaccccuacaaaacgugggccuaccaugggagcuaugagguaaaggccaccggcagcgcaagcuccaugaucaacgguguuguuaagcugcuaacgaagccaugggacgucgugcccauggugacccagauggccaugaccgacacgacgcccuuuggccagcaacgcguuuucaaagagaagguugacacccgcacgcccaggccgaugccggggacccggaaggugauggagaucacugccgagugguuguggcgcaccuugggccgcaacaagcgcccucggcucugcacgcgcgaggaguucaucaagaagguccgcacuaacgcagcaaugggggcagucuuuacagaggaaaaccagugggacagcgcccgggcggccguugaggacgaggaauuuuggaagcugguggaucgcgagcgcgagcugcacaaacuagggaagugcggcuccugugucuacaacaugaugggaaagcgcgagaagaagcuaggcgaguucgggaaggcgaagggcucgcgggccaucugguacauguggcugggcgccagauaccuggaguucgaggcccucggauuccugaaugaggaucauugguucucccgggagaacagcuauuccgguguugagggugagggccugcacaagcucggguacauuuuacgcgacaucagcaagauccccggcggcgcgauguacgccgacgacaccgcggggugggacacccggaucacugaggaugaccugcacaacgaggagaagauaacacaacagauggacccggaacaccgccgccucgccaacgccaucuucaaguuaaccuaccagaacaaggucgugaagguacagcgccccacccccaaggggacggucauggauauaaucucucgcaaagaccagcgcgggucaggccaagugggcacguacgggcuuaacacguucaccaacauggaggcccagcuuauccggcaaauggaaggcgagggggucuuauccaaggccgaccuagagaacccccaccuccuagagaagaaggucacccaguggcuagagaccaagggcguagagcgccucaaacggauggcgaucagcggcgacgacugcgucgucaaaccuaucgacgacagguucgcaaaugccuugcucgcauuaaacgacaugggcaaggugcgaaaagacaucccgcaguggcagcccucuaagggcuggcacgacuggcagcaggucccauucugcagccaucacuuccacgagcugaucaugaaagacgggcguaagcuaguugugccaugccgaccccaggacgaacucauuggccgagcgcgcauuucccaaggcgcuggauggagucuccgggagacugcaugccugggcaaagcguaugcgcagaugugggcccucauguauuuccaccgacgggaucugcgacuggccagcaacgcaauuugcucugcggugccaguucacuggguacccacgagccggaccacuuggagcauccacgcacaccaucaauggaugacgacugaggacaugcucaccguguggaaucgugucuggaucgaggacaaccccuggauggaggacaaaacgcccgugacgaccugggaggacgugcccuacuuaggcaaacgggaggaccaguggugcggcagccuaaucgggcucaccucaagggccacgugggcccagaacauccuaacggccauccagcagguccggagccugaucgggaacgaagaguucuuggacuauaugcccucgaugaagcgcuuucgcaaggaggaagagagcgagggggccaucugguga

SEQ ID NO: 26215 - RNA, 9873 nt, Artificial Sequence
  derived and/or modified CDS sequence (opt11) from DENV-3__AY744682__SS-prME
accagccucugucuuaugaugaugcucccugccacgcuggccuuccaucucacauccagggacggcgagccucggaugaucguagggaagaacgagcgcggcaaaucgcuacuguucaaaaccgccuccgggaucaauaugugcacauugaucgccauggaucuaggcgagaugugcgacgacacugugacauacaaguguccccugaucacugaaguagaaccagaggauaucgacugcuggugcaaccuaaccagcaccugggugaccuacgggaccugcaaccaggccggcgaacaccguagggacaagaggucaguggccuuggcgccccauguugguaugggccuagacacgcgaacgcagacuuggaugucugcugaaggcgccuggcgccagguggagaaagucgagaccugggccuuccgccaccccggcuuuaccauccuagcccuguuucucgcgcacuacaucgggaccucccuaacgcagaagguggugauuuucauccugcugaugcucguaacccccucaaugacgaugcgaugcgucggaguugguaaucgcgacuucguggagggccugaguggggccaccugggucgacguaguacuagagcacggggggugcgugacaaccauggccaaaaauaagccgacccuugauauagaauuacaaaaaacagaagcgacacagcuugccacccugcguaaacuguguauugaagggaaaaucacgaacguuaccacugacagccgcugccccacucagggcgaagcgauccugccggaggagcaggaccaaaauuacguuugcaagcacacauacguggaccggggauggggcaacgggugcggccuguucgguaagggauccuuaguaaccugcgcgaaguuccagugccuggagagcaucgaaggaaaagccguccagcacgagaaucuaaaauacacggugacgaucacagugcacaccggggaccagcaccaggucgggaaugagacgcagggcgugaccgcggagaucacgccccaggccucaaccgucgaggcgauuuuacccgaguacggcacauuggggcucgagugcaguccccgcacgggcuuagauuuuaacgagaugauccuucucaccaugaagaauaaggcguggauggugcauagacaaugguucuucgaucugccauuacccuggaccuccggggccacaacggaaacucccaccuggaacaaaaaagagcuucugguuaccuuuaagaacgcccacgccaagaagcaggaaguaguggugcuaggaagccaagaaggcgcgaugcauacggcguuaaccggagccaccgagauccagaccucagggggaacgucaaucuucgcgggccaucugaaaugucgccuaaagauggacaagcucgagcugaaagguauguccuaugcuaugugccugaacgcauucguccuaaagaaggagguaagugagacccagcaugggaccauccuaaucaaagucgaguacaaaggcgaggacgcucccugcaagauaccauucucaaccgaagacggacaaggcaaagcccacaaugggagacugaucacggccaacccgaucgucaccaaaaaggaggagccggugaacauagaggcugagccgccguucggggagagcaauaucgugauuggaaucggggacaaggcccugaagaucaauugguacaagaagggcaguucuaucgguaagauguucgaagccaccgcgcgcggcgcucgucgcauggcgauacucggcgauaccgccugggauuucgggagcgugggaggagugcugaacuccuugggaaagauggugcaccagaucuucgggagcgccuacacggccuuguucuccggcguaagcuggauuaugaagauaggcauaggggugcuucucaccuggaucggccucaacucuaagaacacaagcauguccuucagcuguaucgugauagggaucauaacccuguaccugggcgccguagugcaagcagauaugggcugugugaucaacuggaaggggaaagaguuaaagugcggaucagggaucuucgucacuaacgaggugcacaccuggaccgagcaauacaaauuccaggccgacagccccaagcgccucgcuaccgcgauagcgggggcgugggagaacggggugugcgguauccgcuccacgacgcgcauggagaaccugcuauggaagcagaucgcuaacgaacuaaauuacauucuaugggaaaacaacaucaagcucaccaucguaguuggggacgugaucggcguccuggagcagggcaaacggacccucacgccgcagcccauggaguuaaaguauagcuggaagaccugggggaaggccaagaucgugacagccgagacucagaacuccagcuuuaucauugauggcccgaauacucccgaaugcccgucggccucaagggcguggaacguuugggaggucgaagacuauggauucggcguauuuaccaccaauauuugguuaaaguuacgggaagucuacacccaacucugugaccacagauuaaugucugccgcuguuaaagacgagcgggcggugcacgcggacaugggauacuggaucgaaagucaaaagaacgggagcuggaagcucgagaaggccuccuugauugaagugaaaaccugcaccuggcccaagagucacacccuguggaguaaugguguccuugagucggacaugauuaucccgaaguccuuggcugggccuaucucccagcauaauuaccgccccggcuaucacacccagaccgccgggccguggcaccucggcaagcucgaacucgauuucaacuacugugagggcacgaccgucguuauaaccgagaacugcgguacaagggggcccucccugcgcacgacgaccgucagcgggaaacugauccaugaguggugcugccggucgugcaccuuaccgcccuuacguuacaugggcgaggaugggugcugguacggcauggagauaagaccaauuaaugagaaggaggagaauauggucaagagccugguuagugcaggcagcggcaaggcggacaacuuuacgaugggcguccuuugccuggcgauacuguucgaggaggugaugcggggcaaguucgggaaaaagcauaugaucagcggggcacuauucaccuucgugcugcuucuuagcggccagaucacguggcgggacauggcucacacacuuaucaugaucggcuccaacgccuccgaccguauggggaugggcgucacguaccuugcacuuaucgcaaccuucaagauccagccuuuccuggcccugggguucuuuuuacgaaagcugacgucucgggagaaccuccuccuggguguagggcuggccauggcgaccacgcuccagcugcccgaggacauagagcaaauggccaaugggaucgcgcugggccucauggcccucaagcugauaacgcaguucgaaacguaucagcucuggaccgcucuggugucccuuauguguagcaacacgaucuuuacccuuaccgucgccuggaggacggccacucugauccuggccgugauauccuuacugcccgugugccagagcuccaguaugagaaagacagacuggcuccccaugaccgucgcggccaugggggugcccccuuugccccuuuuuaucuuuagccugaaagacacucuaaagcggcggagcuggccacugaacgagggcgucauggcgguagggcuggugagcauccucgcuagcuccuuccuccgaaacgauguucccauggcggggccccuuguggcuggaggguuacugauagccugcuacgucaucacgggcacgagcgcggaucugacuguggagaaggcagccgauguuaccugggaggaagaagcggagcaaacggggguuucccacaauuugaugauaaccguugacgacgacggcacgaugcguaucaaggacgacgaaaccgaaaacauuuugaccgugcuguuaaagacugcgcugcugaucgugagugggaucuuccccuacuccauuccggcaacgcuccugguguggcauaccuggcagaagcagacccaaagaagcggagugcuuugggacgugccgaguccgcccgagacgcagaaagccgagcucgaggagggcgucuaucggaucaagcagcaggggaucuucgggaagacucaagugggugucgguguccagaaagagggaguguuccauacgauguggcacgugacccgcggcgccguccuaacgcauaacgguaagcgccuagagccuaacugggccaaugugaagaaggaccucaucaguuacgggggcggauggaagcugagcgcgcaauggcagaaaggugaggaggugcaggugauagcagucgaacccgggaagaaccccaagaacuuucaaacuaugccuggaauauuccagaccaccacaggcgagaucggugccaucgcccucgauuuuaagccggguacaagcggguccccaaucaucaaccgugaggggaagguggucgggcuguacgggaauggcguggugacgaaaaacgggggcuaugucucagguaucgcacagacaaacgcggagccggacggaccgacuccugaacucgaagaggagauguucaaaaaacggaacuugaccaucauggaucugcaucccgggucuggaaagacccgcaaguacuugcccgccaucgugcgggaggccaucaagcgucggcuacgaacacugauccuugcuccgacgcguguggucgccgcugagauggaagaggcccugaaggggcugcccauucgcuaccaaaccaccgcuaccaagagugagcacacggggcgggaaaucguggaucucaugugccaugccaccuucaccaugaggcugcugagccccguucgggucccgaacuacaaccuaaucgugauggacgaggcgcauuuuaccgacccagcguccaucgccgccaggggcuauaucuccacgcguguagggaugggcgaagcggcagccauuuucaugaccgcuacaccgcccggcaccgccgacgccuuuccgcaaucuaacgcaccuauccaggaugaggagcgcgacauccccgagcggagcuggaacucugggaacgaguggaucacggacuucgccgggaagaccgucugguucgugccgagcaucaaggccgggaacgacaucgcgaauugucugagaaagaacggcaagaaggugauucagcucucccgcaaaacguucgacacugaguaccagaagacgaaacucaacgacugggacuucgucgugaccacggauaucagcgaaaugggagccaacuucaaagcggaucgggugauugauccccgacgguguuugaaaccgguaauacucaccgacggacccgagcgcgugauccucgccggccccaugcccgucacggucgccucugcggcacagcggcgcgggaggguggguagaaacccgcagaaagagaacgaccaguacaucuucaccggucagccgcuaaauaaugacgaggaccacgcacauuggaccgaagcaaagaugcugcucgacaacaucaacacacccgaagggauuaucccugcccuguuugagccggaacgggagaaaagcgcggcaauugacggagaauacagacugaaaggugaaagccguaagaccuucguugaacucaugcgccguggcgaccuaccugucuggcuggcccacaaggucgcaagcgagggcaucaaauauacugaccgcaaguggugcuucgacggcgagcggaauaaccaaauuuuggaagagaacauggauguugagauuuggacuaaggagggggaaaagaagaagcugcgcccucgauggcuggaugccaggaccuauuccgauccguuggcccugaaggaguucaaggauuucgcagcgggccgcaagucgaucgcccucgaccucgugaccgagaucggccgcgucccaucacaucuggcccaccgcacgcggaacgcccuggacaaccuggucaugcugcacaccucagagcacggugggcgcgccuacagacaugcgguggaagaacugcccgagaccauggagacccuacugcugcucgggcugaugauccugcucacgggaggggcaaugcucuucuuaauuucgggcaagggaaucgggaagacgaguauuggcuugauauguguggucgcuagcuccggcaugcuguggauggcagacgugccucugcaguggauugcgagcgccaucguguuggaguucuucaugaugguccugcugaucccggagcccgaaaaacagcgcacgccgcaggacaaccagcucgccuacguggugaucggcauccucaccuuggcugcuauugucgcggccaacgagaugggccuuuuggaaacgacgaagcgggaccuaggcaugucgaaggagcccggcguggugagcccuacuagcuaccucgacguggaccugcaucccgccucagcauggacucuuuacgcuguggccaccaccgugauaacccccauguugcgucauacgaucgaaaacuccaccgcaaacgugagccuggcagccauugcgaaccaggcuguaguccuuaugggacuagacaaaggcuggcccaucucaaagauggaccugggcgucccgcuguuggcgcugggaugcuauucucaggugaauccccugacccucaccgcggccguccuuuuacucgucacccacuacgcaaucaucgggcccggcuuacaggcaaaggcgacacgagaagcccaaaagcgaacggccgcgggcauuaugaaaaacccaaccguugacgggaucaugacaaucgaucuggauccaguuauauacgacuccaaguucgagaagcagcuaggacaggugaugcugcugguacucugcgccguacagcugcuguuaaugcgaacgagcugggccuucugugaagcacugaccuuggcgacugggcccaucacaacuuugugggagggcucccccggcaaguucuggaacaccacgaucgcaguuucgauggccaacaucuuccgcggguccuaccucgccggcgccgggcuggccuucaguaucaugaaguccgugggaaccgggaaaagggggacugggagccagggggaaacgcucggcgaaaaguggaagaagaaguuaaaccagcugucgagaaaagaauuugaccucuacaaaaaguccgggaucaccgagguagaccggaccgaggccaaggaggguuugaagaggggggagauuacccaccaugccgucucgcggggcucagccaaguugcagugguucguggagagaaacauggugauccccgagggccgggucaucgaccuaggguguggccgcgggggguggagcuacuacugcgccggccucaaaaagguuacggagguucggggguacaccaaggguggucccgggcacgaagagcccguccccauguccaccuacggguggaacaucgugaaguuaaugucuggcaaggacguguucuaccuaccgcccgagaagugcgauacacugcuaugcgacaucggggaguccagcccuucccccacggucgaggaaucacggaccauuagaguguuaaagaugguugaacccuggcuuaagaacaaccaguucuguauaaagguguugaacccuuacaugcccaccgucaucgagcaucuggaacgccuccagcgcaagcacggcggcaugcugguaaggaacccccuguccaggaacaguacucaugaaauguacuggauuuccaacgggacgggaaacaucgucagcuccgugaauaugguuagcaggcuucugcugaaccgcuucaccaugacccaccggcgccccacgauugagaaagauguugaucuuggggcggguacccgacacgugaaugccgagccggagacccccaacauggaugucaucggcgagcgcauccggcgcauaaaagaggagcacaguagcaccuggcacuacgacgaugagaaccccuacaaaacaugggccuaucacggcucauacgaggugaaggcaacagguucagcuagcucuaugaucaauggggugguuaagcugcuuacgaaaccuugggacguggugccgauggucacccagauggcuaugacagacacaacccccuucggccagcagagaguguucaaggagaagguggacacccgcacaccucggccgaugcccgggacgcgcaaggucauggagaucaccgcugagugguuguggcgcacccugggccggaacaagcgaccccgucuguguacucgagaagaguucauaaagaagguccgcacgaacgcugccaugggagcgguguuuaccgaggagaaccagugggacagugcgcgcgcagccgucgaggacgaggaguucuggaagcucgucgaccgggagcgugagcuucacaagcuagggaaaugcgguuccuguguuuacaacaugauggguaaacgggagaagaagcucggcgaauucgggaaggcgaaagguagucgugcuauuugguacauguggcugggcgcccgguaccuggaauucgaagcccucggguucuugaacgaagaucacugguucagucgcgagaauagcuauuccggcguugagggcgagggccugcacaagcucggguacauacugcgggauauuagcaagauuccaggcggcgccauguaugcggacgacaccgcuggaugggauacuagaaucacggaggaugaccugcacaacgaagaaaagaucacucagcagauggacccagagcaccggcaacucgccaacgccauuuucaagcucacauaccaaaacaaaguggugaagguucagcgccccacccccaagggcacagugauggauaucauuagccgaaaggaccaacgcggcagcgggcaaguugggacauauggcuuaaacaccuucaccaacauggaggcccagcucauucgucagauggagggugaggggguccugucuaaggccgaccuggaaaaccccuaccuucuggaaaagaaggucacgcaauggcuggagaccaagggcgucgagaggcucaagcgaauggcgauaagcggggacgacuguguggugaagccgaucgacgaucgcuucgccaacgcuuugcuagcgcucaacgacaugggcaagguacggaaagacauuccacaguggcagccaaguaagggcuggcacgacuggcagcaagucccguuuuguagccaucauuuccacgaacuuaucaugaaggacgggaggaagcugguagugccuugccggccccaggacgagcucauaggacgcgcccgcaucucccaaggggcaggauggucccugcgcgagaccgccugccuagguaaggccuacgcacaaaugugggcguuaauguacuuccaccggcgcgaccugaggcuggccucgaacgccaucuguagcgcaguccccgugcauugggugcccaccucccggaccacguggagcauacacgcgcaccaucaguggaugacuaccgaagacauguugaccgucuggaaucgcguguggaucgaggacaaccccuggauggaggauaagaccccugugacuaccugggaggacgucccguaccuugguaaacgggaggaucaguggugcggcagccugaucgggcuaaccucccgcgcgacgugggcccagaauauccugacagcgauacagcaggucaggucccucaucgguaacgaggaguucuuggacuacaugcccuccaugaagcgcuuccggaaggaagaagagagcgagggggccauuugguga

SEQ ID NO: 26216 - RNA, 9873 nt, Artificial Sequence
  derived and/or modified CDS sequence (opt11) from DENV-3__AY744683__SS-prME
accucauuaugucucaugaugaugcugccagccacccuggcauuccaccuuaccucacgcgacggcgagccccgaaugaucguuggcaagaacgaacgcggaaagagccuguuguuuaagaccgccagcgggaucaacaugugcaccuuaaucgcuauggacuugggcgagaugugugacgacacugugacuuauaagugccccuugaucaccgagguggagcccgaggacauagacuguuggugcaaccucaccagcacgugggugaccuacgggacguguaaucaggcuggcgagcaccggcgggacaagcggaguguggcccuggcgccccacguuggcauggggcucgacacgcggacccagaccuggaugagcgcggagggugccuggcggcaggucgagaaggucgagaccugggcguuccgccaccccgguuucacgauccuggcccuuuuccuggcgcacuacauuggcaccucacucacccagaagguugugaucuucauucuccugaugcucgucacucccucaaugaccaugcguugcgucggcgugggcaaccgcgacuuugucgaggggcuguccggggccaccuggguggacgucguccuugagcacggcgggugcguuacgaccauggccaaaaauaaacccaccuuggacaucgaguugcagaagacggaggcuacgcagcuugcaaccuuaagaaaauuguguaucgaaggcaagaucaccaacgugacuacggacucgcgcugccccacccagggcgaggcuauacugcccgaggagcaagaccagaacuauguaugcaaacacacuuacguggaccggggguggggcaacgguugcggccucuucgggaagggcucccuaguaaccugcgccaaguuccaaugcuuagaguccaucgaaggcaaggcugugcaacacgagaaccucaaguacacggugauuauaaccgugcacacgggggaucaacaucaggugggcaaugagacccagggggucacggccgagaucacuccccaggcguccaccgucgaggcgauucugcccgaauacggcacgcuggggcuagaguguucaccccgcacgggccuggacuucaaugaaaugaucuugcucacgaugaagaauaaggcauggauggugcacaggcaaugguuuuucgacuuaccgcugccguggaccuccggcgccaccaccgagacgcccaccuggaacaagaaggaacuccuggugacuuucaagaacgcccacgcuaagaagcaggaggucgucguccuggggagccaggagggggcgaugcauacugcucugacaggggccacggagauccagacaaguggcgggaccaguauuuuugcgggucacuuaaagugucgccugaagauggacaagcuggagcugaagggcauguccuacgcaaugugucugaacgcguucguccucaaaaaggaggucucagagacgcaacacgggacaauccuaaucaaaguggaauacaagggagaggacgcucccugcaagauaccguucagcacagaggacgggcaaggaaaagcacauaacggccggcugauuaccgccaaccccaucgucacgaagaaggaagaaccaguuaacauugaggcugaacccccguucggugagucuaacaucgugaucggcaucggggacaaagcccugaagaucaacugguacaagaaggguagcuccaucgggaaaauguucgaggcuaccgcgcguggcgcccggcgcauggcgauucucggagauaccgccugggacuucgguuccgucggcgggguucugaacucccuuggcaagauggugcaccagaucuucgguagcgcauacacggcguuauucuccggugucuccuggaucaugaagaucggcauaggggugcuacugacguggaucggacucaacucuaagaacaccagcauguccuuuucuuguauugugaucgguaucaucacccuguaccuuggcgccguagugcaggcggacauggggugcgucaucaacuggaagggcaaagaguuaaagugcggaucggggaucuuugucacgaacgaggugcacacauggacagagcaguacaaguuccaagccgauagccccaaacgguuagccaccgccaucgcaggcgcgugggagaaugguguguguggaauccgcuccaccaccaggauggaaaaccuucucuggaaacagaucgccaacgagcuuaacuacauucugugggagaacaauauaaaacucaccauugucguuggggacguaaucggcguccuggagcagggcaagcguacccucacgccgcagcccauggagcucaaguacagcuggaaaacgugggggaaggccaagauagugaccgcggagacccagaacaguucuuucaucauagacggcccgaacacccccgaguguccguccgcuucgcgggccuggaaugucugggaggucgaggacuauggguucggcguauuuacuaccaacaucuggcucaagcugcgggagauguacacccaacuuugcgaccaccgcuuaaugagcgcagcagugaaggacgaacgggcgguccacgccgacaugggcuacuggaucgaaagucaaaagaauggcucguggaagcuggagaaggccagucuaaucgaggugaagacaugcacguggccgaaaagccacacgcugugguccaacggcgugcuggagagcgauaugauaauaccgaagucccucgccgggcccauaagccaacacaacuaucggcccggauaucauacccaaacugccgggcccuggcaccuugggaaacuugagcucgauuucaacuacugcgagggcacgacgguagugauuacugaaaacugugggacccggggccccuccuuacgaacgacgaccguguccgggaagcugauccacgaauggugcugucguagcugcacgcugccgccccuucgcuacaugggugaggacgggugcugguacggcauggaaaucagacccauuaacgagaaggaggaaaacaugguuaagagccugguuuccgccgguagcgggaaggcggacaacuucaccaugggagugcugugucuggcgauccucuucgaggaagucaugcgcgguaaguucggcaaaaagcauaugauugccggggcuuuguuuaccuucguguugcugcuguccggccaaauuaccuggcgggacauggcccacacucugauuaugaucggcucuaacgcguccgaccgcauggggaugggcgugaccuaccuggccuuaauagcgacguuuaagauccagcccuuccuggcucuggguuucuuccuccggaaacugacgagcagggaaaaucugcuccugggcgucggccuagcuauggccaccaccuuacagcugccggaggacaucgagcagauggccaacgggaucgcucugggccucauggcccucaagcuaaucacgcaguuugagacguaccagcucuggaccgcgcuggugagccuaaugugcuccaacaccaucuucacgcucaccgucgccuggcggaccgccacccugauccuggccguuauuaguuuacugccugugugccagaguagcuccaugcgcaagacggacuggcugccgaugaccguugccgcgaugggagugccgccccucccccuuuucaucuucucucugaaggacaccuuaaaacggcggaguuggccgcugaacgagggcguaauggccguggggcuggugaguauccucgccucuagcuuccuccgcaaugacgugcccauggcuggcccacuugucgccggcgggcuccugaucgcuugcuacguuauuacuggcacguccgcggaucugacaguggagaaggcugccgacguaacuugggaagaagaggccgagcaaaccggggugagccauaaucucaugaucacgguggacgacgacggcaccaugcgcauuaaggaugacgagaccgaaaacauucugaccguccugcucaaaaccgcgcuucugaucguguccgggauauuccccuacucuaucccggcgacucuccuaguguggcacaccuggcagaagcaaacccagagauccgguguccuuugggacgugcccuccccgcccgaaacccagaaagcggaguuagaagagggcguguaucgcauuaaacagcaaggcaucuuuggcaagacacagguuggggugggagugcagaaggagggcgucuuucacacaauguggcacgugacgcggggcgcugugcugacccacaacggcaagcggcuggagcccaauugggcaaacgucaagaaggaucucaucuccuaugggggcggguggaaacuuuccgcccaguggcaaaagggcgaggaggugcagguaaucgccguggagccagggaagaaccccaaaaacuuccagacaaugccuggcaucuuccaaacuacuaccggggagaucggggccaucgccuuagacuucaagccggggacgucaggcagucccaucauaaaucgcgagggcaaaguggugggccuguacgggaauggcgucgugaccaagaacgggggcuacgucagugggaucgcgcagaccaacgccgagcccgaugguccgacacccgaacuggaggaggagauguucaaaaagcggaaccugacuaucauggaccugcaccccggcuccggcaagacccgaaaauaccucccugcgauagucagggaagcuauaaagcgccgucugcgcacucugauccucgccccuacccgggugguggcggccgagauggaagaggcccugaagggccugccgauccgcuaccaaacgaccgccacuaagagcgagcacacggggcgggagaucgucgaccuaaugugucacgccacguucaccaugcgccugcugucccccgugcgcguacccaacuacaaccucaucgucauggacgaagcccacuucacugacccagcgagcaucgccgccagaggcuacaucuccacccggguaggcaugggggaagcggccgcgauauucaugaccgccacgccgcccggcaccgcugaugcguucccccagagcaacgccccgauccaggacgaagaacgcgacauccccgagcgguccuggaacagcgggaacgaguggauuacugauuucgccggcaagacagugugguuugucccuuccauuaaggccggcaacgacauagcaaacugccugcgcaagaacgggaagaaagugauccagcugucccgcaagaccuucgacaccgaguaccagaagacaaagcugaaugacugggacuucguagucacgacggacaucuccgagaugggugcaaacuuuaaggccgacagggugaucgacccccggcggugcuugaagccggugauccucacagacggccccgagcgcgugauucucgccggacccaugcccgucacgguggccagcgccgcgcagcggcgcggucggguuggcagaaauccgcaaaaggaaaacgaucaguacaucuucacgggacagccccuaaacaacgacgaggaucacgcacacuggaccgaggccaagauguugcucgauaacauuaauacacccgaaggcaucauccccgccuuauucgaaccugaacgcgaaaaguccgcggccaucgacggggaguaucgccugaagggcgagagcaggaaaaccuucguggagcuuaugcggcggggugaucuacccguguggcuggcccacaaggucgccucggaggggaucaaauacaccgaccgcaaguggugcuucgacggcgaacggaacaaucagauccucgaggaaaacauggacguggagaucuggacuaaggagggggagaagaagaaacugcgcccgcgguggcuagacgcccgcaccuacagcgacccccucgcgcugaaagaauuuaaggauuucgccgccggucguaagucaauugcgcuagaccucgucaccgaaauaggacgcgugccgagccacuuggcccaccguacccgcaacgcauuggacaaccucgugaugcugcauacauccgaacaugguggacgagcguaccggcacgccguggaagaacugcccgaaaccauggagacccucuugcugcucgggcuuaugauccuccucaccggcggggccaugcuguuccugauaucaggcaagggcaucggaaagacuucgaucggccuuauuugcgugguggccuccagcgggauguuauggauggcggacguaccccugcaauggauugcauccgccaucgugcuagaguucuuuaugauggugcugcugauaccggagcccgagaagcagcgcacaccccaagauaaccagcucgccuacgucguuauagguauucugacacuggccgccaucguugccgcaaacgaaauggggcuacuggagaccacgaagcgggaccuggggaugucgaaggagccaggcguugugucccccaccagcuaccucgauguggaucuucaccccgcauccgcauggacccuguacgccguggccaccacgguaauuaccccaauguugcgccacaccaucgaaaacucaaccgccaauguuucccuagcggcaaucgccaaucaggcuguaguccucauggggcucgacaagggcuggccgauaagcaagauggacuuggggguuccgcugcucgcccugggcugcuauucccaagucaacccccugacucucaccgcggcgguacuacugcucgugacgcacuacgccaucauugggccggggcugcaggccaaagcaacccgggaagcucagaagcgcacggccgccgguauaaugaagaaccccacggucgacgggaucaugaccaucgaccuggacccggugauuuaugauucaaaauucgagaaacagcucggccaggugaugcugcuggugcucugugccgugcaguugcugcucaugcggacaucaugggccuuuugcgaggcgcugacccuggccaccgguccgauaaccacccucugggagggcagccccggcaaguucuggaacacaaccaucgccguguccauggccaacauauuccgcgguagcuauuuagccggcgcugggcuugccuucuccaucaugaaguccgucggcacagggaagcggggcaccggaucccaaggugagacgcucggcgagaaguggaagaagaagcugaaccaguuaagccguaaggaguucgaccuauacaagaaguccggaauaaccgagguggauagaaccgaggcuaaggagggccucaagcgcggggagauaacacaccaugcugugucccgggguagcgccaaguugcagugguucgucgaacgcaacauggucauccccgagggccgggugaucgaccucgggugcggccgcggcggcuggucguacuacugcgcgggccugaagaaggugaccgaggugcggggcuacacgaagggcgggcccggccacgaggaacccgugcccaugagcaccuacggguggaacaucgugaagcugauguccggcaaggauguguucuaccucccgccagagaagugcgacacccuucuuugugacaucggagagucuucccccucgcccaccguggaggagucccggacaauuagaguccugaagaugguagagccauggcuaaagaacaaccaguuuugcaucaaggugcugaaucccuacaugcccacggucaucgagcaucuggagcgccuccagcgcaaacacggcggcaugcuggugcggaacccccugagccgcaacuccacccacgagauguauuggaucuccaacgggaccggcaacaucguuuccagcgucaacaugguaucucggcuccuuuuaaaccgcuuuacgaugacccaucggcgccccaccaucgagaaggacguggaccuaggggccggcacccggcacgucaacgcggagccggagacgccuaauauggacgucauuggcgagcgcaucaggcgcauuaaagaggaacacagcucaaccuggcauuacgacgacgagaauccauacaaaacuugggcauaucacgggucguacgaggucaaggcgaccgggagcgcgucaagcaugaucaacgggguuguaaagcugcucaccaagccgugggacgucgugcccaugguuacccagauggccaugaccgacaccacucccuuugggcaacagcggguguucaaagagaagguggacacgagaacgccccggccgaugcccgggacccgcaagguaauggagaucacugcagaauggcucuggcggaccuugggaaggaacaagcggcccagacugugcacgcgggaggaguucaucaagaagguccgcaccaacgccgcaaugggcgcuguguucacggaagagaaucaaugggacucggcccgggcggccguggaagacgaggaguuuuggaagcucguagaccgggagcgagaguugcauaagcuggggaaauguggcucaugcguuuacaacaugauggggaagagggagaagaaguuaggagaguucgggaaggcgaaaggcagccgcgccaucugguacauguggcugggcgcccgguucuuagaguucgaggcacucggguuccuaaacgaagaccacugguucagcagagagaauagcuauagcggaguggagggggagggccugcacaagcucggguacauacuucgggauaucuccaagauccccggcggagccauguacgcugacgauaccgcggggugggacacucgcaucaccgaagaugaccugcacaacgaagagaagaucacgcagcagauggauccugagcaccggcagcucgccaacgccaucuucaagcugaccuaccaaaacaaggucgugaaggugcagcgcccgacccccaagggcaccgucauggauaucauaagccggaaagaccagcgcgguuccggacaggugggcacguacggauuaaacaccuucaccaacauggaggcucaacuaauucggcagauggagggcgaagggguguugagcaaggcggaccuggaaaacccccaucuucuugagaaaaagguuacgcaauggcuggagaccaagggcguggagcgccucaagaggauggccaucuccggggacgauugcguggucaagccgaucgacgaccgcuucgcuaacgcacugcuggccuugaaugacaugggcaaggugcggaaggacaucccccaguggcagccuagcaaaggcuggcaugacuggcagcagguucccuucugcucccaccacuuccaugagcugauuaugaaagacgggcggaagcucguagugccgugccggccccaggacgaguugaucggcagagcucggaucagccagggggccggcuggucccugcgcgagacggccugccuagggaaagcauacgcgcagaugugggccuugauguacuuccaccgcagggaccuucgccuggccucgaacgccauauguuccgccgugccaguccacugggugccaacaagucggacgacuugguccauccaugcccaccaccaguggaugacuaccgaggauaugcucaccguguggaaccgcgucuggaucgaggacaacccguggauggaggauaagacccccgugacgaccugggaggacgugcccuaccuggggaagagggaggaccaguggugcggcagccugauuggccucaccuccagggccacaugggcccagaacauacuuacggcuauccagcaaguccggucucugaucgggaacgaagaguuccucgauuacaugcccucuaugaaaagauucagaaaggaggaggaguccgagggggccaucugguaa

SEQ ID NO: 26217 - RNA, 9873 nt, Artificial Sequence
  derived and/or modified CDS sequence (opt11) from DENV-3__AY744684__SS-prME
accagccugugucuuaugaugaugcuccccgccacccuggccuuccaccucaccucccgcgauggcgagccccggaugaucgugggaaagaacgagcggggaaaaagccugcucuucaaaaccgccuccggcaucaacaugugcacacucaucgccauggaccugggugagaugugcgacgacaccgugaccuacaaguguccgcuaaucaccgagguggagcccgaggacauagacugcuggugcaaucuaaccagcaccugggugaccuacggcaccugcaaccaggccggggaacaccggcgcgacaagcgguccguggcccuagcgccccacgucgguauggggcuggacaccagaacccaaaccuggaugucugcggaaggugccuggaggcaggucgagaaagucgagaccugggcuuuucgccaccccgguuuuacgauccucgcccuguuccuagcgcauuauauaggcaccucccucacacaaaaaguggugaucuucauuuuacugaugcucgucacgccgagcaugaccaugcggugugugggggugggaaacagagauuucgucgagggacuguccggggcaaccuggguggacgucguccuggagcacggcgguugcgugacgaccauggcaaagaauaagccaacccucgauauagagcugcagaaaaccgaggccacgcagcuugccacccuccggaaacugugcauagaggggaaaaucaccaacgugaccacggacagucgcugccccacccagggagaagcgauccugcccgaggagcaggaccagaauuacgucugcaaacacaccuauguugaccggggcuggggcaaugggugcggccucuuuggcaagggcucccuggugaccugcgccaaguuccagugcuuggaaagcaucgaggguaaagccguccagcacgagaaccucaaguacacggugaucauaacagugcacaccggcgaccagcaccagguuggcaacgaaacucagggugugacggccgagaucacgccgcaagcaucuaccgucgaagcgauccugcccgaguacggcacucucgggcuugagugcagcccccggacaggccuggacuucaacgagaugauccugcucaccaugaagaacaaggccuggauggugcacaggcagugguucuucgaccugccauugcccuggacauccggcgcuaccaccgagacgcccaccuggaacaagaaggaauuacuggugacauuuaagaacgcgcacgcaaagaagcaagaggucguuguccuggggagccaggaaggagcgaugcauacagcccucacaggagcuaccgaaauccagacgucgggcgggaccucgaucuucgccggccaccugaagugcagauuaaagauggacaagcucgagcugaagggcauguccuacgcuaugugccuuaacgcguucguccugaaaaaggaggugagcgaaacgcagcacgggaccauuuuaaucaagguggaauacaaaggcgaagacgcucccugcaagauccccuucuccacagaggacgggcaaggcaaggcucacaacggccggcuuaucaccgcgaacccaaucguuacgaaaaaggaggagcccguaaacauagaggcggagccgccguuuggggaguccaacauugugaucggcaucggggacaaggcucuuaagaucaacugguauaagaaggguagcucaauagggaagauguuugaagcuaccgcgaggggagcccgacgaauggcgauccugggggacaccgccugggacuucgggucuguuggcgggguguugaacucccucggcaagauggugcaccagaucuucgggagcgccuauaccgcccuauucuccggcgucagcuggaucaugaagaucggaaucggggugcugcugacguggaucggccucaacuccaaaaacacguccaugucguuuagcugcaucgucaucgggauaaucacccuguauuugggcgccgucgugcaagcggauauggggugcgugaucaacuggaaggggaaggaacuaaaauguggcuccggaaucuucguuaccaacgaggugcacaccuggacugagcaguacaaguuccaggcggauagccccaagcggcucgccacugccaucgcaggggccugggagaacgguguuugcggcaucaggucgacaacgcgcauggagaaucuguuauggaagcaaauagccaacgagcugaauuacaucuugugggagaacaacauuaaacucaccaucguugugggggacgugaucggaguccuggaacaaggcaagcggacccuaacgccucagcccauggagcucaaguacagcuggaagacgugggggaaggccaaaaucgugacugcagaaacccagaauucgucguucauaauugauggcccgaauacccccgagugcccguccgcgagcagggcguggaacgugugggaagucgaggacuacggcuucggugucuucacuaccaacaucuggcugaagcuucgggaaauguacacacaguugugcgaucaccgucugaugucagcugcagugaaggacgagcgggccguccaugcagacaugggcuacuggauagagucgcagaagaacggaagcuggaaguuggagaaagccucccucaucgaagugaagacuugcaccuggcccaagucacacacgcuguggaguaacggcgugcuggagagcgacaugaucauuccaaagucccucgccgggcccaucagccagcacaauuaucgcccaggcuaccauacacagacugcaggaccguggcaucuggggaagcuagagcuugacuucaacuacugugagggcacaacggucgucauaaccgagaacugcgggacccggggcccgucucuacguaccacgaccguaucaggcaagcuaauccacgaaugguguugccgcucuugcacccugccgccccuccgcuacaugggcgaggacgggugcugguauggaauggagauccggcccauuaacgagaaagaagagaacauggucaaaagccuggugagugccggcagcgggaaggcggacaauuucacaaugggugugcuuugccuggccauucuguucgaggaaguaaugcgcggcaaguucggcaaaaagcacaugaucgccggagcauuauuuacguucgugcugcugcugagcggucaaaucacauggcgcgacauggcccacacccugaucaugauaggcagcaaugcguccgaccgcauggggaugggcgugaccuauuuggcccucaucgcgacguucaaaauccagccuuucuuagcgcuuggguucuuccuccggaagcuaacuucaagggagaaccugcuauuaggcgucggccuggcgauggcaacuacgcuccagcugcccgaggacauugagcagauggccaacgggaucgcccuaggcuugauggcccugaagcugauuacacaguucgagaccuaccagcucuggacggcccuagugucacugaugugcuccaacaccauaucgacgcucaccguagccuggcggaccgccacgcuaauccuggcggucaucagccuccuucccgugugccagucuuccagcaugaggaaaaccgacuggcugccgaugacuguggccgcgaugggggucccgccgcucccucuguuuaucuucucucugaaagauaccuuaaaacggcgcagcuggccguuaaaugagggcgucauggccguugggcugguaucgauacuagccagcucuuuccugcgcaacgacguucccauggccggcccccugguagccggcggauugcugaucgcuuguuacgugauaacgggcacgagcgccgaucucacaguggagaaggccgccgaugucaccugggaggaggaggccgagcagacgggggugucucacaaccucaugauaacgguggacgacgacggcacgaugcggauaaaggacgacgagaccgagaacauacugaccguccuguugaagaccgcgcuguugaucgugagcggaaucuuucccuacuccauaccugcuacguuacugguguggcacacauggcaaaagcaaacccaacgcagcggcgugcuuugggacgugccgucaccgcccgagacacagaaggccgaacucgaggaaggcguguaccggaucaagcagcaggggauauuuggcaagacccaggucgggguaggggugcagaaggaaggggucuuccacacgauguggcauguaacccgcggggcuguccucacccacaacggcaagcggcuggagccgaacugggcgaacgucaagaaggaccucaucagcuacgggggcggauggaagcuguccgcgcaguggcagaagggcgaggagguccaggugaucgcggucgaaccaggaaagaacccgaagaacuuccagacgaugccuggcaucuuccagaccacgaccggcgagaucggggccaucgcccuggauuucaagcccggaacaagcgggagcccuaucaucaaccgggagggcaagguggugggccuuuacgggaacggcgucgugaccaagaaugguggcuacguaagcgggaucgcgcaaaccaacgcagagcccgacggcccgacccccgagcucgaggaggagauguucaaaaagcguaaucugaccauuauggaccugcacccgggcucugggaagacccggaaguaccucccagccauaguccgggaggcgauaaagcgccggcugcguacgcugauccuugccccgacccgggugguggccgcugaaauggaggaggcccugaaaggccugcccauaagauaccaaacgacggccacuaagagcgaacacaccgggcgggaaauaguugaucucaugugccaugccaccuuuaccaugcgacugcugagccccgugcggguacccaacuacaaccucauugucauggaugaagcgcauuucacggacccugccuccaucgccgcgcgcggcuauauaagcacccgugugggaaugggcgaagcggccgccauauucaugacggccacgccgcccgggaccgcagacgcguucccccaguccaacgccccgauccaggacgaggagcgggacauccccgagaggucguggaacucugggaacgaguggaucacagacuucgccggcaagacggugugguucgugccuucaaucaaggccgggaacgauaucgccaacugccugagaaagaacggcaaaaagguuauacaguugucccgcaagacguucgacacagaguaucagaagaccaaacucaacgacugggacuuuguggucacgaccgacaucagcgaaaugggggcgaacuuuaaggcugaccggguaauagauccccgccguugcuugaaaccugugauucugaccgacggccccgagcgcgucauccuagccggcccaaugcccguuacugucgcguccgcggcccaacggagggggcgcgucggacgcaacccgcagaaggaaaacgaccaguacaucuucaccgggcagccccuuaacaaugacgaggaucacgcccacuggaccgaggccaagaugcuguuggacaacaucaacacgcccgaaggcaucauccccgcccuguuugaaccagagagagaaaaguccgcggccaucgacggggaguaccgccugaagggcgagagccggaaaaccuucguagaacucaugaggcggggcgaccugcccguauggcuggcccacaaggucgccagcgaggggaucaaguacaccgaucgcaaauggugcuucgacggugagcggaauaaccagauucucgaggagaauauggacguggagaucuggacgaaggagggugagaagaagaaguuacgcccccgguggcuggacgcccguacuuauuccgacccccuggcccugaaggaguuuaaggacuuugccgcgggccggaaguccaucgcccuggaccucgucacagagaucgggagaguuccgucucacuuagcacaccgcacccggaacgcgcuggacaaccucgugaugcugcacaccagcgagcacgggggacgcgcuuaucgacacgccgucgaggagcugcccgagaccauggagacccuccugcuuuuaggccugaugauccuucucaccggcggggcaaugcuuuuccugauaagcgggaagggcaucgggaagacguccaucggccucauuugcguaguggcgagcuccggaaugcucuggauggcugacgucccccuucaguggauagcgagugccauagugcucgaguucuucaugauggugcuguugauaccggagccugagaagcagcgcaccccgcaggacaaucagcucgcuuacgucgugauugguauacugacgcuggcugcgauaguggccgcaaacgagauggggcuccuggaaacuaccaaacgugaccugggcauguccaaggagcccggcgucgugagcccaacuuccuaccucgacguggaccugcacccggccagcgcguggacuuuauacgccguggcuacuacgguuaucacccccaugcuccgccacaccauagagaacuccaccgccaacgugagcuuggccgcgauugcuaaccaggccgucguucugauggggcucgauaaaggcuggcccauuuccaagauggaccugggugugccgcugcuagcuuugggcugcuacagccagguuaacccccugacccucaccgccgcgguacuucugcucgugacccacuacgccaucaucgggccgggccugcaagccaaggcgaccagggaggcccaaaaacgcacggcugccgguaucaugaagaacccaaccgucgacgggaucaugaccaucgaucucgaccccgugauauaugacucuaaguuugagaagcagcucggccaggugaugcugcucguucucugcgccgugcagcuccugcucaugcggaccagcugggccuucugcgaggcguuaacgcuagccacagggcccaucaccacccuaugggaaggcucccccggaaaguuuuggaacacgaccaucgccgugucaauggccaacaucuuccgcggauccuaucuggccggggcagggcuggccuucucgaucaugaaaucggucggcaccgggaagcgggggaccggcagccagggggaaacgcucggugagaaguggaagaagaagcugaaccaacugucccgcaaggaauucgaccucuacaagaagucggguaucaccgagguugacaggaccgaggccaaggagggccugaagcgcggcgaaauaacccaccaugcagugucgcgcggcuccgccaagcugcaaugguucgucgagcgcaacaugguuauacccgaggggcggguaaucgaccucgggugcggccgagggggcuggaguuacuacugcgcgggacugaaaaaagucaccgaggugagaggcuacacgaaaggagggcccggccacgaggagcccguucccauguccaccuacggguggaacaucgucaagcugaugagcgggaaggacguguucuaucucccgcccgagaagugcgacacccugcugugcgacauaggggaguccagccccagccccacaguugaggagagccgcaccauacgggucuuaaagaugguggagcccugguugaagaacaaccaguuuugcauuaagguucugaaucccuacaugcccaccgucaucgagcaucuggaacgccuacagagaaaacacggcggcaugcuaguccgcaauccccugucccgcaauucgacucaugagauguacuggaucuccaacggaacaggcaacauuguuucuucugucaacauggugagcaggcuucuucuaaacagguucacgaugacucaccggcgcccgaccauugagaaggacguugaccucggggccgggacccggcacgucaacgcggagccggagacgccaaauauggacgugaucggagagcggauucggcgcaucaaggaagaacacuccagcaccuggcacuacgacgaugagaaccccuacaagaccugggcauaccacggguccuacgagguaaaggccacaggcagcgcaucaucuaugauaaauggggucgugaagcuccugacaaagccgugggaugucgugcccauggugacgcagauggcuaugaccgacaccacgcccuucggacagcaacggguguucaaggagaagguggauacccgcaccccucggccaaugcccgguacccgcaaggugauggagaucacggccgaguggcucuggcgaacccugggccgcaacaagcgacccaggcugugcacacgggaggaguuuaucaagaaggugcgcaccaacgccgcgaugggcgccguguucacggaagagaaccagugggacagcgcccgagcugccgucgaggacgaggaguucuggaaacugguggaucgggagcgugaguugcacaaacuggguaagugcggcuccugcguguauaacaugauggggaagcgagagaagaagcucggcgaguucggcaaggcgaaggggagccgcgccaucugguauauguggcugggcgcccgguaccuugaauucgaggcacucggguuucuuaacgaagaucacugguucucccgcgaaaacagcuauuccggcguggagggugaggguuugcacaagcucggguacauacugagagacaucucaaaaauccccggcggggcgauguaugcggacgacaccgccgguugggacaccagaaucacugaggaugacuuacacaacgaggaaaagauaacgcagcaaauggauccggaacaccggcaacuggccaaugcgaucuucaagcugaccuaccagaauaaggucguaaaggugcagcgccccacgcccaaggggaccguaauggacaucaucucccggaaagaccagcgcgggagcggccagguaggcacguacgggcugaauaccuucacuaacauggaagcccagcucauccggcaaauggagggcgagggggugcugagcaaggcggaccuggagaauccccaccuccucgagaagaaagucacccaguggcuggagaccaagggcgucgagcgcuuaaagcggauggccauauccggggacgacugcguggucaagccgauugaugaccgcuuugccaacgcccugcuggcccucaacgacaugggcaaagugcggaaggauauuccccaauggcagcccucaaaggguuggcacgacuggcagcaagucccguucugcucccaccauuuccaugagcuuauuaugaaggacgggcgcaagcuggucgugccuugccggccacaagaugaacuuaucggcagagcgcggaucucccagggggccggcuggucauugcgcgagacggcaugccuggguaaagcuuacgcucagaugugggcccucauguacuuccaccgccgggacuuacgucucgccuccaaugccaucugcagcgcugugccuguccacugggucccuaccucucgaaccacuugguccauccacgcgcaccaccaguggaugacgaccgaggacauguugaccguguggaaccgcguuuggauagaggacaacccuuggauggaggacaagacccccguaaccacuugggaggacgugcccuaucuuggaaaacgggaggaucaguggugcggcucgcugaucggauuaaccucccgcgccacuugggcccagaacauccugacggcgauucagcagguccggagccugaucggcaacgaagaguuucucgacuacaugcccuccaugaaacgcuuccggaaggaggaggaaucggaaggggccauaugguga

SEQ ID NO: 26218 - RNA, 9873 nt, Artificial Sequence
  derived and/or modified CDS sequence (opt11) from DENV-3__AY744685__SS-prME
acuucucugugccucaugaugaugcugcccgcaacccuggccuuccaccucaccucccgggacggggagccucggaugaucgucgggaagaacgagcgcggcaagagccugcuguucaagaccgcguccgggaucaauaugugcacccucaucgccauggaccugggcgaaaugugcgacgauacugucacguauaagugcccccugaucaccgaaguggagcccgaggacauugacuguuggugcaaccucaccagcaccugggugacguacgggaccugcaaccaggccggcgagcaccggagggacaagcggucugucgcacuggccccucacguggggauggggcuggacacucggacgcagacguggaugagcgcggagggcgccuggagacagguggagaaggucgagaccugggccuuccgccacccgggguucaccauccucgcccuguuccuggcacauuauaucggcaccucccucacgcagaaggugguaaucuucauccuuuuaaugcucgucacgcccagcaugaccaugcguugcgugggggucggcaaccgcgauuucguagagggucuguccggagccaccuggguggacgugguccuggagcacggcgggugcguuaccacgauggccaagaacaagccuacccucgacauugagcugcagaagacagaggccacacagcuggccacacuucggaagcugugcaucgaggggaagauaacuaacgugacaacugacucacgcugccccacccaaggcgaggcgauccugccggaagaacaggaccaaaacuacgucugcaagcacaccuauguagaccgcgggugggggaacgggugcggacucuucgggaagggcucccugguaaccugcgccaaguuccagugccuggagagcaucgagggcaaggccguccagcacgagaaccucaaguacacggugaucaucacaguucacaccggggaccaacaccaaguagguaaugaaaugcaagggguaaccgccgagaucacgccccaagcguccaccgucgaggcuauacuccccgaguacggcacccuggggcucgagugcagcccccgcacaggccuggacuuuaacgagaugaucuugcucaccaugaagaauaaggcuuggauggugcaccggcagugguucuuugaccugccgcuccccuggacguccggcgccaccacagagacacccacuuggaacaagaaggagcuccuggucacuuucaagaacgcccacgccaagaagcaggaggucgugguguugggaucucaggagggcgccaugcacaccgcuuuaaccggggccaccgagauccaaacuuccggcgguacuagcaucuucgccggccaccugaagugcagacugaagauggacaagcucgaguuaaagggcaugucguacgccaugugccugaaugcguucguccugaagaaggagguaagcgagacccagcacgggaccauccugauuaagguggaguacaagggcgaggacgcaccguguaaaauuccguucagcaccgaggaugggcagggaaaggcccacaacggccggcugaucacggccaaccccaucgucaccaagaaggaggagcccgugaacaucgaagccgagcccccuuucggggagagcaacauuguuaucggcaucggggacaaagccuuaaagaucaacugguacaaaaagggcagcucgaucggcaagauguucgaagccacggcgcgcggcgcucggcgcauggcgauacucggcgacaccgccugggacuucgggagcgucggcgggguguugaacucccugggcaagauggugcaccagaucuucgggagcgccuacaccgcccucuucuccggcgucagcuggaucaugaagauaggcaucggugugcuauuaacauggaucggccuaaauuccaagaacgcaagcauguccuucagcugcaucguaaucgggaucaucacgcuguaccugggcgcggucgugcaggccgacauggguugugugaucaacuggaagggcaaggagcucaaaugcgguuccgggaucuucgucaccaaugagguccacaccuggaccgagcaguacaaguuccaggccgacagccccaagcggcuggcgaccgccauagcgggcgccugggagaacggggugugcggcauacgcucaaccacccgcauggaaaaucugcucuggaagcagaucgccaacgaguugaacuacauccugugggagaauaacaucaagcucaccaucgucguuggagacgugauaggcguccuggagcagggcaagcggacgcugacuccccagcccauggagcucaaguacagcuggaagaccugggggaaggcuaagaucgugaccgccgagacccaaaauuccagcuucaucaucgauggcccuaacacccccgagugccccucggcccugcgcgccuggaaugugugggaggucgaagacuauggguuuggcguguucaccaccaacauuuggcugaagcuccgggagaaauacacgcagcuuugcgaccaccgccugauguccgcugccguuaaagacgagcgagccguccacgccgauauggguuacuggauagagucucaaaagaacggguccuggaagcuagagaaggccagccugauugaggugaagacgugcacuuggcccaagucacauacccucuggaguaacggcguguuggaguccgauaugaucauuccgaaaagccuggccgggcccauuagucagcacaacuaucgccccggcuaccacacacagacggcagggccguggcaccuggguaagcucgagcuggacuuuaacuauugcgaaggaacaacgguaguaaucacagagaauugugggaucaggggcccaucgcugcgcacgaccaccgugucugggaaguugauucacgaguggugcugccggagcugcacccucccucccuuacguuacaugggcgaagacgggugcugguacggcauggaaauacggccaauuaacgagaaggaggagaauauggucaagucucucguaagcgcgggcuccgggaagacggacaacuucaccaugggcgugcugugccuggcuauacucuucgaagaggucaugagagggaaguucggcaaaaagcacaugauugccggugcacuguucaccuucguguuacuccugucuggccagaucacauggagagauauggcccacacgcuaaucaugaucggcucaaacgcgagcgaccggauggggaugggcgugacuuaccucgcccugaucgccaccuucaagauccagcccuucuuggcccucggcuucuuccugcguaaguugaccagccgcgagaacuuacugcugggcgucggccuugcgauggccacgacccugcagcugccugaggauauugagcaaauggccaacgggaucgcccugggccuaauggcccugaagcucaucacccaguuugagaccuaucagcuguggacugcgcuuaucagccucaugugcagcaacacgaucuucacccugaccguggccuggcggacggccacacugauccucgccgugaucucccuucuaccggucugucaaaguucaagcaugcgcaagaccgacuggcucccgaugaccguggccgcaaugggggucccaccccugccccucuucaucuucucccuaaaggacacgcugaagcggcgcagcuggccguuaaacgagggcgucauggccguggggcucgucucuaucuuggcuagcuccuuucugcgcaacgacguacccauggccggcccccuaguugcuggcggauuacuuauagcgugcuaugucaucaccggcacgagcgccgaccucaccguagagaaggccgcugacgugacgugggaggaggaggccgagcagaccggggucucccacaaccugaugauaacgguugacgaugacggcaccaugcgaaucaaggacgacgagaccgagaacauacuuaccguucucuugaagaccgcccugcucauagucagcgggaucuucccauacuccaucccggcgacccugcugguguggcacaccuggcaaaagcagacgcagcgcuccggcguguuaugggauguuccuucaccgccugagacacagaaggccgagcuggaggagggcguguaccgcauuaagcagcaagggaucuucggcaaaacccaggugggggucggcguccagaaagagggugucuuccacaccauguggcacgucacucgcggcgccguacuaacacacaacggcaagaggcuagagccuaacugggcuaaugugaaaaaggaucugauuagcuacggcggaggguggaaguuguccgcccaauggcagaaaggcgaggagguccaggugaucgcuguggagccaggcaagaaccccaagaauuuccagacaaugcccggcaucuuucagaccacgaccggcgagauuggggccauugcccuggacuucaagccgggcacgagcgggucccccauaaucaacagagagggcaaggucgugggccucuacggcaacggcgucgucaccaagaacggcggauacgugagcgggaucgcgcagacgaacgccgagcccgauggaccgacccccgaacuggaggaagagauguucaagaaacggaaccuaaccaucauggaccuccaccccggcagcggcaaaacccgcaaguaccuucccgcaaucguucgggaagcaaucaagcggcggcugcgcacgcucauccuggcaccuacccggguuguggcggccgagauggaggaggcccugaagggacuccccauccgcuaccagacuacggccacaaagagcgagcacaccgggcgggaaaucguugaccugaugugccaugccaccuuuaccaugcgcuugcucagccccguucggguacccaacuauaaucuuaucgugauggaugaggcgcacuucacggacccugccuccaucgcugcccgcggcuacaucucgacccgggucgggaugggcgaggcggccgccauuuucaugaccgcgacaccacccggaacagccgacgcguucccccagaguaacgccccgauccaagacgaagaacgagacaucccagagcgaucuuggaacuccgggaacgaguggaucaccgacuucgccggcaagacugugugguucgugccaagcaucaaagccgggaacgacaucgcuaacugcuugcgcaagaacggcaagaaaguaauccagcucucccgcaagacauucgauacggaauaccaaaagaccaagcugaacgauugggauuucgugguuaccaccgacaucagcgagaugggggcgaacuucaaggccgaucgggucauugacccuagacgaugucugaagccggugauccucacggacggccccgagcgcgugaucuuagccggccccaugcccgucacaguggccucugcggcgcaacggagagggcggguaggucgaaacagccagaaggagaaugaccaguacauuuucaccggacagccgcugaacaaugacgaggaccacgcccacuggaccgaggccaagaugcugcuugacaacaucaauacgcccgagggcaucaucccagcgcuguucgagcccgaacgcgagaaguccgcugccaucgacggggaguaccggcuuaagggggagagccgaaagacuuucgucgagcugaugcgacggggcgaucuaccgguguggcuggcacacaagguggccuccgaggggauaaaguacaccgaucgcaaguggugcuuugacggcgaacggaacaaccagauccuggaggagaacauggacgucgagaucuggaccaaagaaggggagaaaaagaagcugagaccccgguggcucgacgcccgcaccuacagcgauccccuggcccugaaggaguuuaaggacuucgcugcgggccggaaguccauugcacucgaccuagugacugagaucggccgcguccccagccaucucgcccaccguacaagaaacgcucucgacaaccuggugaugcugcacaccucagagcacgggggccgcgccuaccggcacgcuguggaggaguugccggagaccauggagacucuccugcuccucggucugaugauccuccucaccggcggggccauguuguuucucauuagcgggaagggcaucgggaagaccagcaucgguuugaucugcgucguugccuccagcgggaugcucuggauggccgauguaccgcuucaguggauugcuuccgcuauaguccuagaguucuucaugauggugcuguuaauccccgagccggagaagcagcgcacaccccaggauaaccagcuggccuauguggucaucggcauccugacccucgccgcgaucguggcggccaacgagauggggcuacuggagacuaccaagcgagacuuggggaugagcaaggaaccuggcguagucucacccacuucguaccuggacguagaccuccacccggccuccgcguggacauuauacgccgucgccacaaccgucaucacuccgauguuacgccauaccauagaaaacagcaccgccaacgugucucuggcugcgauagccaaccaggccgucguacuuauggggcuggacaagggcuggcccauuagcaagauggaucuuggggugccccuucuggcgcugggcuguuauucccaggucaacccccucacucugaccgcagcgguguugcuccuggugacacacuacgccauuaucgggcccggccugcaggcgaaggccacccgggaggcccagaagaggaccgcagccggaaucaugaagaaccccaccguggacgggaucaugacgauagaucucgaccccguaaucuaugacagcaaguucgaaaagcagcugggccagguuaugcugcucgugcugugcgccguccaacugcuccuaaugcggaccuccugggcuuucugcgaggcacugacucucgcuaccgggccgauuacgacccugugggagggcagccccggcaaauuuuggaacaccacuaucgcaguaagcauggccaacaucuucagagggucuuaccucgccggcgcggggcucgccuucuccauuaugaaaagcgugggcacggggaagagagggaccggcucgcagggggagacacugggcgagaaguggaagaagaaacuaaaccagcuuagccgcaaagaguucgaccuguacaaaaagucugggaucacggaagucgaucguacggaggccaaagaaggcuugaagcgcggcgagaucacccaccacgccgugucccggggaagcgccaaacuucagugguucguggagcgaaacauggucauccccgagggucgagugaucgaccucgggugugggcgcggaggcuggucauacuacugugcugggcugaagaaaguaaccgagguccggggauacaccaagggcgggcccggccacgaggagccgguucccaugagcacauacggguggaacauagugaagcucauguccggaaaggacgucuucuaccugccacccgagaagugugacacguuacugugcgacauuggggagagcuccccaagcccaacgguugaagaaucccgcacgauccggguccucaagaugguagagcccuggcugaagaacaaccaguucugcaucaaagugcugaaccccuacaugccgaccguuaucgagcaccucgaacgccugcaacgcaagcacggcggcaugcuggucaggaacccgcucagccgcaacuccacgcacgagauguacuggauaucaaacgggaccggcaacauugugaguagcguuaacauggucucccggcuguugcuuaaucgcuuuacgaugacccaccggcgccccacaauagaaaaagacguggaccugggggccgguacccggcacgugaaugcagagccggagaccccgaacauggacguuaucggcgagcgcauccggcgcaucaaggaggaacacagcuccacauggcacuaugacgacgagaaucccuacaagacgugggcuuaccaugggucguaugaggugaaggccacaggcuccgcauccagcaugaucaauggagucgugaagcuguugacgaaaccgugggacguaguaccgauggucacccaaauggccaugacggacacaaccccauucggucagcaacggguguucaaggagaaggucgacacccgcacgccccggcccaugccggguacacgcaagguuauggagaucaccgcggaguggcuguggcggacccugggccgcaauaagcguccccgccucugcacgcgggaggaguuuaucaaaaaggugcgcaccaacgcggcgaugggggcagucuucaccgaggagaaccagugggacuccgcucgcgcggcuguggaggacgaggaguucuggaagcugguggaccgggagcgcgagcugcacaagcuagggaagugcgguaguugcgucuauaacaugauggguaagagagagaagaagcugggcgaguucggaaaagcaaagggcagucgcgccaucugguacauguggcugggcgcgagguaccucgaguucgaggcccugggguuccucaaugaggaccauugguuuuccagagagaacucgcacagcgggguggagggggaggggcuccacaagcugggguacauccugcgggacaucaguaagaucccaggcggcgccauguacgcggaugacaccgcagggugggacacacgcaucaccgaagacgaccuccacaacgaggagaagaucacccaacagauggacccugagcaccggcagcuugccaacgccaucuucaaacugaccuaccagaacaagguggucaaagugcagcgcccgacgccgaagggcacgguuauggacaucauaagccggaaggaucagcgcgggagcggccaaguaggcaccuauggguugaacaccuucacaaacauggaggcccagcuaauccgucagauggagggcgagggagugcucagcaaggcggacuuagagaacccucaucugcuggagaagaaggugacacaauggcuagagaccaagggcgucgagcgcuugaaacggauggcgauaaguggagacgacuguguggucaagcccauugaugaccgcuucgccaacgcucugcucgcccugaacgacaugggcaagguaagaaaggacaucccgcaguggcagccguccaagggcuggcaugauuggcagcagguacccuuuugcucccaccacuuccacgaguugaucaugaaagacgggcgcaaguuagucgucccgugccggccgcaggacgaacugaucggccgcgcacggauuagccaaggugccggcuggucccugagagagaccgccugccucgggaaggcguaugcgcaaaugugggcccuaauguauuuucaccgccgggaccugcgccucgccuccaacgccauaugcucugccgugccugugcacuggguccccaccagccggacgaccugguccauccacgcgcaccaccaauggaugaccaccgaggauaugcugacgguguggaaucgcguguggauugaggauaacccauggauggaggacaagacacccgucaccaccugggaggaugugcccuaccuaggaaagcgggaagaucagugguguggcagccucaucggucugacuagccgcgcgaccugggcccagaauauacugaccgccauucagcagguccggucccucaucggcaacgaggaguuucucgauuacaugccgagcaugaaacgguuccggaaggaggaggaguccgagggagccauuugguga

SEQ ID NO: 26219 - RNA, 9873 nt, Artificial Sequence
  derived and/or modified CDS sequence (opt11) from DENV-3__AY876494__SS-prME
accagccucugcuugaugaugaugcugcccgcgacccuggccuuccaccucaccucccgugacggggagccccggaugaucguugcgaaaaaugagcgcgggaaaucacucuuauuuaagaccgcaagcggcaucaauaugugcacccuaaucgcgauggaccugggggaaaugugcgacgacaccgugacguauaagugcccccugaucgccgagguggaacccgaggacauagacugcuggugcaacuuaacaucaaccugggugaccuacgggacuugcaaccaggccggggagcaucggcgcgacaagcggagugucgcccuggcgccgcacgugggcauggggcuagacacccgcacccagaccuggaugagcgccgagggggccuggcgucccguugagaagguggagacgugggcguugcggcaccccggcuuuacaauccuggcacucuuccucgcccacuacaucgggacuucucugacccagaaggugguaaucuuuauccuucuuaugcuugucaccccaucaaugaccaugcggugcgucggcguggggaacagagacuuugucgagggacuguccggugccaccuggguggacguggugcucgagcacgguggcugcguuaccacgauggcgaagaacaagcccacccuggacaucgagcugcagaagaccgaggcaacacaacuugccacccuacggaagcucugcaucgaggggaagaucaccaacgugacgacugacagccgcugcccgacgcagggcgaggccaucuuacccgaggagcaggaccagaacuacgucuguaagcauacuuacgucgaccggggcugggguaacggcugcgggcuguucggaaaagggucccuggugacaugcgcaaaguuccagugcuuagagcccaucgaaggcaaggucgugcagcacgaaaaccugaaauacaccgugauuaucacgguacauacaggcgaccagcaccagguggggaacgacacccaggggguuaccgucgaaaucaccccacaggcuagcaccgcggaggccauccugccggaguacgggacccucgugcuggagugcucaccccguaccggccuggacuuuaacgagaugauccuccugaccaugaagaacaaggcguggauggugcaccggcagugguucuucgaccugccacucccuuggacgagcggggcuaccaccgagaccccgacguggaaccgcaaagagcugcugguuacguucaaaaacgcucaugcgaagaagcaagagguggucguucucggcucccaggagggcgcaaugcacaccgcccugaccggugccacagaaauccagaacagcggcggaaccuccauuuucgccggccaccuaaagugucgucucaagauggacaaacuggagcugaagggcaugagcuacgcgaugugccucaacaccuuugugcucaagaaggaggucuccgaaacccagcauggcacuauccuaaucaagguggaguauaagggcgaggacgcccccugcaagauccccuucagcacagaggacggacagggcaaggcccacaacgggcgccugaucacugccaaccccgugguuacaaagaaggaggagcccgugaauaucgaagcggaaccgcccuucggggagucaaacaucgugaucgggaucggggacaaggcauuaaagaucaacugguauaagaagggcuccaguaucgggaaaauguucgaggcgacggccaggggcgcccguaggauggcgauccugggcgacaccgcuugggacuucggcuccgucggcggggugcugaacagccucggcaagaugguucaucagaucuuugggucggccuacacggcucuguucagcggcgucuccuggauuaugaagaucgggauuggcgugcugcucaccuggaucggccugaauagcaagaacacuuccaugaguuucucgugcaucgugaucgggauaaucaccuuauaucuaggcgcuguuguucaggcggacauggggugcgugauaaacuggaaaggcaaggagcucaagugugggagcggcauuuucgucaccaacgaggugcacaccuggacggagcaguacaaguuccaggccgauuccccgaaacggcuggcgacagcuaucgccggggcgugggagaacggcgucuguggaauacgcagcacuaccaggauggaaaaccuccuguggaagcaaaucgccaacgagcugaacuauauccugugggagaacaauauaaagcuaacggucguggugggcgacaucaucggcguccuggagcagggcaagcgcacccucaccccgcaacccauggaauugaaguacuccuggaaaaccuggggcaaggccaagaucgugacugccgagacacaaaacagcuccuuuaucauugacgggcccaacacccccgagugcccgucagcgucgcgggccuggaacgugugggaaguagaggacuacggcuucggcguguucaccacgaacaucuggcugaagcuccgcgagguguacacgcagucaugcgaccaucgguuaaugagcgcggccaucaaggaugaacgggccguccaugcugacaugggauacuggaucgagucccagaaaaacggcagcuggaagcuggagaaggccuccuuuaucgaggugaaaacgugcacguggcccaagucgcacacacucuggucaaauggcgugcuggagucugacaugaucaucccuaaauccuuggccgggccgaucucgcaacacaaucacagacccggcuacuacacgcagaccgcagggcccuggcaccucggcaagcuggagcuggauuucaauuacugcgaggggaccaccguagugaucacggagaacugcggcacccgcggcccuucccugcggacuaccaccgugucaggcaagcugauccacgaguggugcugccgcucaugcacccugccgccccuccgguacaugggcgaggacgggugcugguacggcauggagauccgccccaucaacgagaaggaagagaauauggucaagagccugguaagcgccgggagcggcaaggucgacaacuucaccauggggguccuguguuuagcgauccuguucgaggaggugaugcgagggaaguuugguaagaaacacaugauagccggggugcucuuuacuuuuguucuccugcucuccggccagaucacguggagagacauggcucacacacucaucaugauugggucgaacgccuccgaccggaccggaaugggggugacuuaccuugcucugaucgcuacguucaagauccagccauuccucgcccugggguucuuccuucgcaaacucaccagccgggagaaccugcugcucggaguggggcuggcgauggccaccaccuuacagcucccggaggacaucgagcagauggcuaauggcaucgcgcuggggcugaugacgcucaaauugaucacgcaguucgaaaccuaccagcuuuggacugcccucgugagccucacgugcuccaacaccauauuuacccugacgguugccuggcgcacagcgacccucauccuggcgggggucagucuguugcccuuaugccagucgucauccaugcgcaagaccgacugguuacccaugaccgucgccgccaugggcgugccgccguugccccuguucaucuuuagccugaaggacacuccuaaaagacgcuccuggccccugaacgagggggucauggcugugggccuggugucgauccuggccuccagccuccuucggaacgacgucccgauggcgggaccccucguggcuggcggccuccugaucgccuguuacgugaucaccgggacgucggccgaucugaccgucgaaaaagccgcagacguaacgugggaggaggaagcugaacagaccggagugagccacaaucucaugaucaccgucgacgaugacgggaccaugcgcaucaaggaugacgagacggagaacauccccacggugcugcugaagaccgcccuucuaaucguguccggcaucuuucccuacagcaucccggccacccugcuggucuggcauacuuggcaaaagcagacccagcggucgggggugcugugggacguccccagcccgcccgagacccagaaggccgagcuggaggaaggcgucuaccgcaucaagcagcagggcaucuucgggaaaacccaggugggcguggggguacagaaggagggcguguuccacaccauguggcacguuacgcggggcgccguccucacccacaacggcaagagacuggagccgaauugggcuuccgugaagaaggaucucaucagcuacggcgguggcuggcggcucuccgcccaguggcagaaaggggaggagguucagguaauugccguggagcccgggaagaaccccaagaacuuccagaccaugccggggaucuuccagaccacuacuggcgagaucggcgcaaucgcccuggacuucaaacccgggaccagcggcucgcccauuaucaaccgcgaggguaagguggucggacuguacggcaacgggguagucaccaagaacggcggguacguauccggcauagcgcagacaaacgccgagcccgacgggccuacgcccgagcuggaggaggagauguucaagaagcgcaaucuaaccaucauggacuugcaccccgguagcggcaaaacacgcaaguaccugcccgcgauagugcgggaagcgaucaagcggaggcuccgcacgcugauccuggcccccacccggguuguggccgccgagauggaagaggcccucaaagggcugcccauccgcuaucaaaccacggcgacgaaguccgagcacacgggccgggaaaucgucgaucugaugugccacgcaacauucaccaugcgccuacugagccccguacggguacccaacuacaaccugauaauaauggaugaggcucacuucacggacccggcaucuaucgcggcgcgcggauacauuagcacucggguuggcaugggggaggccgcggccaucuucaugacugcgacaccgcccggcacggccgaggccuucccccaguccaacgcgccgauccaagacgaggagcgcgacauacccgaacgcaguuggaacuccggcaacgaguggaucacugacuucguugggaagaccgucugguuuguccccucaaucaaagcugguaacgacaucgcgaacugucuccggaaaaacgggaagaaggugauccagcugagccgcaagaccuucgauacggaguaucagaagacccggcugaacgacugggacuuuguaguaaccaccgacaucagcgagaugggcgccaauuucaaggccgaucgcgugaucgauccccgucgcugccucaagccggucauccugaccgaugggcccgaacgugugauacuggcuggcccgaugcccgugaccgccgcaagugccgcacaacgccggggacgcgucggacggaacccgcagaaggagaacgaccaauacauauuuaccggccagccccucaacaaugacgaggaccacgcccauuggacugaggccaagaugcugcuggacaacauaaacacccccgaggguaucauacccgcccuauucgaaccggagagggagaaguccgcggccaucgauggcgaguaccggcugaagggugagucccgcaagacguucguggagcugaugcggcgcggugaccuuccugucuggcuggcccauaaaguggcgagugaggggaucaaguacacggacagaaagugguguuucgacggggagagaaacaaccagauucuggaggaaaauauggacguugagaucuggaccaaggaaggcgaacggaaaaaguugagaccccgcuggcuggacgcccggacuuacuccgacccucuggcacucaaggaguucaaggacuucgccgccggccgaaagagcaucgccuuggaccuggucacggagaucggccgugugcccucccaccucgcgcauagaacucgaaacgcccuggauaaccuggugaugcuccacaccagcgaacacggcggcagggccuaccggcacgccgucgaggaacuuccggagaccauggaaacacugcuccugcucggucucaugauccugcuuacugggggcgcgaugcuguucuugauuucugggaagggcaucggcaagaccuccaucggguugauauguguaauaguguccucugggaugcucuggauggccgacguccccuugcaguggaucgcgucagcuauaguguuggaguucuucaugaugguacuccugaucccggagccagagaagcagcgcacgccccaggacaaccagcuggcuuacgucguuauugggauccuuacgcuggcggccauuguagccgccaacgagaugggacugcucgaaaccaccaagcgggaccugggcauguccaaggagcccggcgucguguccccgaccucauacuuagacguggacuugcaccccgccucggcauggacacuguacgccguugccaccaccgugauaacccccauguugcgucacacuaucgagaacuccaccgccaacgugagccucgccgccaucgccaaucaggcggucgugcuaaugggccuggacaaaggguggcccaucuccaaaauggacuugggcguuccccugcucgcacucgguugcuacucucaggucaacccucugacccugacggcggcagugcugcuucuggugacgcacuacgccaucaucggccccgggcuccaggccaaggccacccgggaggcgcaaaagcgcacagccgcggggaucaugaagaauccgaccgucgacggcaucaugacgaucgaccuggacccggugaucuacgacuccaaguucgagaaacaacugggccaagugaugcucuuaguccucugcgccgugcagcuccugcugaugagaaccagcugggcgcucugcgaagcgcugacacuggccaccggccccaucacgacuuuaugggaggggucccccggcaaguucuggaacaccacaaucgccgugagcauggccaacaucuuucgcggcuccuaccuggcgggggcggggcuggccuucagcaucaugaaguccgucgggacgggcaaacgggggaccggcucccagggcgaaacucucggggagaaguggaagaagaaauuaaaccagcugucacgcaaagaguucgaucucuauaagaaauccggaaucaccgagguggaccggaccgaggccaaagagggacugaagagaggcgagacgacccaccacgccgugagccggggguccgcgaaauuacaaugguucgucgagaggaacaugguuauccccgagggccgggucaucgaccucgggugcggucgcggcggguggucauacuacugcgccggccugaagaaggucacugaggugcgcggguauacgaagggcgguccugggcacgaggaaccugugcccaugaguacguacggauggaacaucgucaagcugaugagcgggaaggacguguucuaccuacccccggagaaaugcgacacauuguuaugugacaucggcgaguccagccccucccccaccgucgaggaaucacggaccauccguguacugaagaugguagagcccuggcucaagaacaaccaauucugcaucaaggugcugaaccccuauaugcccacggucaucgagcaccuggagaggcuccaacggaaguacgggggcaugcugguucguaacccucugucccgcaacucuacccacgagauguacuggauuucgaacggcacggggaauauugugucguccgucaacauggugaguagacuacugcugaaucgcuucaccaugacgcaccggcguccgaccaucgagaaagacgucgaccucggcgccgggacgcggcacgucaacgccgagcccgagacacccaauauggacguaaucggcgaacgcaucaagagaauaaaagaggaacacuccagcacauggcacuacgaugacgagaaccccuauaagaccugggcguaccacggauccuacgaggucaaggcgaccggguccgcuagcuccaugauaaacggugucgucaagcuguuaaccaagccgugggauguggugccaauggugacgcagauggccaugaccgacaccacccccuucggccaacaacgcguauucaaggagaaaguggacacgcggacaccgcgcccgaugccaggcacccguaaagugauggagauuacggccgaguggcucuggagaacgcuggggcggaauaagcgcccccgccuguguaccagagaggaguuuacgaagaagguccgaaccaacgcagcgaugggcgcaguguucacggaggagaaccagugggacagcgcccgggcagcgguggaggaugaagaguucuggaaccucugggacagggagcgggagcuacacaagcugggcaagugcggguccugugucuacaacaugaugggcaagcgggagaagaaguuaggggaguucggcaaagccaaggggucgcgggccaucugguacauguggcugggcgcgcgcuaccuggaguucgaggcccugggcuuccugaaugaagaucacugguucucccgggagaacagcuauagcgguguggagggggagggacugcacaagcucggcuacauccuacgcgacaucucuaagaucccugggggcgcgauguaugccgacgacacugcgggaugggacacccgaauuacagaggacgaccuucauaacgaggagaagaucacgcagcagauggacccugagcaucgccagcucgccaacgccaucuucaaacugaccuaucagaacaagguggucaaggugcagaggcccacccccaaggggacagugauggacaucauaucgcgaaaggaccagcgggggagugggcaggucggcaccuacggccugaacacguuuaccaacauggaggcacagcuaguacggcagauggagggggagggcgugcuguccaaggcugaccuugagaauccccaccuccuugagaagaagaucaccccauggcuggaaccaaagggggucgagcggcucaagcgcauggccaucagcggcgacgacugugugguaaagccaauugacgaccguuucgcuaaugcccugcuggcgcucaaugacauggggaagguccgcaaggacauaccccaguggcagccguccaagggcuggcacgacuggcagcagguccccuucugcagccaccacuuccacgagcugaucaugaaggauggucggaagcuggugguacccugccgcccacaggacgagcuaaucgggcgcgcgaggaucucccagggcgcgggguggagucugaaggaaaccgccugccuggggaaggcuuaugcgcaaauguggucccucauguauuuccaccgccgggaccugcgauuggccagcaaugccaucugcuccgccgugccggugcacuggguccccacgagccggacuaccuggagcauacacgcgcaccaccaauggaugacgacggaggacauguuaaccguguggaaccgcguguggauagaggacaaucccuggauggaagacaagaccccggucaccaccugggaggauguacccuaccuugguaagcgggaagaccaauggugcggcucccugauuggcuuaaccagccgaagcacuugggcucagaacauccugaccgccauccaacagguccggagccugaucggggaugaggaauuucucgauuacaugcccuccaugaagcgcuuccggaaggaggaggagagcgagggggcuauaugguaa

SEQ ID NO: 26220 - RNA, 9873 nt, Artificial Sequence
  derived and/or modified CDS sequence (opt11) from DENV-3__AY923865__SS-prME
accagccuuugcuuaaugaugaugcugcccgccacgcuggccuuucaccucacgagccgggauggcgagccgcggaugaucgugggaaagaacgagcggggaaagagccugcuguucaaaaccgcguccgggaucaacauguguacccugauagccauggaccugggcgagaugugcgacgacaccgugaccuacaaauguccucugaucgccgaggucgagccagaggacauugacugcuggugcaaccucaccagcaccuggguaaccuacgggaccuguaaucaagccggcgagcaccggcgagacaagcguuccguggcccuggcgccccaugugggaauggggcuggauacccgcacccagaccuggaugagcgcugagggagccuggcgccaaguggagaagguggaaaccugggcccuccgccacccgggguuuaccauccuggcguuguucuuggcccacuauauuggaaccucucugacccagaaaguggugauauucauccugcucauguuagucacgccaucaaugacaaugcggugcguggggguaggcaaucgcgauuucguggaaggccuguccggagccaccuggguggacgucguccucgagcacggcgggugugugaccacgauggccaagaacaagccuacccuggacaucgagcuucaaaaaacggaggccacccagcucgcgacgcuucggaaguuaugcaucgagggcaagaucaccaacaucaccaccggcucacguugccccacgcaaggggaggcuauccucccggaggagcaggaucagaacuacguguguaaacacaccuacguugaccggggcugggguaacggcugcgguuuauucggcaagggcaguuuaguuacgugugccaaguuucagugucucgagccgaucgaggggaaggugguccaauacgaaaaccucaaguauaccguuaucauaacgguccacaccggcgaucagccccaggucgguaacgacacccagggugugacggucgagaucacgccgcaagccuccaccguggaggcugugcugcucgaguacgggacgcugggcuuaaagugcucaccgcgcaccggcuuggauuucaacgaaaugauccuacugaccaugaagacuaaggcuuggaugguacaccggcagugguucuucgaccuaccccugccguggaccucaggggccaccaccgagacgcccacguggaaccgaaaagagcuucucgugaccuucaagaaugcccacgcgaagaagcaggagguggucguguuaggcucgcaggagggugccaugcauaccgcccuuacgggcgccaccgagauccaaaacagcggggggaccagcaucuucgcugggcaucucaagugucgucuaaagauggauaagcuggagcucaaagggaugagcuaugccaugugccucaacaccuucgugcugaaaaaggaggugagcgagacgcagcacggcaccauccugauuaagguggaauauaagggggaggaugcuccgugcaagaucccguuuagcacugaagacggccagggcaaggcgcauaacgggcgccucaucaccgcgaaucccgugguuacgaagaaggaagagccugucaacaucgaggccgagccgcccuucggcgagagcaacaucguuaucgggaucggcgauaaggcccugaagauuaacugguacaagaaggggucaucuaucgggaagauguuugaggcuacggcccggggugcacgucggauggccauccucggcgacaccgccugggacuucggcuccgucgggggcgugcucaacagccucgguaagaugguccaucagaucuucgguucggcguacaccgcgcuguucucggguguauccuggaucaugaagaucgggauagggguucuccugacguggaucggacugaacuccaaaaauaccuccaugaguuucuccugcauagugauaggcaucaucacccucuacuugggggccgucguccaagccgacaugggcugcgugaucaacuggaagggcaaggagcugaaauguggaagcgguauuuucgucaccaacgaagugcauacguggaccgagcaauacaaguuccaagccgacucccccaaacgccucgcaacagcuauugcuggagcaugggagaacgguguaugcgggauaagaagcacgacgcggauggagaaucugcucuggaagcaaauagcgaaugaguugaauuacauacugugggagaacaacaucaaguugaccgucguagugggcgacaucaucggcguccucgagcaggggaagcggaccuugacgccgcagccgauggagcuaaaguacuccuggaagacguggggcaaggcuaagaucgucaccgcagagacccaaaacagcuccuucaucaucgacgggccuaacaccccagagugccccagcgccucccgggcguggaacgugugggaggucgaagacuacggcuuuggagucuucacaaccaacauuuggcucaaguugcgagagguguacacccagagcugcgaccaccggcugaugagugcggcuauaaaagacgagcgcgcgguccacgcagacaugggguacuggauagagucccaaaagaaugggaguuggaaguuagagaaggccuccuucaucgaggugaagaccugcaccuggcccaagagccacacacugugguccaacgggguucuugagucugacaugauaauaccaaagucccuggcgggcccgaucagccagcacaaccaucggccgggguaccauacccagaccgccggccccuggcaccuagguaaacucgagcucgacuucaacuacugcgagggaaccacggucgucaucacugagaacugcggcacccgcggcccgucccuucgcacaacgacggugagcgggaagcugauccaugaguggugcugucgcuccugcacccugccaccccugcgguacaugggcgaggacggaugcugguacggcauggagauacgcccgaucaacgagaaagaggaaaacauggucaagagccuggucagcgccgggagcggcaagguggacaacuuuacuauggggguccucugccuggcuauacucuucgaggagguaaugcggggcaaguucgggaaaaagcacaugauagccggcguccucuucacguucgugcuacuguugaguggccagauaaccuggagagacauggcucacacccucaucaugauugggucgaacgccuccgaccgcaugggcaugggggugacuuauuuagcguuaaucgcgacguuuaagauccagcccuuccuggcacuuggguucuuccuccgcaagcugaccucacgggaaaaccuguuauugggcguuggucucgcaauggcuaccacccuacaguuaccggaggacauagaacagauggcaaacggaaucgcauuggggcucaugacgcugaaacugaucacccaguucgagaccuaccagcuguggacagcgcuggucagccucacaugcagcaacaccaucuucacccucaccguggccuggcguacggccacccuuauccucgccggcgucagccuccugccccugugccaauccucguccaugaggaagaccgauuggcuacccaugacuguggccgcgaugggggugccgccgcuaccuuuguucauauuuucacuaaaggacacgcccaagcgccgcucuuggccccugaacgaggguguaauggccguaggccuggucagcauccuggccucuagccugcugcggaaugacguacccauggccgggccgcugguggccggcgggcuucugaucgcgugcuacgugaucaccggcaccuccgccgaccucacagucgaaaaggccgcggacguaacgugggaagaggaggccgagcagaccggggugucacauaaccugaugaucaccguggacgaugacggcaccaugagaauaaaggaugacgagacugagaacauacuaacgguacuccugaaaaccgcgcuccucaucguguccgggaucuuccccuacagcauccccgccacccucuugguuuggcauaccuggcagaagcagacgcaacgguccggggugcucugggacgugcccaguccgcccgagacccagaaagcggaacuugaggaaggcgucuaccgcauaaagcaacagggcaucuucggcaagacgcagguaggagugggaguccagaaagaggggguuuuccacaccauguggcacgucacgcgcggggccgucuugacgcacaacggcaagcgccucgagcccaacugggccuccguuaagaaggaccugaucucauacgggggcggguggcggcuuagugcucaguggcaaaagggggaggagguucaggucaucgccguggaacccggcaagaauccgaagaacuuccagacgaugcccgggauuuuccagaccacgaccggagagaucggugccaucgccuuggacuucaagccgggcacaagcggcagcccgaucaucaaccgcgaggggaagguggucggacucuacggaaacggcguagugaccaaaaacgggggcuaugucuccgggauugcacaaacuaacgccgagccugacgggcccacgccagagcuggaggaggagauguucaagaagaggaaccugaccaucauggaccuccacccgggaagcgggaagacccgcaaguaccugcccgccaucguacgugaggccaucaagcgccggcugcgcacccucauucuggcccccaccagaguagucgcggccgagauggaggaggcccugaagggucucccuauccgcuaccagaccaccgcgacgaaaagcgagcacaccgggcgggagauuguggacuugaugugccacgccaccuuuaccaugcgccuguugagcccugugagaguacccaauuauaaccugaucaucauggacgaggcucacuucacggacccagccucuaucgcagcccgaggcuacaucucaacccgggucgguaugggggaggcggcggccaucuuuaugacagccacgccgccaggcacggccgaggcguucccccaaucuaacgcccccauccaggaugaggaacgcgacaucccagagcggucguggaacuccggcaaugaguggauaacggauuucguggggaagaccgugugguucgugccgagcaucaaagccgggaacgacaucgccaacugccuccggaagaacggcaagaagguuauccagcucucccgaaagacuuucgacacagaguaucagaagacacggcugaacgacugggacuuucugguaacuaccgauaucagcgaaaugggugccaacuuuaaggcggaccgcguuaucgacccccggcgaugccucaagcccgugauccugacggacgggccggagagagucauauuggcgggcccgaugccugugacagccgcauccgcagcgcaacgucgggggcgcgugggccgaaacccccaaaaggagaacgaucaguacauauucaccggacagccgcucaacaacgacgaggaccacgcgcacuggaccgaggccaagaugcugcuggauaacauaaacacuccggagggaaucaucccugcuuuauuugaacccgagcgcgaaaagucagccgcgaucgacggcgaguacagacugaagggggaaucccguaagacguuugucgaacugaugcgccggggagaccuccccguguggcuggcccauaaggucgccucugaggggaucaaauauacagaccgaaagugguguuuugacggcgagcgcaacaaccaaauccuggaggagaauauggauguugaaauauggacgaaggagggagagcggaagaagcuccgcccgagauggcuggaugcccggaccuacuccgauccccuggcgcucaaagaguucaaggacuucgccgccggccgcaagaguaucgccuuggauuugguuacggagaucggacguguccccagucacuuagcccaccgcacccgcaacgcccuggauaaucuugugaugcuccacaccagcgagcacgggggccgcgccuaucgccacgccguggaggaacucccugagaccauggagacgcuucuccuguuggggcucaugaucuugcuuaccggcggcgcgauguuauuuuugaucagcgggaagggaaucgggaagacguccauaggccuaauuugugucaucgugucuuccgggaugcucuggauggccgacgugcccuugcaguggaucgcgucagccauuguccuggaguucuucaugaugguucuucugauccccgagcccgagaagcagaggaccccacaggacaaccagcuugccuacgucgucaucggcauacucacucuggccgccaucguggcggccaacgagaugggccuguuggagaccacgaagcgggaucucgggauguccaaggagccggguguggucagccccacuuccuaccucgacguggaucuccaccccgccagcgccuggacguuauacgccguggccaccaccgucaucaccccuaugcuacgccacaccaucgagaacuccacugcaaacgugagcuuggcggccaucgcaaaccaggcggucgugcugauggggcuggacaagggcuggcccaucucuaagauggaucuggggguuccccugcuagcccucggcugcuacagccaggugaauccacuaacccugaccgcggccgucuuacugcucguaacgcacuacgcgaucaucggcccggggcuucaagcaaaggcgacccgggaggcccagaagcgcaccgccgcgggaaucaugaagaaccccaccguggacgggaucaugacgauagaucuggaccccguuaucuacgacuccaaguucgagaagcagcuggggcagguaaugcucuuggucuuaugcgcaguccagcuccugcugaugcggaccagcugggcccucugcgaggcacugacccuggcuacaggcccuaucacgacccucugggagggguccccgggcaaauuuuggaauaccaccaucgccgugagcauggccaauaucuuccguggguccuaucuggcaggaacgggguuggcguucucgauaaugaaguccgugggcaccggccgucgcggaaccggcagccagggggaaaccuuaggcgagaaguggaagaagaagcugaaccaguuaagccgcaaagaguucgaccucuacaagaaguccgggaucacugaaguagaucgcaccgaggcaaaagaaggacugaaacguggcgaaaccacccaccacgccgugagccgcgguucugcaaagcugcagugguucguagagcggaacaugguuauccccgagggacgggucaucgaccucgggugcggacgcgggggcuggagcuacuauugcgcuggccuaaagaaaguuaccgaggugagaggguacacgaagggcggaccuggccacgaagaacccgugccuauguccacuuacggguggaacaucguuaagcuaaugagcggcaaggacgucuucuaucugccgcccgagaagugcgacacacuacugugugacaucggugaauccucucccucuccgaccguggaggagagccgcacgauacggguccuaaagauggucgagcccuggcucaagaacaaucaguuuugcaucaagguccuaaaccccuacaugcccacagugaucgagcaucuggaacgccuccagcgcaaguacgggggcauguuggucaggaauccuuugagucgcaauagcacccacgagauguacuggauuuccaacgggacggguaacaucgugucguccgugaacaugguaucaagacuacugcugaacagauucacgaugacccaucgucggccgaccauagagaaggaugucgaccucggcgcaggcacccgccacgucaacgcagagcccgaaacgccgaacauggacgugauuggcgagcggaucaagcgcaucaaggaggagcacuccucaaccuggcacuacgacgaugagaaccccuacaaaaccugggcuuaucacggcaguuacgaggugaaagccacgggcagcgccucuuccaugaucaacggcgucgugaaacugcugacaaagcccugggacguggucccuauggugacccagauggccaugacggauaccacgcccuuuggccagcagcggguauucaaagaaaaggucgacacacgcacgccccggccgaugcccgggacgcgcaaggugauggagaucacggcggaguggcucuggaggacccugggccgcaacaaaaagccgcgccugugcacccgggaagaguuuacuaaaaaggugcgcacgaaugcugcaaugggcgcggucuucacggaggaaaaccagugggauagcgcucgggcggcaguugaggacgaggaguucuggaaacucguggaucgcgagcgggagcugcacaagcuagggaaaugcgggagcugcguguacaacaugauggggaagcgcgagaaaaagcuaggggaguucggaaaagccaaggggagccgggccauuugguacauguggcugggcgcgcgguacuuagaauucgaggcccuuggcuuucuaaacgaggaccacugguucucccgggagaacagcuacuccgguguggagggagagggucugcauaaacucggcuauaucuugcgcgacaucagcaaaaucccagggggggccauguacgccgaugacaccgcagggugggauacccggauuacagaggacgaucuccacaacgaagagaagaucacccagcagauggacccugagcaccgucagcucgcgaacgcaaucuucaagcuuaccuaccaaaacaagguugucaaggugcagcggccuaccccuaagggcacgguaauggacaucaucucccguaaggaccagcggggcagcggccaagucgggacuuacgggcugaacaccuucaccaacauggaggcccaacucgugcgccaaauggagggcgaaggcguucugucuaaggcggaccuagagaacccucaccuauuggagaagaagaucacccaguggcuagagacgaagggcgucgagcggcucaaacgcauggccaucagcggggacgacugcgucguuaagcccaucgacgaucgguucgcgaacgcucuacuggcacucaacgacauggggaaggucagaaaggauauuccacaguggcagccguccaagggguggcacgacuggcagcagguacccuucugcagccaucauuuccaugaguuaaucaugaaggacggcaggaagcuuguggucccuugccgcccccaggacgagcugaucggcagagcucggaucagucagggggccggcuggagccugaaggagacggccugccuggguaaggcuuacgcgcaaauguggucgcucauguacuuccaucgcagagaccugcgccuggccagcaacgccaucugcuccgcugucccgguccauugggucccuaccagccggaccacguggucuauccacgcgcaccaucaguggaugaccacagaggacaugcucaccguauggaauagaguguggaucgaggacaaccccuggauggaagauaaaacaccagucacuaccugggaggacgugccguaccugggaaagcgggaggaccaguggugcggcucccugauuggguugaccagccgcgccacuugggcacagaacauccugacagcgauucaacagguccgcucccugaucggugaugaggaauucuuggacuacaugcccucgaugaagcgcuucaggaaggaggaagaguccgaaggggccaucugguga

SEQ ID NO: 26221 - RNA, 9867 nt, Artificial Sequence
  derived and/or modified CDS sequence (opt11) from DENV-4__KR922405__SS-prME
ucuaccauaacccugcucugccuaauccccacuguuauggccuuccaucuguccacuagggacggcgaaccgcuuaugaucgucgcaaagcacgaacgcgggcgaccccugcuguucaagaccacggaagggaucaacaaguguacccuuaucgcgauggaccuaggggagaugugcgaggacaccguuacguacaagugcccccugcucgucaacaccgagccagaggauauagacugcugguguaaccugaccagcgccugggucauguacggcacgugcacccaauccggugagcggcgccgggaaaagcgaucaguggcccugaccccgcauuccggcaugggucucgaaaccagggcugaaacuuggaugagcucagaaggcgccuggaagcacgcccaacgcguggagagcuggauucugcggaaccccggguucgcacuguuagccggguuuauggcauauaugaucggucagaccgggauccagcgcaccguuuucuucauccugaugaugcucguggcaccguccuacggcaugaggugcguuggcguagguaaccgcgacuucguugagggggugagcgggggcgccugggucgaucucguucuggaacauggcgggugcgugaccaccauggcccaggggaagccaacccuggauuucgagcucaucaagaccacggccaaggaggucgcucuauuacggacguauugcaucgaggccucaaucagcaacaucaccacagccacacgaugcccuacccagggugagcccuacuugaaggaggaacaggaccaacaguacaucugccgucgagacaugguggaccgaggcugggguaacggcuguggccuguucgggaaaggcggggucguaaccugcgccaaauucuccugcuuagggaagaucacagguaaccucgugcagaucgagaaccuggaguacacgguagucgugacgguucauaacggcgauacccacgccgucggcaacgacacaagcaaccacgggguaacugccaccauuacaccgcggucuccuuccguugaagugaaauuaccagacuacggggagcuuacccuggacugcgagccacgguccgggauugacuucaacgaaaugauuuuaaugaagaugaagacgaaaacuuggcuagugcacaagcagugguuccuggauuugccccucccuuggacaaccggcgcggacacgcucgagguacacuggaaccacaaggagcgaauggucacguucaaggucccgcacgccaagcggcaggacgucaccgucuuggggagccaggagggugccaugcacagugcuuuggccggugcgaccgagguugacucuggcgacggcaaccacauguucgccggucacuuaaagugcaaggucagaauggaaaaacugaggauuaagggcaugagcuacaccauguguuccgggaaguucagcaucgacaaggagauggccgagacgcagcacgguaccaccguggugaaggucaaguacgaaggaaccggggcccccugcaagguaccaauagagauacgagacgugaauaaggagaaggucguggggagaauaaucuccucuacgccauucgccgagaacaccaacuccgugacaaacaucgagcucgagccgcccuucggggacagcuauaucguaaucggcgugggggauuccgcacugacccugcacugguuccggaagggaaguagcaucggcaaaauguucgaaagcacguaccgcggggcuaagcggauggccaucuugggagagaccgccugggauuuuggauccguugggggauugcugaccagcuuagggaaggcgguccaccaggucuucggcuccguguacacuacgauguuuggcggcgucaguuggauggugcgcauccugaucgggcugcuugugcuguggauaggcaccaacucccggaauaccagcauggccaugucgugcaucgccgucggagggauuacccuguuucuagguuucacggugcacgccgacauggggugcguggucuccuggaguggaaaggagcucaaaugcgggagcggcauauucgugaucgacaacgugcauaccuggaccgagcaguacaaauuucagccggagucgcccgcccggcuugccuccgcaauccugaacgcucacaaggaaggugucugcgggauacggagcaccacgcgccucgaaaacgucauguggaaacagaucaccaacgagcugaacuacgucuuaugggaaggaggucacgaucucaccgucguggccggcgacgugaagggcguacuguccaaggggaagcgggcccuggcaccgcccguuaacgaccuuaaauacagcuggaagacguggggcaaggccaagaucuucaccccugaaaccaggaacuccaccuuccugguggacgggcccgauaccagcgaaugcccgaacgagcgacgggccuggaacuuccuggaggucgaggacuacggauucgguauguuuacaacgaacaucuggaugaaguuccgggagggcuccagcgaggugugugaucaccgccucaugucugcggcgaucaaggaccagaaggcgguacacgccgacaugggcuauuggauugagagcuccaagaaccagacauggcagaucgagaaagcgagcuugauagaaguaaagaccugccucuggccgaagacacacacgcucuggucgaacgggguucuugagagccagaugcugauccccaaggcuuaugcaggcccgauuucccaacacaacuaccggcagggcuacgccacccagacagcaggaccauggcaucucgggaaguuagagaucgacuucggggagugccccgguaccacgguaacaauucaggaggauugcgaccaccgcgggcccagcuuacgaaccaccacggccuccggcaagcucgucacgcaauggugcugccggucauguaccaugccgcccuuacgcuuccuuggggaggacggcugcugguacgggauggagaucagaccccucaaugagaaggaggagaacauggucaaaagccagguaagcgcgggccagggcacgagcgagacauuuucuauggggcugcugugccucacccuauuugucgaagagugccugcgccgucgcgugacccggaagcauaugauucucgucguggugaccacgcugugcgcgaucaucuuaggagggcucaccuggauggaucuucuaagggcccucauaaugcugggcgacacaaugagcgggagaaugggaggccagauccaccuggcuaucauggcugucuucaagaugucccccggguaugugcuaggcaucuuccugcgcaagcuaaccagccgggaaacggcccuuaugguuauuggcauggcgaugacuaccgugcuguccaucccucacgacuuaauggaauuuaucgacggcauuagccucggcuuaauccugcucaagauggucacgcacuucgacaauacgcagguagggacacuggcccuggcccucacguucaucaagaguaccaugccucuggucauggccuggcgcacgauaauggccguguuguucgugguaacccucauaccgcugugccggacguccugccuacagaagcagucacacuggguggaaaucacugcucucauucuuggggcccaggcccuucccguguaccucaugacacucaugaagggggccagcaagcgcuccuggccgcugaacgaaggcauuauggcugugggauugguuagcuugcugggcuccgcccugcucaagaaugacguaccccuggcuggccccauggucgccggggguuuacugcuggccgcuuacgugaugagcggcuccucggccgaucuuagccuggagaaagccgccaacguccagugggaugagauggccgacauaacgggcagcagcccaaucaucgaggucaaacaggacgaggacggguccuucagcauccgggauguggaggagaccaauaugaucacuuuacucgugaaacuugcccuuaucacgguuuccgggcuauacccgcucgccauccccgucaccaugacucuuugguacauguggcaagugaagacccagcgcagcggugcccucugggacgugccgagucccgccgccgcccaaaaagccacgcugaccgaaggggucuauaggaucaugcagcgaggccuguuugguaagacacaagugggagucgguauccacacggaaggcguguuccacaccauguggcacgugacgcggggcucagucaucugccacgaguccgggagguuagagccuagcugggcggacgugcgcaacgacaugaucuccuacggcggaggcuggcgccugggagauaaaugggacaaggaggaggacgugcagguccuggcaauugaaccggggaagaaucccaaacacguacagaccaagcccggccuuuucaaaacccuaacaggcgaaauaggggcuguuacgcuugauuucaaaccggggacaagcggcucccccauuauaaaccggaagggaaaggugaucgggcucuacggcaaugggguagugacaaagucuggcgacuacgucuccgcgaucacucaagcggaacgcaucggugagcccgacuacgagguggacgaggacaucuuucgcaaaaagcgucugaccauaauggacuuacacccuggugccggaaagaccaagcgcauccugcccaguaucgugcgggaggccuugaagcgcagacuaagaacacugauucucgcccccacccgggucguagccgcugagauggaggaggcgcugcggggacuaccaauacgauaccagacgccugcggugaaauccgaacacacuggcagggagaucguagaccucaugugucaugccacuuuuacuacuaggcuguugagcuccacccgugugccuaacuacaaccucauugugauggaugaagcucacuucaccgaccccagcuccguggccgccagaggguacaucagcacccgaguggagaugggcgaggccgcggcuaucuucaugacggccacacccccagggacuacugaccccuuuccccagagcaacucccccaucgaggacauagagcgggagauaccggagagaagcuggaacaccggcuuugacuggaucaccgacuaccaaggaaagacgguuugguucgugcccuccauuaaagcagggaacgacauugccaauugcuugagaaagagcggcaagaaggugauccagcugagucgcaagaccuuugauacagaguacccgaagacaaaacuuaccgacugggacuucgucgugaccacggacauaucagagaugggugcgaacuuccgggccggccgagugaucgacccaaggcggugccucaaaccggucauucuaaccgacgggccugaacgggugauccucgccggccccauuccagucacaccggccuccgcugcccagcggcgcggccgcaucgggcgcaacccagcucaggaggaugaccaguacguguucaguggagauccauugcggaacgacgaagaccacgcgcacuggaccgaggccaagauguuacucgacaacaucuacacacccgaagggaucaucccgacucuuuucggcccggagcgcgagaagacucaggcgaucgacggcgaguuccggcugcggggugagcagcgcaaaaccuucguggagcuaaugcgccggggugaccugcccguguggcuguccuacaaggucgccagcgccggcaucagcuacaaggaccgcgaguggugcuuuacuggagagcggaacaaccagauccuggaggagaacauggaaguggagaucuggacccgcgagggagagaagaaaaagcuaaggccgaaguggcuggaugccagaguguaugccgacccgauggcgcucaaagacuuuaaggaguuugccagcggucggaaguccaucaccuuggacauacugacggaaaucgccucucucccgauguaccuauccagccgcgccaagcuggcguuagacaauaucgucaugcugcacacgacggagcguggagggaaggcauaucagcacgcccugaacgagcuccccgaaucccuggagacucucaugcucgucgccuuguuaggcgccaugaccgcugguauuuuucucuucuucaugcaaggaaaagggaucgguaagcugagcaugggccugauagcuaucgcuguugccuccgggcuccugugggucgccgagauacagccucaguggaucgcagcuagcaucauccuggaguuuuuccucauggugcugcugguccccgaacccgaaaaacagagaacaccccaggauaaccaacucaucuacguaauccugacgauacugacuauaaucgcccucguagccgccaacgagaugggccuuaucgaaaagacgaagacagacuucgguuucuaccaggugaaggcggaaacuacuauccuggacgucgaccuucgcccggcgagcgccuggacccuguacgccguggcaacgacgauccugacaccgaugcuccggcacaccauagagaacacguccgcgaaccugagccuagcugcuaucgccaaccaggccgcgguccuuaugggacuggggaagggcuggccgcugcaccgcauggaucucgggguaccccugcuagccaugggcuguuacagucaggugaacccgacgacgcucaccgccucucuagugauguuacucguccacuacgcaaucaucggacccggguuacaagcgaaggcuacacgggaggcacaaaaacgcaccgccgccgggauaaugaagaaccccacgguggacggcauaaccgugauugaccuggagcccaucuccuaugaucccaaguucgagaagcagcucggucaggucaugcugcuggugcucugcgccggccaacugcuacucaugaggaccacgugggccuucugugagguccugacccuggccacggggcccauccucacccuaugggagggcaacccugggcgcuucuggaacacgacgaucgcggucucgaccgcuaacauuuuucgaggcuccuaccuggcgggcgccggucucgccuucagucugaucaaaaacgcacagacgcccaggcgggguacggggaccacuggcgaaacccugggagagaaguggaagcgccagcucaacucccuugauagaaaggaguucgaggaauacaagcgcuccggcauccuggagguggaccggacggaggccaaguccgcgcucaaggaugguuccaagaucaaguuugccguaagucgcggcacuagcaagauccgguggaucgucgagcgcgggaugguaaagccgaaggggaagguugucgaccuggguugcggcagaggcggcuggucguacuauauggcuacucugaagaacgugaccgaggugaagggguacaccaaaggcggacccggccacgaggagccgguccccauggccacguacggguggaaccucguaaaguugcacaguggcguagacgucuucuacaagcccaccgagcagguugacacccugcucugugacauuggcgaguccucauccaaccccaccaucgaagaggggagaacgcucagagugcugaaaauggucgagcccuggcuuagcagcaagccggaguucuguaucaaggugcucaacccguacaugcccaccgucaucgaggaauuggaaaaacuacagcgacgccacgguggguccuugguccggugcccccucucccgcaacaguacccacgagauguacugggucagcggagucucggggaacaucgugagcuccgugaauaccacguccaagauguuauuaaacagauucacgacucgccaccguaagccaacauacgagaaggacgcggaucugggggcgggcacgcgcuccgucagcacugagacagagaaaccggacaugaccaucauugggaggcgauugcagagacuccaggaggagcacaaggagacguggcacuaugaucacgagaaccccuauagaacuugggcauaucacggauccuacgaagcccccagcacagguuccgccagcaguauggugaacggcguggugaaacugcugacuaaaccgugggacguggucccgauggucacacagcucgcaaugaccgacaccacgccuuucgggcagcaacgcguauuuaaggagaagguggauacgcgcacgccccagcccaagcccgggacuagggucauuaugaccacgacggccaacuggcuuuggacgcugcucggccguaagaaaaacccgaggcuauguacccgagaggaguucauaaguaaagugcgguccaacgccgccaucggcgccguuuuucaggaggagcagggcuggaccagugcguccgaagcagucaacgacagccguuucugggaguugguugacaaggagcgcgcccuccaccaggagggaaaaugcgagaguuguguuuacaacaugaugggcaagcgcgagaaaaagcugggcgaguucggacgugcgaaggguuccagagccaucugguacauguggcugggcgcgcgguuccucgaguucgaggcccugggguuucugaacgaggaccauugguucggccgggagaacagcuggucuggagucgagggcgagggacuccaccgcuugggcuauauccuggaggacaucgacaagaaagauggggaccucauuuacgccgacgauacagcaggcugggauaccagaaucacugaagacgaucugcugaaugaggagcucauaacggaacaaauggcgccacaccacaagauccuagccaaggccaucuucaaacugaccuaccagaacaaggucgugaagguccucagaccaaccccgaagggcgccgugauggacaucaucagucggaaggaccaacgcggaucaggccagguggggacuuacggucugaauaccuucacgaacauggagguacagcugaucagacagauggaagcugaaggcgugauaacccaggacgacaugcacaaucccaagggccucaaggagcgcgucgagaaguggcucaaagagugcggagucgaccggcugaaacgcauggccauaagcggcgacgacugcgugguaaagcccuuagaugagcgguucuccaccucucugcuuuuccucaacgacauggggaaagugcggaaggacaucccccaaugggagcccucaaaagguuggaagaacuggcaggaggugcccuucugcucacaccauuuccauaaaauauucaugaaggacggccggucccugguggugccuugcagaaaccaggacgagcuuaucgggcgggcaaggaucagccagggcgccgguugguccuugcgggagaccgcgugccuuggaaaggccuacgcgcagauguggucguugauguauuuccaccggcgagaucuccgucucgcuagcauggcuaucugcagcgccgucccgacggagugguucccgacgucccgcacaaccuggagcauucaugcacaucaccaguggaugacgaccgaggacaugcugaagguguggaaucgggucuggaucgaggacaacccaaacaugauagacaaaaccccggugcauuccugggaggacaucccguaucugggcaaacgcgaggaucuguggugcggcucccugaucggccucagcucccgggccacgugggcgaaaaauauccauacugccaucacccagguucggaaucuaaucgggaaggaggaguaugucgacuacaugcccgccaugcguagauacagcgcccacuucgaaagugagggcgugcuguga

SEQ ID NO: 26222 - RNA, 9867 nt, Artificial Sequence
  derived and/or modified CDS sequence (opt11) from DENV-4__KP188557__SS-prME
uccaccaucacgcugcugugccugaucccaacggugauggcuuuccaucugaguacgcgcgacggugaaccgcucaugauagucgccaagcaugagcgcggucgccccuuacuguucaagaccaccgaaggaauuaauaagugcacucucauugccauggaucugggggagaugugcgaggauaccgugaccuauaaguguccccugcucgugaauacggagccggaggacauugacugcuggugcaaucugacuuccaccugggucauguacggaaccuguacgcaguccggggagaggcggcgggagaaaaggagugucgcccucacgccgcacucaggcaugggccucgagacccgggcggagaccuggaugagcagcgaaggggcauggaagcacgcccagagaguggagucuuggauuuuaagaaacccaggcuucgcgcuacucgcuggguuuauggccuacaugauuggccagaccggcauucagagaacugucuuuuucgugcuaaugaugcugguagcgcccagcuacggcaugcggugugugggcguugggaaccgcgacuucguagagggcgucagugggggcgcauggguggaucugguacuggagcacggcgggugcgucacuacgauggcgcagggcaagccgacccuggacuuugaacucacuaaaaccaccgcgaaggagguagcccugcugcggacuuauuguaucgaagcccucauauccaacauuacgaccgcgacccguugcccgacccaaggggagcccuaccugaaggaggaacaggaccagcaguacauaugccggcgagaugugguagaccgcggcugggggaaugggugcggcuuauucgggaagggagggguggugacgugcgcgaaguucagcuguuccggcaaaaucacggggaaccucguccagauagagaaccuggaauacaccguggucgucaccgugcacaauggcgacacgcacgcggucgguaacgacacaaguaaucacggugucaccgccaccauuacuccccguucccccagcgucgaggucaaacuuccagauuacggagagcucacccuggacugcgagccacgguccggaaucgacuucaacgagaugauccuaaugaaaaugaagaagaagaccuggcucgugcacaagcagugguucuuggaucucccccuccccuggacgacaggcgccgacacguccgaggugcacuggaacuacaaggagcgcaugguuaccuucaagguaccgcacgccaagcggcaggacgugaccguccugggcucccaggagggcgccaugcacagcgcccuugccggggcaaccgaaguugacucaggggacggcaaccacauguucgcuggucaucucaagugcaaggugcgcauggagaagcugcgcaucaaaggcaugucguacacgauguguagcggcaaguuuuccaucgacaaggaaauggccgaaacacagcacgggacgaccguagugaaagugaaguacgagggggcgggggccccaugcaagguccccauugagauccgcgaugugaacaaagaaaagguggugggccgcgugauaagcgcuacgccccuggcagagaacacaaacucaguaacgaacaucgagcucgagccgccguucggggacagcuacaucgucaucggcguggguaacucggcucuuacccuucacugguucagaaaagggucauccaucggcaagauguuugaaagcacguaccgcggggcuaagcggauggccauccucggcgagaccgcgugggacuucggguccgugggcgggcuguucacaagccucgggaaggccgugcaccagguauucgguagcguguacaccacuauguucgggggcgucagcuggaugauccgcauuuugauaggcuuucuuguccuguggaucggcacaaacucccguaacaccucuauggccaugaccuguaucgcuguuggcgguaucacacucuuccucggcuuuacagugcaagcggacauggggugugugguuucauggagcggucgggagcugaagugcggcaguggcaucuuuguaguagacaacgugcacacguggacggagcaauacaaguuccagcccgaaagccccgcucgguuagcuagugcuauacucaacgcucacaaggacggcguaugugggauucgcaguacaacccggcuggagaacgugauguggaagcaaauuacuaaugagcuuaacuacgugcucugggagggcgggcacgaucugaccguugucgcgggcgauguaaagggcguccuuacgaaggguaagcgcgcgcucacgccgccagcgagcgaccugaaauacuccuggaagaccuggggcaaggcaagaauuuucaccccggaggcuaggaacaacacuuuucugaucgacggucccgacaccagcgagugcccaaacgagcggcgcgccuggaacuccuucgagguggaggacuacgguuucgggauguucaccacuaacauauggaugaaguuucgggagggcagcucugagguuugcgaccaccgccugaugagcgcggcaaucaaggaccagaaggccguccacgccgauaugggguacuggaucgaguccagcaagaaccagacguggcagauagagagggcgucccugauagaagugaagaccugcuuguggcccaagacucacacccucuggagcaacggcguccuggagucccagaugcugauccccaaaagcuacgcgggcccguucagucaacacaacuaucgccaaggguacgccacucagacggucggccccuggcaucuggggaagcuggagaucgacuucggggagugccccgggacaaccgugaccauccaggagaauugcgaccaccgcgggcccagccugcguacuaccaccgccuccggcaaacuuguuacccagugguguugucgcuccuguacaaugccgccccugcgcuuccugggggaggacggcugcugguacgggauggagauucgcccacucagcgagaaggaagaaaacauggucaagucccaggucacugcgggucagggcaccuccgagaccuuuuccauggggcugcugugccugacgcuguucgucgaggagugccuacggaggcgggugacccgcaagcacaugauccucgcggucgucaucacccugugcgccaucauccuuggcggguugacguggauggaucugcugcgggcccucaucaugcugggggacacgaugagcgggcgcaucgggggccagacccaucuggccaucauggccguguucaagaugagucccggguauguucuggguguguucuuacgcaagcugaccucacgcgaaacugcccuaauggugaucgggauggccaugacuaccaccuugaguauuccacacgaccugauggagcucaucgacggcaucagccugggcuugauccuccugaaaaucgugacccaguucgacaauacgcaagucggaacucuggcccucucccugaccuucauacggucaacuaugucacuggugauggcauggcguaccauuauggcgguacucuucguugugacccugaucccccugugcagaaccucgugccuccagaagcagucccacuggguugaaaucacggcgcugauacuuggcgcccaggcccucccggucuacuugaugacuuuaaugaagggggccagccgccgguccuggccgcucaacgaaggaaucauggcgguugggcugguuucgcugcucggcucagcccugcugaagaacgacgucccgcucgccggccccaugguggccgggggauuacuacucgcugcguacgugaugagcggcuccagcgccgaccugagcuuagagaaggcagcaaacguccgaugggacgagauggccgacauuacgggguccagucccauuaucgaggugaagcaggacgaggaugggaguuucucgauccgggacguagaggagaccaacaugaucacccucuuggucaagcuggcguugaucacgguguccggcuuguacccccuggccaucccgaucacuaugacacucugguauauguggcaagugaagacccagcggucaggcgcccugugggacgucccaagccccgccgcgacccagaaggcggcccugagcgaagguguguaccggaucaugcagcgcggguuauuugggaaaacacaagugggcgucgggauccacauggagggcguguuccacaccauguggcacgugacccgcggcucagucaucugucacgagaccgggagacuggagcccagcugggccgacguucgcaacgacaugaucuccuacggcgguggguggcggcugggagauaagugggacaaggaggaagacgugcaaguacucgccaucgaacccgggaagaaccccaaacacguacagaccaagcccggucuguucaagacccuuacgggggagaucggugccgucacgcucgauuuuaagcccgguaccucaggcuccccgauaaucaaccgcaaaggcaaggucaucgggcucuacgggaaugggguggugaccaaaagcggcgacuacgucuccgcgauaacgcaggccgagcggauaggggagccagauuacgagguggaugaagacaucuuucgcaagaagagacugacuaucauggaucugcaccccggcgcagguaaaacgaagcgcauccugccgagcaucgugcgagaagcccugaagcgacggcugcgcacccucauccuggccccgaccagagucguggccgccgagauggaggaagcccuccgcgggcuccccauccgauaccagacgcccgccgugaaguccgagcacacuggccgcgagauugucgaccugaugugccaugcaacuuucaccacccggcuguuaagcagcacgagggucccgaauuacaaccugaucgugauggacgaggcccacuucacagacccuagcaguguggccgcccggggguacaucuccacccgcguggagaugggcgaggccgcagccauuuuuaugaccgcuacaccgcccggcgccacugacccguuuccgcagaguaacuccccgaucgaggacaucgagcgcgagaucccggagcggagcuggaacaccggcuucgacuggaucacggacuaccagggcaagacggucugguucgucccguccaucaaagccgggaaugacaucgcgaacugccugcgcaaguccgguaagaaagugauucaacucucccggaagacauucgacacggaguaccccaaaacaaagcugacggacugggauuucgucgucacgaccgacaucucugaaaugggagccaacuuccgcgcgggucgggugauagacccucgccggugccugaagcccgucauccucaccgacgccccggagcgcgugauucuagcggggccuauccccguaacacccgccuccgcggcccagcggcggggacggaucggccgcaaccccgcacaggaggacgaccaguacguguucagcggggacccccugaaaaacgacgaggaccaugcucacuggaccgaggcgaagaugcugcuggacaacaucuauacaccagaggguauuauccccacucuguucggcccggaacgggagaagacacaggccaucgacggcgaguuccgcuugcgaggggagcagcgcaagacauucguggagcucaugaggcguggggaccugcccguguggcucuccuacaaagucgccucagccgggaucuccuauaaggaucgggaguggugcuucaccggugagagaaauaaccagauccuggaagagaauauggagguugagaucuggacgcgggagggggagaagaagaaguuaaggcccaagugguuggacgcucggguguacgccgaccccauggccuuaaaagacuucaaggaguuugccucgggcagaaagucuaucaccuuagauauacucacggagaucgccagccugccgaccuaccugagcaguagagcgaaauuagcccuugacaacaucgugaugcugcauaccacggagcggggcggcagggccuaccagcaugcacucaacgaacugcccgagucccucgagacgcucaugcuuguggcacugcucggggccaugaccgccggaauauuccuguucuucaugcagggaaaggggaucgggaaacuuaguaugggccucaucaccaucgcaguggcaagcggccugcuguggguagcggaaauucaaccccaguggaucgccgccuccaucauccucgaguucuuccugauggugcuccucauccccgagcccgaaaagcagcggacaccccaggacaaccagcugaucuaugugauccugacgauccucacaauaauuggauugaucgccgccaacgagauggggcugauugagaagaccaagaccgacuuuggguucuaucaggucaagaccgagacuaccauccucgacgucgaccuaagacccgcuuccgcguggacgcucuaugcaguggccacaaccaucuuaaccccgaugcugcggcacacuaucgaaaacacgagcgccaaccucucacucgcggccauagcaaaccaggcggccguccugaugggcuugggcaagggauggccccuucaccgcauggaccuuggcgucccccugcucgcgauggggugcuacucccaggucaauccuacuacccucacagccucgcuggucaugcuccugguacacuacgcgaucauuggcccgggucugcaggccaaagcgacgcgggaggcccagaagcgcacugcugcggguaucaugaagaacccaaccguugacggcauaaccguaaucgauuuagagcccaucuccuacgaccccaaguucgaaaagcagcuggggcagguuaugcuucucgugcugugcgccgggcagcuacuguuaaugagaacgaccugggcguucugcgaggucuuaacccucgcgaccgggccgauccuuacguugugggagggcaaccccgggcgcuucuggaacacgaccaucgccgugagcaccgccaauauauuccgggguuccuaucucgccggagcgggccuggccuucucgcugaucaaaaacgcccaaacgccucgacggggcaccggaaccgccggcgaaacgcucggggagaaguggaagcgccagcugaacucccuagaccggaaggaguucgaggaguauaaacgcagcggcauccucgagguggaccggacagaagccaaguccgcauugaaggacggcucgaagaucaagcacgccgucucccgcggcagcuccaaaauuagguggaucguggagcggggcaugguaaagcccaagggcaaggucguugaccugggaugcggacgcggcgguugguccuauuacauggccacguugaaaaacguaaccgagguuaagggguacacgaagggcgggcccgggcacgaagaacccaucccgauggccaccuauggauggaaccuagugaagcugcacagugguguagaugucuucuacaagcccacggagcaaguggacacccuccugugcgauauaggagagagcagcuccaacccuacuaucgaggaagggcggacccuccgaguucucaagauggucgagcccuggcucagcuccaagcccgaguuuuguauaaagguccuuaacccauacaugccgacggugaucgaggaguuagaaaaacuucaacggaaacacggugggaaccuaguccgcuguccccugagccggaacaguacccacgagauguacugggugagcggcgcgucgggcaacaucguuagcuccgugaacaccacuagcaagaugcucuuaaacagauucacgacucggcaucgcaagccgacauacgaaaaagacguggaccugggcgccgguacucgguccgucucgacggagaccgagaaacccgacaugacaauaaucgggcgccggcuccagcgccuccaggaggagcacaaagaaaccuggcacuaugaccaggagaacccguaccgaacgugggccuaccacggcucuuacgaggcccccaguaccgggucugcuagcuccauggugaacggcguggucaagcugcucaccaagccaugggaugugaucccgauggugacacaacuagcgaugacggacaccaccccauucggccagcaacgcgucuucaaggagaaaguggauacccggacaccacagccaaagccgggaacccgaauggugaugaccaccacggcuaacuggcugugggcgcuacuaggcaaaaagaagaacccccgguuaugcacccgcgaagaguucaucagcaaaguccgguccaaugcugccaucggagcgguuuuccaggaggagcagggcuggacuagcgccagcgaggccgucaaugacagccgcuuuugggagcucguugacaaggagcgcgcccugcaccaggagggaaagugcgagagcugcguguacaacaugaugggcaagcgggagaaaaagcugggcgaguucgggcgcgccaagggcucccgggcgaucugguacauguggcucggggcucgguuccuggaauuugaggcucuggguuuccucaacgaggaccacugguuuggacgggagaacagcuggucgggcguggagggcgaagggcuacaccgucugggcuacauacucgaggagaucgacaaaaaggacggugacuugauguacgccgacgauacagcgggaugggacacccggaucacugaagacgaccugcagaacgaggagcucaucacggaacagauggcuccccaccauaagauccuggccaaagccaucuucaagcuaacuuaccagaauaaggucgugaagguacuccgccccaccccgcgcggcgccgucauggacaucaucagccgcaaagaccaacggggguccggccaggugggcacguacggccuaaacaccuucacuaacauggaagugcaguuaauccgccagauggaggcggaaggggugaucacccaggaugacaugcagaaucccaagggucucaaggaacggguggagaaauggcugcgcgagugcggaguggaucgcuuaaagcgcauggccauuucaggggacgacugcgucgugaagccgcucgacgagcgguuuggcacgucccuccuuuuccucaacgacauggggaaggugcgcaaggacauuccgcagugggaaccgagcaagggcuggaagaacuggcaagaagucccauucuguucccaccacuuucacaagaucuucaugaaggacgggcggagccuggugguaccuugccgaaaccaggacgaacugaucggccgcgcccggaucucccagggcgcgggguggagcuugcgcgagaccgccugccugggcaaggcguacgcccagauguggucccugauguauuuccaccggagagaccuucgucuagccagcauggcgaucugcuccgcagucccuaccgagugguuuccgaccagccgcaccaccuggucaauccacgcgcaccaccaguggaugaccaccgaggauaugcugaagguguggaaccggguguggaucgaggauaacccuaacaugaucgacaagacgcccguucacaguugggaagacaucccguaucucggcaagcgcgaggaucuguggugcggcagcuugauagggcucagcucucgggcaacaugggccaagaacauccauaccgccaucacccaggugcggaaucugaucggcaaggaagaauauguggauuacaugccggucaugaaacgguacuccgcaccgagcgaauccgagggcgugcuauaa

SEQ ID NO: 26223 - RNA, 9867 nt, Artificial Sequence
  derived and/or modified CDS sequence (opt11) from DENV-4__KP188558__SS-prME
ucaacaaucacacuacuaugucuaauaccaaccgucauggcuuuucaccuauccacaagggacggcgaacccuugaugauaguagcaaaacaugaacguggccgcccgcucuuauucaaaacuacggaaggcaucaacaaaugcacccucauagcgauggaccuaggcgaaaugugcgaagacacggugaccuauaagugcccccuccuagucaacacagaaccagaagacauagacugcuggugcaaccugacgucgacaugggugauguacgguacuugcacacagucuggggaacggcgccgggagaaaaggaguguagcacuaacaccacacucgggaaugggacucgaaacucgggccgaaacuuggaugagcagcgaaggggcauggaagcacgcucaaagaguagaauccuggauccucaggaacccgggguuugcucuguuagcgggguuuauggcauacaugauaggacagacgggaauccaaaggacggucuucuuuguacuaaugaugcucguggcgccaagcuacggaaugcgcugugugggggugggcaaccgcgauuucguugaggggguguccggcggagccuggguagaccuaguguuggaacacgggggaugcgucacgacgauggcacaaggaaaaccaacacucgacuucgaacucacaaaaacaacggcuaaagaggucgcgcuguugcggacguacugcauagaagcacuaauaucuaacaucacgacagcaacacgcugcccuacucaaggcgaacccuaccugaaggaagaacaggaucaacaguacauuugccgcagggacgugguggaucggggcuggggaaacggaugcggccucuucggaaagggaggcgucguaaccugcgcaaaauucaguuguuccggaaagauaacagggaaccugguucaaaucgaaaaccucgaauacacaguugucgucaccgugcaugacggagacacccacgcggucggcaacgacaccuccaaucacggaguaacagcaacaauaaccccgcggucccccagcguagaggugaaacuaccggauuacggcgaacucacacuggauugugaaccacgcucggggauagacuuuaacgaaaugauacuaaugaaaaugaaaaagaagaccuggcucguccauaaacaaugguuccuggaccuaccauuacccuggacaaccggggccgauaccuccgaagugcauuggaauuacaaggaaagaaugguaaccuuuaaggucccgcacgcgaaacgccaggacgucacagugcuaggaagccaggagggcgcgaugcauuccgcucuugcuggagccacagagguagacagcggagacgggaaccauauguucgccggacaccucaaaugcaagguacgcauggaaaaacuaagaauaaaaggcaugaguuacacaauguguagcgggaaauucagcauagacaaagagauggcugagacucagcauggaaccacagugguaaaggugaaauacgagggggcgggugcaccauguaaagucccgauagaaauucgggaugugaacaaagagaaggucguaggucgggugauauccgcaacaccacuggccgagaacacaaauagcgucaccaauaucgagcuggaacccccauucggagacucguauaucguaaucggagucggcaacucggcccucacacuacacugguuccgcaagggcagcagcaucggcaaaauguuugagaguaccuaccgcggggccaagagaauggcgauccuaggugaaaccgcaugggacuuuggcucagucggaggccucuucacaucccugggcaaagccgugcaucaaguguuugggagcguuuacacaacgauguuuggaggagucucauggaugauccgcauacucauaggguucuuagucuuauggauaggcacgaacucgcguaacacaagcauggcuaugacgugcaucgccgucggaggaaucacacuauuucucggauuuacggugcaagcggacauggggugcguaguuucauggagcggccgugaacugaaguguggcucgggcauauucguaguggacaacguucauacguggacagaacaguacaaauuccaacccgagucaccagcacgucucgcaagcgccauacucaacgcccacaaggacgguguaugcgguauccguagcacgacccgucuugaaaacguaauguggaagcaaauaacaaacgagcuuaacuacguacucugggagggaggucacgauuugaccguaguagcuggcgacguaaagggcguccugacaaaggggaaacgcgcuuuaacaccaccggcgagugaccugaaguacucauggaaaaccuggggaaaagcgaagaucuucacgcccgaagcaagaaauuccacauucuuaaucgacgggccagacacauccgaaugcccgaacgaaagaagggccuggaacucauucgaaguggaggacuauggguuugggauguucacaacgaacauauggaugaaguuuagagaaggaagcagcgaagugugcgaucaccgccucauguccgcagccauuaaagaccaaaaagcggugcacgccgacaugggauacuggaucgaguccuccaagaaucaaacguggcagaucgagagggcgucauuaaucgagguaaagacaugcuuguggccuaagacacauacacucuggagcaaugggguuuuggaaucgcaaauguugauccccaaaucauacgcuggaccauuuagccagcauaacuaccgccagggauaugcaacgcagaccgucggaccguggcacuugggaaaauuggagaucgacuucggugaauguccaggcaccaccguaaccauucaagaaaacugugaucacagggggccgagccugcgcacgacgaccgcaucugguaagcugguuacacaauggugcugcagaucaugcacgaugccaccgcugagguuccuuggagaagauggguguugguacggaauggaaauccgcccccuaucagaaaaggaggagaauauggugaagagucaggucaccgcagggcaggggaccuccgagaccuuuuccaugggacugcugugccugacccucuuuguggaggaaugucuacgcagacgcgugacgcgcaagcacaugauccucgcagucguaauaacacuaugcgcaaucauccugggaggccuuacauggauggaccuacuucgcgccuugauaauguugggagacacaaugagcgggcgcaucggcggucaaacucaccucgcgaucauggcuguuuucaaaaugucgcccggguacguacucggggucuuccugaggaaauugaccagccgcgaaacugcacucauggugauaggcauggccaugacaaccacacuauccauaccccacgaccuaauggaguugaucgacggaauaucuuuaggccugauuuugcucaagauagugacacaauucgauaacacucaagucggcacccuugcccucagucugaccuuuauacggagcacuaucagccuuguaauggcauggcgaacgauaauggcuguacuauucgucguaacgcugaucccccugugucgaacgucaugccuccaaaaacagagccacuggguggagauaacagcgcucauacucggggcacaagcacugcccguguacuuaaugacccuaaugaaaggugcaagccggcguagcuggccacuaaaugaaggaauuauggccguaggacuggucagccuccucggcagcgcgcuacucaaaaaugacgucccguuggcugggccuauggucgcagggggucuauugcuagcugcauacgucauguccgguaguagcgcggaucucucgcucgaaaaagcagccaaugugcagugggaugaaauggccgacaucacgggcucgaguccaaucauagaggugaagcaggaugaggacgggucguucucaaucagagacguugaggaaaccaacaugauaacacuccuagucaaguuagccuuaauaacagucagcggccucuacccgcuggcuauacccauaacaaugacacuaugguacauguggcaggucaagacacaacgaagcggcgcacucugggacgugccaucgcccgccgccacgcagaaggccgcucuauccgagggaguauaccggauaaugcagcgaggacuauucggcaagacacaagucggcguagguauucacauggaaggaguguuccacaccauguggcacgucacacggggaucaguuauaugccacgagacaggccgguuagagccaucgugggcugacgugagaaacgauaugauuagcuaugggggaggauggcggcucggcgauaaaugggacaaagaagaagacguacagguacuugcaauugaaccagggaagaaccccaagcauguacaaacgaaaccaggcuuguuuaagacauuaaccggggagauaggggccgucacacuagauuuuaaaccugguacaucuggcuccccaauaauaaaccgcaaaggaaaaguaauaggucuauauggcaacggcguggugacgaaaucuggugacuacguaagcgcaaucacacaggcagaacggauaggcgaaccagacuaugagguggaugaggacauuuuccgcaagaagcgacuuaccaucauggaccuccaccccggggcgggcaagacuaagcggaucuuaccuuccauagugcgcgaggcacucaagcgacgacucagaacccugauacucgcaccgacgcgcgugguagcugcggagauggaggaggcacuccggggacuaccgauaagguaucagacaccagccgucaagagcgagcacacaggacgcgaaauaguagacuuaaugugccaugcaacauucacgacgagacuucugucgaguacccgaguaccaaacuacaaccuaauugucauggacgaagcccacuuuacggauccgucgucagucgccgcacgcggauacauauccacgaggguagaaaugggugaagccgccgcgaucuucaugacugccacgcccccgggagcaacugauccguucccccaaucuaacagccccauagaggacauagagcgagagauaccggagcgcaguuggaacaccgguuucgacuggauaacagacuaccaggguaagacaguaugguucgugccguccauaaaagcaggcaacgacaucgcuaacugccugcgaaagucaggcaagaaaguuauacaauuaagccggaaaacguuugacaccgaguauccgaagaccaagcuaacugacugggauuucguaguaacgaccgacaucucagaaaugggugccaacuucagggcaggaaggguaauagacccaaggcggugcuuaaagccaguaauacucacggacggcccugaacggguaauucuagcggggccaauccccgugacaccagccagcgcagcgcagagacguggccgaauaggcagaaacccagcucaagaggacgaccaauacguguucagcggagacccacucaaaaacgacgaagaccaugcgcacuggaccgaggccaagaugcugcuagacaacaucuacacccccgaaggaauaauaccgacgcuguuuggccccgaaagagaaaagacucaagccaucgacggcgaguucaggcugcgaggugaacagcgaaaaacguuuguggagcuaaugcggagaggggaccuacccguaugguuaucauacaaaguugcaucagccggcauuucuuacaaagaccgcgaauggugcuucaccggugaaagaaacaaucaaauucuugaagaaaacauggagguagaaauauggaccagagaaggcgagaaaaagaaauuacgaccgaaguggcucgacgcccgcguguaugcagaccccauggcacuaaaagacuucaaggaguucgcgagcggcagaaagucgauuaccuuggacauauuaaccgagauugcaucucugcccaccuaucuaaguagccgcgccaaacuugcccucgauaacauagucaugcugcacaccaccgagaggggcggcagagcauaucaacacgcccugaacgagcugccggaaucguuagaaacgcugaugcucgucgcucuacugggagcgaugaccgccggcaucuuccuauucuucaugcaaggaaagggcaucggcaaacuuagcaugggacuaauaacuaucgcaguugccucaggucuccucuggguagcugaaauccagccccaauggauugcagccucaaucauccuagaguucuuccugaugguauuguuaaucccggaaccggagaagcagcgcacaccccaagacaaucagcugauauacgucauacuuacgauccuaacaaucauuggacucauagccgcaaaugagaugggguuaaucgagaagacgaagaccgauuuugguuuuuaccaagucaaaacagaaacgaccauacucgacgucgaccugagacccgcuagcgccuggaccuuguacgcgguugccaccaccauccuaacaccgaugcuacggcauacaaucgagaauacguccgccaaccucucacuugccgccaucgcuaaccaagccgcugugcugaugggguuaggaaaaggguggccacuacaccgaauggaccuaggagucccacuucucgcaaugggcugcuacagccaagucaacccaaccaccuugacggcgagccucgugaugcugcuaguacacuacgccaucaucggcccugggcugcaagcaaaagccaccagagaagcacaaaaacgcacagcagcaggaauuaugaagaaucccacggucgacggcauaaccgugauagaccuagaacccaucuccuacgaucccaaauucgagaaacaacucggccaaguuaugcuccucguccuaugugccgggcaauuacuacugaugcguacgaccugggcauuuugcgaaguauuaacacuugcaacaggaccuauacucacgcucugggaagggaacccggguagauucuggaauacgacuaucgccguuuccacagcgaacauauuccgugguuccuaccuagccggugcaggacucgcguucucacuaaucaagaacgcgcaaacaccccgacgaggaaccgggaccgcgggcgaaacucuaggugagaaauggaaaaggcaacuuaacucccuugacagaaaggaauuugaagaguacaaaaggagcggaauccuagaaguagaucgcacugaagcaaagagcgcccuaaaagacggaagcaagauaaaacacgccguaagccgcggcagcucgaaaauucgcuggauaguugaacgaggaauggucaaaccgaagggaaaggugguagaccucggaugcgggagaggaggauggagcuauuauauggcaacccuuaaaaaugucacggagguaaaggguuacaccaaaggcggaccuggacaugaggagccuauucccauggccacuuacggauggaaccuggucaagcuacacuccggagucgacgucuuuuacaaaccaacggaacaaguugacacacuucugugcgauauaggggagagcagcuccaauccgaccauugaggaggggcggacccuacggguccuaaagaugguagaaccuuggcucucaagcaaaccagaguuuugcaucaagguguuaaauccuuacaugccaacgguaaucgaagaacuagagaaacuacaaagaaaacacggaggaaaccucguccgaugcccccuuucacgaaauagcacccacgaaauguauugggucagcggcgcgucgggaaacaucguaagcucggugaauacaacgagcaaaaugcuccucaacagauucaccaccagacaccggaagccaaccuacgagaaagaugucgaccucggcgcaggaacgcgaucggucuccacagaaacggaaaagccugacaugacaauaaucggccggagauuacagcggcuacaggaagaacauaaagagaccuggcacuaugaccaggaaaacccguaccgaacuugggcauaccacgggucuuacgaagcacccuccacaggaagcgcaucgucgaugguaaacggaguugucaaguugcuaacaaaaccaugggacguaaucccgauggugacgcaacuugcgaugacugauaccacgcccuucggacagcagcgaguauucaaggaaaagguagauacucgcacuccgcaaccuaagccagguacuaggauggucaugacaaccacugcgaauuggcuaugggcgcuccucggcaaaaagaaaaacccaagacuuugcacaagagaagaguucauaucaaagguacgaagcaaugcugccaucggcgcaguauuccaagaagaacaaggauggaccucugccuccgaagcaguaaacgacagucgguucugggagcucguagacaaagaacgcgcuuuacaucaggaaggcaaaugcgaaucgugcguauacaauaugaugggaaaaagagagaaaaagcuaggcgaguucggucgggcgaaaggaagucgcgcuauuugguauaugugguuaggagcccgauuucucgaguucgaagcucuuggauuuuuaaacgaagaucauugguuugggcgggagaacaguuggucaggagucgaaggggagggccuccaucgacucggcuacauacuagaagaaauagacaagaaagacggcgaccugauguacgcggacgacacagccggcugggacacgcgaauaaccgaagacgaccuccaaaacgaagaacuaaucacagaacaaauggcaccucaccacaagauauuagccaaggcaauauucaaacuaacguaccagaauaaaguugucaagguccuacgcccuacaccaagaggcgcggucauggacauuauaagucggaaagaucaacgggggagcggacagguggggacuuacggcuuaaacacauucacgaacauggaggugcagcuaauuagacaaauggaagcagagggcguaaucacccaagacgacaugcagaaucccaaaggauuaaaggagcgcguagagaaguggcuucgagaaugcgggguugacagguuaaagcgaauggccauaaguggggacgacugcguggucaagccccucgaugaacgauuuggcaccagcuuacuguuucuaaaugacaugggcaaaguccgcaaagacauaccacaaugggaaccaagcaagggauggaaaaacuggcaagaggucccauuuuguucgcaucacuuccacaagauauuuaugaaggacgggcgaucacuugugguaccgugcagaaaccaagacgagcugauaggacgagcccgcaucagccaaggagccggguggucacugcgcgaaaccgccugucucggcaaagccuacgcgcaaauguggagucugauguacuuucacagaagggaucucaggcucgccagcauggccaucugcuccgcggucccuacggagugguucccaaccucccgcacaacuuggucaauacaugcccaccaucaguggaugaccacagaagacaugcucaagguguggaaccggguguggauagaagacaaccccaauaugauagauaaaaccccgguacacucaugggaggacauuccguaccugggcaaacgcgaagaccuguggugcgggucgcugauuggacugucaagcagagcgacaugggcgaagaacauucacacggccauaacccaaguaagaaaccuuaucgggaaggaagaauacguagacuauaugccagugaugaaacgcuacuccgccccgucggaaucggaaggcguccuauaa

SEQ ID NO: 26224 - RNA, 9867 nt, Artificial Sequence
  derived and/or modified CDS sequence (opt11) from DENV-4__KP188563__SS-prME
agcaccaucaccuuacuuugccugaucccaacggugauggccuuccaucugucuacccgcgacggcgaaccgcucaugaucgucgcuaagcacgaacgggggcgcccgcuucuguucaagacgaccgagggcauuaacaagugcacccugauugcgauggaccuaggagagaugugcgaggacacagugaccuauaagugcccccuccucguuaacacagagccugaagacauugacugcuggugcaaccucacgagcaccugggucauguacggcaccugcacacaguccggugagcggcgccgugagaaaaggagcguggcucugacaccccacuccggcaugggucucgagacccgggcagagacauggaugagcagugaaggagccuggaaacacgcccagcgcguggagagcuggauccugcgaaaccccggcuucgcccuacuggcggguuucauggccuacaugaucggucagaccggcauccagcggacggucuucuucgugcugaugaugcugguggcccccuccuacgguaugcggugcguuggcguugggaaccgcgacuuuguagaaggcgucagcgggggcgcguggguggaucugguccuggagcacggugggugcgucacuaccauggcccagggcaagcccacccuggauuucgaguugacuaagacgaccgcaaaagagguggcgcugcugcguaccuacuguaucgaggcacugauauccaacaucacaacagcuacccgcugcccaacccagggggaacccuaucugaaggaggagcaggaccagcaguauauuugccggcgcgacguggucgaccgggggugggggaacggcugcggccuguucgggaagggcggaguugugacgugcgccaaguucagcugcuccggcaagauuaccgggaaccuaguccaaauugagaaucucgaguacacagugguuguuacugugcauaacggcgacacacacgcugucggcaacgacacgucaaaccacgggguaaccgccacaaucacgccccgcucgccaagcguggagguuaaacugccugacuacggggaguuaacguuagacugcgagccacggucgggaauugacuuuaacgagaugauacugaugaagaugaagaaaaagacauggcucgugcacaagcagugguuucuggaccugccgcuccccuggaccaccggcgccgacacgagcgaagugcacuggaacuauaaggagagaauggucaccuucaaggugccccaugcgaaacggcaggacguuaccgugcuggggucccaagagggugccaugcacuccgcacuagccggggcgaccgagguugacuccggcgacggcaaccacauguucgcgggacaccucaagugcaaggugcggauggagaagcuccgcaucaaagguauguccuacacgaugugcagcggcaaguucucuaucgacaaagaaauggccgagacccagcacggaacuaccgucgugaaggugaaguacgaaggcgcgggagcaccguguaagguccccaucgagauacgggacguuaacaaagagaaggugguugggcgagugaucuccgccacgccccuggcagagaacaccaacucugugaccaacauugagcucgaaccgcccuucggggacagcuacaucguaaucggcgucggcaacuccgcccucacccugcacugguuccggaaggggucauccauaggcaaaauguucgagagcacguacagaggggcgaaaaggauggccauucugggcgagacagccugggacuucggguccguuggcggccuguuuaccagccuugggaaagccguccaucagguauucggcuccguauacaccaccauguucgggggugucucguggaugaucaggauccuuaucggguuccuggugcuauggauuggaaccaacucccggaauacgucgauggccaugacaugcaucgccgucggaggaauaacgcuguuccucggcuucaccguccaagccgacauggggugugugguguccuggucgggccgcgaguuaaagugcgggagcgggauuuucgucguggacaacguacauaccuggaccgagcaguacaaguuccagccggagagcccagcgcggcucgcgagcgcuauucuuaacgcucacaaggacggaguuugcgggauccgcuccacgacucggcuggagaacgugauguggaagcagaucaccaacgagcugaacuacgugcuaugggagggagggcacgaucugacaguaguggccggcgacgugaagggaguccugacgaaggggaagcgcgcguugacgccacccgccucggaucugaaguacucauggaaaaccuggggcaaggccaagaucuucacccccgaggcgcggaauucuacguuccucauugaugggccagauacguccgaguguccuaaugagagacgggccuggaacagcuuugaagucgaagacuauggguucgggauguucacgaccaacaucuggaugaaguuccgcgagggcagcagcgagguaugcgaucaccggcucauguccgccgccaucaaggaucagaaggcgguccaugccgacaugggcuacuggaucgagagcaguaagaaccagacguggcagaucgagcgcgcgagccucaucgaggugaagaccugucuguggccuaagacgcacacccucuggucaaacggggugcuggagucucagaugcugaucccaaaaucauaugccggcccguucucucaacacaacuaccggcaggguuacgccacccaaacggucgggcccuggcaccucgguaaguuagagauagacuucggggaaugcccgggaaccacugugacuauacaagagaacugcgaccaccgcgguccgucccugcgcacgacuacggccucugggaagcucgugacccaguggugcugccgauccugcacgaugccgccgcuccgcuuccugggggaagacggcugcugguacgggauggagauccggccccucagcgagaaagaagaaaacauggugaaaagccaggugacugccgggcagggcaccuccgaaaccuucucaauggggcugcucugcuugacguuauuugucgaggagugcuugcgacggaggguuacccggaagcacaugauccuagcgguaguuaucacccugugcgccaucauucuuggcgggcugaccuggauggaccugcugcgcgcccucaucaugcugggcgacaccaugucgggccggaucggaggccaaacccaccuggcaaucaucgcugucuucaagaugucgccgggguacguccucggcguuuuccugcgcaagcugaccucacgcgagacagcgcuaaugguuaucgggauggccaugacaaccacccuuagcaucccacaugaccugauggaacucaucgacggcaucagucuuggguugauccucuugaagaucgugacccaguucgacaacacgcaggucgggacacuagcgcucagccugaccuucauccgcucgacgaugagccuggugauggccuggcggacgauaauggcugugcucuucgucguaaccuugaucccacuuugccgcaccuccugccuccagaagcagagccacuggguggaaaucaccgcccuuauccugggcgcccaggcccuucccgucuaccugaugacgcugaugaagggggcuucccgacgcagcuggccccucaacgagggcaucauggcgguggggcucguguccuuacucggcagcgcuuuacugaagaacgacgucccguuggccggccccaugguggcagggggccuguugcucgccgcguaugugaugagcgggagcagcgccgacuuaucucuagagaaggccgccaauguccagugggacgaaauggcggacaucaccggcagcuccccuaucaucgaagugaagcaagacgaggacgggagcuucuccauccgggacguugaggagaccaacaugaucacccuccuggucaagcuggcgcucaucacggugucaggacuguacccucuggccaucccgaucaccaugacccucugguacauguggcaggugaagacccagcgaucuggcgcucuaugggacguucccucgccugcggcuacccaaaaagcggcauuguccgaaggcguguaccggaucaugcagcgcggauuauuugggaagacgcaggugggugucgggauccacauggaagggguguuccacacaauguggcaugucacccgggguagcgucaucugccaugaaaccggccgccuggagcccucaugggcugacgucaggaacgauaugaucagcuacggugggggcuggcggcugggcgacaaaugggaccgugaggaggacguucagguccucgccaucgagccggggaagaaccccaaacauguccagacgaaaccgggccuguucaagacccugaccggggagauaggcgccguuacacucgacuucaaacccggaacguccggcucccccaucauuaacaggaaggguaaagucaucgggcuguacggcaacgggguagugaccaagagcggcgauuacgucagcgccaucacccaagccgagcgaaucggggagcccgacuacgaaguagacgaagauaucuuccggaagaaacgccugacaaucauggaccuccaucccggagcuggcaagacgaagcggauccugccuuccauagugcgcgaggcacugaagcggcgucugcggacccucauccuggcgccuacccgcgucguggccgcggagauggaggaggcauugcgggggcucccuauacgcuaccagaccccagccguuaaaagcgagcacacgggccgagagauagucgaccugaugugccacgcgaccuucacgacccgccuucucuccagcacgagagugccgaacuacaaccugaucguaauggacgaggcccacuucaccgaccccagcucuguugcagcccgcggguacaucaguaccaggguggagaugggggaagccgcggccaucuucaugacugccacgcccccaggggccaccgacccguucccccagaguaacagcccaaucgaggauauugagcgagagauccccgaacgcaguuggaacacgggcuucgacuggaucaccgacuaccaaggcaagacggucugguuuguacccagcaucaaagcagggaacgacaucgcgaacugccugcggaaauccggaaagaaagugauccaacuaucccguaagacuuucgacaccgaguaccccaagaccaagcugacggacugggauuucguugugacgaccgacauaucagagaugggggcuaacuuucgcgccgggcgcgugaucgacccccggcgcugccugaagcccgucauucucaccgacgggccggagagagugauccuagccggccccauacccguuacucccgccucagcggcgcagcgccggggccgcauuggccggaaccccgcccaggaggaugaccaguacgucuucuccggcgacccccugaagaacgacgaggaccacgcacacuggaccgaagcuaagaugcuccuugacaacaucuacaccccggaaggcaucauccccacgcuguuuggaccagaacgcgagaagacgcaggccaucgacggcgaguuccggcuccguggagagcagcggaagaccuucguggagcugaugcgccggggcgaccugccgguguggcucagcuacaaagucgcauccgccgggauaaguuacaaggaccgggagugguguuucacgggcgagcggaauaaccagauauuggaggagaacauggaaguagagaucuggacccgcgagggggagaaaaaaaagcugcggccuaaguggcucgacgcccgcguguacgccgaucccauggcccugaaggauuucaaggaguucgccucagggaggaagagcaucacccuggacauccucacagagaucgccucccugccgaccuaccugucuagucgugccaaacucgcgcuggacaacaucgucauguugcacacgaccgagcgaggugggcgggccuaccagcacgcccuaaacgaguugccagagagccuggagacgcucaugcuaguggcccuucucggcgcgaugaccgccgggauuuuccuguucuucaugcagggcaaggggauuggcaagcugagcaugggacucaucaccaucgccguugccuccggcuugcugugggucgccgaaauucaaccucaguggauagcggcaagcaucauccuugaguucuuuuugauggugcugcucaucccagagcccgagaagcagcgcaccccccaggacaaccaguugauuuacgugauccugacgauccucaccauuaucggcuuaaucgccgcgaacgaaaugggguugauagagaagaccaagaccgacuucggcuucuaucagguuaaaacugagaccacaauucucgacguggauuuacggccugccuccgcuuggacccucuacgccgucgccaccaccaucuugaccccgaugcuuaggcauaccaucgagaacacgagugccaaccugucccuagcagcaaucgccaaccaggccgccguccugaugggacugggcaaagguuggccccuccaccgcauggaccuggggguuccccugcucgccaugggcugcuacagucaggugaaucccaccacccugaccgccucccucgucaugcuccucgugcauuaugcgaucaucgguccgggcuuacaagccaaggccacgcgggaggcgcagaaacggaccgcugccggcaucaugaagaacccaaccguggaugguaucaccgucaucgacuuggaacccaucagcuaugaucccaaguucgagaagcagcuggggcaggucaugcugcucgugcugugcgccggucagcuccuccuaaugcgcacgaccugggcuuucugcgagguccugacccucgcgaccggcccgauccugacgcugugggaggggaaccccggucgguucuggaacacaaccaucgccguguccaccgccaauaucuuccgcggcagcuaccucgccggggccggacuggcguucucccugaucaagaacgcccagaccccccgaagagggacaggcaccgcuggcgagacccucggcgagaaguggaagcgacagcugaacuccuuagaccggaaggaguucgaggaguacaagcgguccggcauccucgagguggacaggacagaggccaaaagcgcacugaaggacggguccaagauuaagcaugcggucagccggggcucaagcaagauccgcuggaucguggagcgcgggauggugaagcccaagggcaagguaguggacuuggguugcggccggggcggauggagcuacuacauggccacgcuuaagaacguuaccgaggucaaggguuacaccaagggaggcccggggcacgaggagcccaucccuauggccaccuacggcuggaaccugguuaaacugcacagcggcguggacguuuuuuauaagccgaccgaacagguggacacccuccucugcgacaucggggagucaagcucaaauccgaccaucgaggagggacgcacccugcggguccucaagaugguagagcccuggcugagcaguaaacccgaauucugcaucaaggugcugaaccccuacaugcccacggucaucgaggagcuggagaagcuccagcgcaaacacgggggcaaccugguucgaugcccccugucccgcaacagcacacaugagauguacugggugaguggcgccuccgggaauaucguguccucgguuaacacgacauccaagaugcuccugaaucgguucacgacccgccaccggaaaccuacauaugagaaggauguggaucuaggggcggggacucgcagcgucuccacugagaucgagaagcccgacaugaccaucauuggccggcgccugcagcgguugcaggaggagcacaaggagacauggcauuaugaccaggaaaacccguaccgcaccugggccuaccacgggagcuaugaggcuccgucgacgggcagcgccuccaguauggugaacggggugguuaaacugcuuaccaagcccugggacgugaucccuauggugacccaacuggcaaugaccgacacgaccccuuucgggcagcagcguguauuuaaagagaagguugacacccgcaccccccagcccaaacccgguacgcgaauggugaugacgaccaccgccaacuggcucugggcacuccugggaaaaaagaaaaacccccgccuaugcacgagagaggaguucaucuccaaggucaggaguaacgccgccaucggugccguuuuccaggaggagcagggguggaccuccgcgagugaggccgugaacgacagccgguucugggagcucguggacaaggagcgcgcacugcaccaggagggcaaaugcgagucuugcguguacaacaugaugggcaagcgcgagaagaaguugggggaguucggccgggcuaaggggagccgcgccauaugguacauguggcuuggcgcccgguuccuggaguucgaggccuuaggguuccucaacgaagaccacugguucggccgcgagaacuccuggucgggcguggagggggagggccugcauagacugggguauauccuugaggagauagauaagaaggacggggaccugauguacgccgacgacaccgccggcugggacacccgcauuacggaagacgaccuacaaaacgaggagcugaucaccgagcagauggcgccacaccacaagauuuuggcuaaggccaucuucaagcugacguaccaaaacaaagucgugaaagugcuccggccgacgccccgcggugccgucauggacauuaucucucggaaggaccagcgcggcagcgggcaagugggcacauacgggcugaacacauuuaccaacauggagguucaacugauccggcagauggaggcggaaggggugaucacucaagacgauaugcaaaacccuaagggccugaaggagaggguggaaaaguggcugcgggagugugggguugaccgccugaaacggauggcgaucucuggcgacgacugcgucgugaagccccuagaugagcgcuucgggacuucauuauuguuucucaacgacaugggaaagguucgaaaggacaucccacagugggagcccuccaagggcuggaagaacuggcaggagguccccuucuguagccaccacuuucacaagaucuucaugaaggauggucgcucccucguuguacccugucguaaucaggacgaguugaucggcagagcucgcaucagccagggggccggcuggucccuccgggagacugccugccuggggaaggccuacgcgcagauguggucccuuauguauuuccaccgcagggaccuccggcuagccuccauggccaucugcagcgcuguccccacggagugguucccgacgagccguaccacuuggucuauccacgcccaucaccaguggaugacgacugaggacaugcugaagguuuggaaccgcguguggaucgaggacaaucccaauaugaucgacaagaccccgguccacagcugggaagacauccccuaucucggcaagagggaagaccuguggugcggcucccugaucggcuuaucgagccgcgcuacgugggcgaagaacauacauacagcuaucacucaggugcgaaaccugaucggcaaggaggaguacguagauuacaugagcguaaugaaacgcuacuccgccccgagcgaguccgaggggguccuguga

SEQ ID NO: 26225 - RNA, 9867 nt, Artificial Sequence
  derived and/or modified CDS sequence (opt11) from DENV-4__KP188564__SS-prME
agcaccauuacccuccugugucugauccccacggugauggcguuccaucucaguacucgcgauggcgaaccgcucaugaucgucgccaagcaugagcgggggcgcccuuuguuguucaagaccaccgaaggcauuaacaaaugcacgcucaucgcgauggaccugggcgaaaugugcgaagauaccgugaccuacaaguguccgcuccugguuaauacagaacccgaagacaucgauugcuggugcaaucugacgagcacuugggucauguauggcaccuguacccagagcggggaacggcgacgggagaagcgcagcguagcgcugaccccgcauuccggaaugggccucgagacccgugcagagaccuggaugagcuccgaaggcgccuggaagcacgcccagcgcgucgagagcuggauccugcgcaacccgggcuucgcgcugcuugccggcuucauggccuacaugauugggcagaccgggauccagcgcacaguauucuucgugcugaugaugcugguggcgcccuccuacggaaugcggugcguuggagugggaaacagggacuucguggagggagucaguggaggcgccuggguugaucucgugcuugagcaugggggaugcgucacaaccaucgcccagggaaagccaacccuagacuucgaacucacgaaaacaaccgccaaagagguagccuugcugcguaccuacugcaucgaggcgcucaucucaaacauaacgaccgcaaccaggugcccgacgcagggggagcccuaccugaaggaagagcaggaccagcaauacaucugcagacgugacguaguugaucggggcugggggaacggcugcggacuguuugggaaaggcggggugguuacgugugcuaaguucucuugcaguggaaagaucaccgggaauuugguacagaucgaaaaccuggaguacaccgugguagucaccguacacaauggugacacacacgcugucggcaacgacacaucgaaccacggggugaccgcgaccauaacaccgcgaucacccagcguggaggucaagcugccggacuacggcgagcucacccuggacugcgagccccgguccgggaucgacuucaaugaaaugauccugaugaagaugaagaagaaaaccuggcucgugcacaagcagugguuucuggaucugccccuccccuggacaacgggcgccgauacgagcgaggugcacuggaacuauaaggagcgcauggucacauucaagguaccgcacgcgaagcgccaggaugugaccguccuggggucacaagagggcgcaaugcauagcgcacuggcuggcgccaccgaagucgacaguggggacggcaaccacauguucgcgggccacuugaagugcaaggugcgcauggagaagcuccgcaucaagggaaugaguuacacgaugugcagcggcaaguucuccaucgacaaggagauggccgagacccaacacgggaccaccguugucaaaauuaaguacgagggugcgggggccccaugcaaggugcccaucgaaauucgggacgucaauaaggagaaaguggugggccgcgucaucagcgccacgccccuggcggagaacaccaauuccgugacuaacaucgaauuagagccgcccuuuggggacuccuacaucgugaucggggucggcaacucggcccugacccuucacugguuucguaaggggagcuccauaggcaagauguucgagucgacguaccgcggggccaagcggauggccauccuuggcgaaacugcgugggacuucggguccgugggcggccuguucacgagccuaggcaaggccguucaccaggucuucggcuccguguacacaacaauguucgggggggugucuuggaugauccgaauccugaucggguuccucguacuguggaucggcacgaauucgcgcaacaccagcauggcuaugacaugcaucgccgucggcgggaucacacuguuucucggcuucaccgugcaggccgacauggggugcgucguaagcuggagcggccgcgagcugaagugcggguccgggaucuuugugguugacaacgugcacaccuggaccgaacaguacaaguuccagccagaaucuccggcacgccuugccagcgccauccuuaacgcccacaaggacgguguuugcggcauccgcuccacgacgcgacucgaaaauguaauguggaagcagauaacuaaugaacugaacuacguucucugggaaggcggacacgaucuaacaguagucgcgggugacgugaagggcgugcugacgaagggaaaacgcgcgcucacaccgccugccagcgauuugaaguacuccuggaagaccuggggaaaagccaagaucuucaccccagaggcccggaacagcacguuucugaucgacgggcccgauacguccgagugcccgaacgaaagaagggcauggaacagcuuugaaguggaggacuacggcuucgggauguucacaacuaacaucuggaugaaguuuagggagggcuccagcgaggugugcgaccaccggcucauguccgcugccaucaaggaccagaaggcuguccacgcggacaugggcuacuggaucgagucguccaagaaccagaccuggcagaucgaacgcgccagccugauugagguaaagaccugucuuuggccgaagacccacaccuuaugguccaauggaguacuagagucgcaaauguugauccccaagucuuacgccggcccguucucgcagcacaacuaccgucagggauacgccacccagacuguugggcccuggcaccuggggaaacuggagaucgacuucggcgagugccccggcacaacggucaccauucaggagaacugcgaucaccgcgggcccucccugcgcacgacaaccgccagcggcaagcucgugacccagugguguugccggagcugcacgaugccgccccugcgcuuccugggggaggacggaugcugguacgggauggaaauccguccccuauccgagaaggaggagaacauggugaaaagucagguaaccgcaggacagggcaccagugagacuuucuccauggggcugcugugccucacgcuguucguggaggaguguuugcgccguagagucacgcggaagcacaugaucuuagcgguggucaucaccuuaugcgccaucauccugggagggcucacuuggauggaccuguuacgagcccucaucaugcugggagacacaauguccggacggaucgggggccagacgcaccucgccauuauggcagucuucaagaugagcccgggguacgugcucggaguguuccuacggaaacugacuuccagggagacugcacucauggucaucggaauggccaugacgacgaccuugagcauaccgcacgaucugauggagcucaucgacgguaucuccuuaggccuaauacuccugaaaauugugacccaauucgacaacacgcagguggggacgcuggcccuaagccugaccuucauccgcucgaccaugagcuuagucauggccuggcgaacgaucauggccgugcucuucgugguuacccugaucccccugugucgcaccuccugucuacagaagcaaucgcacuggguggagaucaccgcgcugauacugggagcccaagcucuucccguauaccucaugacccugaugaagggagccucccggcgcagcuggcccuugaacgagggaauuauggcggucgggcuggucucgcugcucggcucugcccuccucaagaacgacgugccgcuggcagguccaaugguugcggggggccuccuacucgcagcguauguaaugagcggcagcagcgccgaccucucccuggagaaggccgccaaugugcaaugggaugagauggcagacaucaccggaagcaguccaauaauugaggucaaacaggacgaggaugggucguuuucgaucagggacguagaggaaacuaauaugaucacccuccugguaaagcuggcgcucaucacggugaguggacuguacccauuagcaaucccuaucacaaugacacucugguacauguggcaggugaagacccagcguucaggugcuuugugggacguaccaucgcccgccgcuacccagaaggcugcccugagcgagggggucuacaggauuaugcaaaggggacucuucgggaagacgcaggugggcgucgggauccacauggaaggggucuuccacaccauguggcacguuacccguggcagcguaaucugccacgaaacaggacggcuggagcccagcugggcggacgugcgaaacgacaugauaagcuauggugggggauggcggcugggagacaagugggacaaggaggaggacgugcaggugcuggccaucgagccggggaagaacccaaagcacguccagacgaagccaggccuguucaagacucucacuggggaaauaggcgcggugacucuugauuucaagcccggcaccuccggcagucccaucaucaaccgcaaggggaagguuaucgggcuuuacggcaaugguguggugaccaagagcggcgacuacguuuccgcgaucacccaggccgagcggaucggggaacccgacuacgaggucgacgaggauaucuuccgcaaaaagcggcucaccaucauggaccuccaccccggggccgggaagacgaagcggauuuuacccucgaucgugcgggaagcccugaagcgucggcugagaacccucauccuggcaccgaccaggguggucgccgcugagauggaggaggcacugagggggcucccuauccgauaucagacccccgcagugaaaagugagcacacaggucgcgagaucguggaccugaugugucacgcgaccuuuacgacaagacuguuguccagcacgcgcgucccgaacuacaaucugauugugauggaugaagcccauuucacagacccaucguccguggccgcccgggguuacaucagcaccagggucgagaugggcgaagccgcggccauuuucaugaccgcaacgccgccgggggccaccgacccguuuccucaguccaacagccccauugaggacaucgagcgugagauucccgaacgcaguuggaacacgggcuuugacuggauaaccgacuaccagggcaaaacugucugguuugucccgagcaucaaggcugggaacgacaucgcgaacugcuugcgcaaaagcggcaagaaggugauucaacugagccggaagacguucgacaccgaguaccccaagaccaagcugacugacugggacuucgugguuaccacagacauuuccgagaugggcgccaacuuccgcgccggucgggugauagacccccgccgguguuugaagcccgugauucucaccgacgguccggaaagagugauccuggccgggccgauccccgugacgcccgcuucggccgcccagcggaggggccggauagggcguaacccggcucaagaggacgaccaguacguuuucucaggcgacccgcugaagaacgacgaggaucaugcccacuggacugaggcgaagaugcuucuggacaacauauacacccccgaggguaucauccccacccuguuuggcccggagagggagaagacccaggccauugacggcgaguuucgccuccggggggaacagcgcaagaccuucguagagcugaugcggcgcggcgaccugcccguaugguuaagcuacaaggucgccuccgccggaaucagcuacaaggaucgcgaaugguguuucaccggggaacgcaauaaccagauacuugaggaaaacauggagguagaaaucuggacccgggagggcgagaaaaagaagcugcgccccaaguggcucgaugcgcggguguaugcggaccccauggccuugaaggacuucaaagaguuugccuccggccgcaagagcauuacacuggacauccucacggagauagccucccugccgaccuaccugagcagucgagcgaaauuggcguuggacaauaucgucaugcuacauaccaccgagcggggcggccgagccuaccagcaugcccucaacgagcuuccugagagccuggagacgcucaugcuagucgcgcuucucggcgcgaugacagccggcaucuuccuuuucuuuaugcaaggcaaagggaucggcaaauugucgaugggccucaucacgaucgccguggccuccggucugcuguggguagccgaaauacagccccaguggaucgcagcuagcaucauccuagaguucuuccuaaugguccugcuuaucccagagcccgagaagcagcggaccccccaggacaaccagcugaucuaugucauccugacgauacucacgaucaucggccugaucgcggcuaaugagauggggcugauagagaagacgaagaccgacuucggauuuuaccaagugaaaaccgagaccacaauccuggacguggaccuuaggccugccuccgcauggacgcuuuacgcgguugcgacgaccauacucacuccaaugcugagacacaccauagagaacacgagcgcaaaccuguccuuagccgcgauagccaaccaagccgccgugcugauggggcucggcaagggcuggcccuuacacaggauggaccugggagugccucuuuuggccaugggcugcuacagucaggugaaucccacaacacucaccgcgucccugguaauguuacugguccauuacgcuaucaucgggccgggacugcaggccaaggccacccgugaggcgcagaagcgaaccgccgccggaauaaugaaaaaccccacuguggaugggaucacaguuauugaccucgagcccaucagcuaugaccccaaguuugaaaagcaacugggccaggugaugcuucugguacugugugccgggcaguuauugcucaugcgaacaaccugggcauuuugcgaggugcugacgcucgcgaccggcccgacgcuaacccucugggaagguaacccugggcgguuuuggaacaccacaaucgccgucuccacugccaacauuuuucggggcucuuaccucgccggggcuggcuuggcguucuccuuaaucaagaacgcccaaacaccccgccgugggacgggaaccgccggggagacccuuggcgagaaauggaagcgccagcugaacucccuagaccgcaaggaauucgaggaguacaagcguuccggcauccucgaaguagacagaaccgaagccaaaagcgcacugaaagaugguucgaagaucaagcaugccguuagcaggggcuccucgaagauccgguggaucgucgagcgcgggauggugaagcccaaaggcaaggugguggaccucggaugcggacgcggggguugguccuauuacauggccacucucaagaacgugacagaggucaaggguuacaccaagggagguccgggacacgaggaacccauccccauggcuacauacggcuggaaccugguuaaguugcauagcggcguggacguuuuuuacaaacccacggaacaggucgacacacuccuaugcgacaucggagagagcaguucgaacccgaccaucgaggagggucggacgcugcgcgugcugaagaugguggagcccuggcuguccucgaagcccgaauucugcaucaagguccuuaacccauacaugccgacuguaaucgaggagcuugagaaguuacaacggaaacaugggggcaaccugguucgcugcccacugucccggaacucaacccacgaaauguacugggucagcggcgcgagcgggaacaucgugaguagcgucaacacgaccagcaagaugcuccugaaccgcuucacgacccggcaccgaaagccaacuuaugaaaaggacguggaccugggcgcggggacaagaagcguguccacugaaaccgagaagcccgacaugacgaucaucggccgccggcuccagagacuucaggaggaacauaaggagaccuggcacuacgaccaggagaacccguaccgcaccugggccuaucacgggucauacgaagcacccagcaccggcagcgcauccagcaugguuaacgguguugugaagcugcucaccaagccgugggaugugauucccauggugacgcagcuugccaugaccgacacuaccccguucggacagcagcgcgucuucaaggagaagguugauacacggaccccccaaccgaagccaggcacccgcauggugaugaccacgaccgcgaauuggcucugggcccuuuuggggaagaagaagaacccccggcuguguacacgcgaggaguuuaucucuaaggugcgaagcaacgcggccaucggugccgucuuccaggaggaacaaggguggaccagcgcgaacgaggccguaaacgacucccguuucugggagcucguggacaaagaacgggcccuacaccaagaaggcaaaugcgagagcugcguguacaauaugaugggcaagcgcgagaagaagcugggugaauucggcagagcuaaggggucccgggcuaucugguacaugugguugggugcgcgcuuccuggaauucgaggcccuaggcuuccuuaacgaggaccacugguucggacgggagaacucauggucuggcguggagggggagggcuuacaccguuugggguacauccucgaggagaucgacaaaaaggacggcgaucuaauguaugcagacgacacggcuggcugggauacccggaucaccgaagaugaccugcagaacgaggaguugaucaccgagcagauggcgccacaccacaagauucuggccaaggccaucuucaagcugaccuaccagaauaagguggucaaggugcuccgucccacgccgcgcggggcagucauggauauuaucuccagaaaggaccagcggggcagcgggcaaguggggacauauggacugaacaccuuuaccaacauggaggugcagcuuauccgccagauggaggcugaaggaguaauaacacaggacgauaugcagaaccccaagggccugaaggagcgggucgagaaguggcuacgcgaaugcgggguggaucgucugaagcgcauggcaauuucuggggacgacugcguggugaagccuuuagacgagcgguucggaaccucccuucuuuuccucaaugacaugggcaaagugcguaaagauaucccacagugggagccgucaaagggguggaaaaacuggcaggaggugcccuucugcucccaccacuuucauaagaucuucaugaaggaugguaggagccuggucguaccgugucgcaaccaggaugagcugaucggacgggcucgcaucucccagggggcgggcuggagccucagggaaaccgccugucuggggaaagcguacgcacagauguggucccugauguacuuccaucggcgggaccuccgucuggccucuauggccaucugcucagccgugcccaccgagugguucccuacgucgcgcaccaccuggagcauccacgcacaccaccaguggaugaccacggaggacaugcugaagguguggaaccgggucuggaucgaggauaaccccaacaugaucgacaagaccccgguacacuccugggaagacaucccauaccucggaaagcgcgaggaucuguggugcgggagccucaucggcuuguccaguagagcgacgugggcuaaaaacauacauaccgccauaacgcaggugcgcaaccugauuggcaaagaggaguacguggauuacaugccugugaugaagcgguacucagcccccagcgagagugaggggguccuguag

SEQ ID NO: 26226 - RNA, 9867 nt, Artificial Sequence
  derived and/or modified CDS sequence (opt11) from DENV-4__JN983813__SS-prME
ucgaccaucacccugcucugccugauccccacggugauggcuuuccaccugucgacucgggauggagaaccgcucaugaucguugcuaagcacgagcgggggagaccgcuguuguuuaagaccacugaagggauaaacaagugcacgcucauugcgauggaccuaggugaaaugugcgaggacacugugacuuacaaaugccccuuacucguaaacaccgagcccgaggauaucgauugcuggugcaaccugacgagcaccugggugauguaugggacuugcacccaaagcggggagcggcgccgcgagaaacggaguguagcccugacgccgcacuccggcaugggcuuggagacucgggcugagaccuggaugagcuccgagggggcuuggaagcacgcccagcgcguggaguccuggauacuccggaaucccgguuucgcgcugcucgcgggguucauggcguacaugaucggucaaaccggcauucagcgcacggucuucuucgugcugaugaugcugguggcgcccuccuacggcaugcguugcguuggcguagguaacagggacuucguggaaggcguaagcgggggcgcguggguagacuuggugcuggagcacggcgggugugucacuaccauggcccaggggaagcccaccuuggacuucgagcucacgaagaccacugcuaaagagguagcacuacugcggaccuacugcaucgaggcccucauuuccaacaucacgacggcaacccgcugcccaacucaaggggagcccuaucuuaaggaggagcaggaucagcaguacauuugccggcgcgauguugucgauagaggcugggggaacgggugcggccuguucggaaagggaggcgugguaacuugcgcuaaguucagcugcucgggaaagauuaccggcaacuugguucaaauagaaaaccuggaguacaccgucguggucaccguacauaauggcgacacgcaugccguuggcaaugacacaaguaaucauggggugaccgcuaccaucacgccccgcucucccagcguugaggucaagcugccugacuacggugaauuaacccuggauugugaaccccgcucggggauagacuucaacgaaaugauccugaugaagaugaagaagaagaccuggcuagugcauaagcaaugguuucuggaccugccccuccccuggacgacuggagccgacacgagcgaggugcauuggaauuauaaggagcgcauggucacauucaaggugccccacgcgaaacggcaggacguaaccguauuggggucgcaggagggcgcgaugcacucggcccuagcaggcgcgacagaaguggacagcggggacggcaaccacauguucgcggggcaccuuaagugcaaaguucgcauggagaagcugcguaucaagggcauguccuacacgaugugcagcggcaaauucuccaucgacaaggagauggccgagacccagcacgggaccaccgucguuaaggugaaguacgagggggccggggcgcccugcaagguccccauugaaauccgagauguuaacaaggagaagguggugggacgcgugaucucagccacgccccuagcggagaacacuaauuccgugacaaacauagagcuggagccgcccuucggggacaguuacaucguuaucggcgucggcaacuccgcucugacccugcauugguuccggaaaggauccuccaucggcaagauguucgagagcacauaucgcggggccaagcggauggcgauucucggcgagacggcaugggacuucggauccgugggcggucuguuuaccucauuagggaaggccguacaccagguguucggcuccgucuacaccaccauguucgggggcgugagcuggaugauccgcauccucauugguuuccugguguuauggauaggcacgaacucccgcaacaccagcauggccaugaccugcaucgcagucggagggaucacgcuguuccucggcuucaccguccaagccgauauggggugcgucguguccuggagcggacgcgagcugaaauguggguccggcaucuuugucguggauaacguacacacuuggaccgagcaauauaaauuucagccugaguccccggcccggcuggccuccgccauccugaacgcacacaaggauggcgucugcgggauccgcuccacgacccgguuagaaaacgugauguggaagcagaucaccaaugagcugaacuacgugcucugggaaggagggcacgaccugaccgucguggccggagacgugaaaggaguccugacgaaggggaagcgcgcucucaccccgccagccagugaccugaaguauuccuggaagaccugggguaaggcgaagaucuucacccccgaggcccggaacagcaccuuccucauugaugggccggacacaucagaaugcccgaacgaacgccgagccuggaacucuuuugagguggaggacuacggauucgggauguucaccacuaacaucuggaugaaauuccgcgagggcuccagugaggugugcgaccaccggcucaugagcgcggccaucaaggaccagaaggccguccaugcggauaugggcuauuggaucgaaagcagcaagaaccagaccuggcagaucgagcgcgcgagccugaucgagguaaagacgugucuguggcccaagacccacacucugugguccaacggaguacuggaaagccagaugcugauccccaaguccuacgcgggaccuuucagccagcacaacuaccggcagggguacgcaacccaaacggucggccccuggcacuuagggaaauuagagaucgacuuuggagagugccccgggaccaccguuaccauacaagaaaacugcgaccauaggggucccuccuugcguaccacgaccgccagcggaaaacuggugacccaguggugcugucgguccugcacgaugccgccccugcgcuuccuaggggaggacggcugcugguaugggauggagauccggccccuauccgaaaaggaggaaaacauggugaagagucaggugaccgccggccaggguacauccgagacuuucucuaugggcuuacugugcuuaacgcuguucguggaggagugccugcggaggcgcgugacccggaagcacaugauccuggcgguggucauaacccugugcgccauuauucugggagggcucacguggauggaccuccuucgagcccugauaaugcuaggugacacgauguccggccggaucggaggucagacccauuuagccaucauggcgguguucaagaugagcccaggcuacgugcucgggguuuuccugcgcaagcugacaagccgggaaaccgcccucauggugaucgggauggcgaugacgacuacacugucgaucccccaugaucuaauggagcucaucgacgguaucucccugggccugauccuccugaaaaucguaacccaguucgauaacacucaagucgggacccuggcucucucacugacguucauacgguccacgaugagccugguuauggccuggaggacgauaauggccgugcuguuugucguaacccucaucccccugugcagaaccaguugcuuacagaagcagagccacuggguggagauuaccgcgcugauacucggugcucaagcguuacccguauaccucaugacacuuaugaagggggccucccggcgcagcuggccacucaaugaggggauaauggcgguggggcugguguccuuacucggcagcgcccugcucaagaaugacgugccacuagccgggcccaugguggccggagggcugcugcucgccgcguacgugauguccgggagcagcgcggaccugucccuugagaaggccgcuaacguccagugggacgagauggccgacaucaccgguuccuccccuaucaucgaagugaagcaggaugaggacggaaguuucuccaucagagacgucgaggagaccaauaugauaacgcucuuggucaagcuagcgcucauuacgguaucuggccuguauccucuggcuaucccgaucacaaugacccucugguacauguggcaggucaaaacccagcgcuccggagcccugugggacgugccgagccccgccgcaacacagaaggccgccuuaucagaggggguguaccggaucaugcagagaggucuguucggaaagacacaggugggaguugggauccacauggaggggguauuccacaccauguggcaugugaccagaggcagcgucaucugccacgagacagggcgccuagagccgucuugggcugacguacgcaacgauaugaucaguuacggcgggggauggcggcuuggcgacaagugggacaaggaggaggauguccaagugcucgccauugagccuggcaaaaaucccaaacauguucagacaaagccgggccuguucaagacucugaccggggagaucggcgccgugacgcucgauuucaaaccggguacgaguggcagcccuauaauuaaucgcaaggguaaggucaucgggcuuuacggcaacggaguggugaccaagucgggagauuacauuucggcgauuacucaggcggagagaaucggggaaccagacuacgagguggacgaggacaucuuccgcaaaaagagacuaaccauuauggacuuacaccccggagcagguaagacgaagcgaaucuuaccguccaucgugagagaggcgcugaaacgccgacuccgcacgcucauccuggcgccuaccagagucgucgccgcagagauggaggaggcacugcgaggguuacccauccgcuaccagacccccgcaguaaaauccgagcacacgggccgggagauugucgaucucaugugucacgcgaccuucaccaccagacugcucagcucaacgcgcgugccgaacuauaaccuuaucgugauggacgaagcgcacuucaccgauccaagcuccguagcugcgaggggauacaucucaacccgcgucgagaugggcgaggcugcggccaucuucaugaccgccacgccuccgggggccaccgacccguuuccccaguccaauagccccaucgaggacauagagcgggagauacccgagcgauccuggaauacaggcuucgacuggauaacugacuaccagggcaagacggugugguuuguaccgagcaucaaggcuggaaacgacauugccaacugcuuacgcaaaucuggcaagaaggugauccagcucagccggaagacuuucgauaccgaguaccccaaaaccaaacugaccgauugggacuucguuguaaccaccgacaucagcgagaugggggcgaacuuccgagccggccgggugaucgacccccgacggugccugaagccaguuauccucacugacgguccggagcgcgugauucucgccggccccauccccgucacgccagcaagcgccgcccagcggaggggccggaucggucgcaacccugcgcaggaggacgaccaguacgucuuuuccggcgacccccugaagaacgacgaggaccacgcgcauuggaccgaggcgaagaugcucuuagacaauaucuacacccccgaggggaucauccccacccuguucgggccggagagagaaaagacccaagccaucgacggcgaguuccgccugagaggggagcaacgcaagaccuucgucgaguuaaugcgccggggcgaucugcccguaugguuaucguacaagguagcauccgccggcaucucauacaaggaccgugaaugguguuuuaccggcgagcguaauaaucaaauacuagaggaaaacauggaaguugagaucuggacccgggaaggcgagaagaagaagcugcgccccaagugguuggacgcacguguguaugcggacccuauggcccuuaaggacuucaaagaauuugcuuccggccgcaaaagcaucacccuugacauucucaccgaaaucgccagccugccgacauaccugagcucccgugcgaagcuagcgcuggauaacaucguuaugcuucauaccacggagcggggugggcgcgccuaucagcacgcucucaacgagcuccccgagagucuggagacacucaugcuggucgccuuacucggcgcgaugacagcaggaaucuucuuauucuucaugcaaggcaagggaaucggcaagcugagcauggggcucauaaccaucgcgguggccucggggcugcuauggguagccgagauacagccccaauggauugcagccuccauuauacucgaguucuuccugauggucuuguuaaucccagagcccgagaagcaacggacaccccaggacaaucagcugaucuacgugauccugacgauccucaccauuaucggccuuaucgccgccaacgagauggggcugaucgaaaagaccaagaccgacuuuggcuucuaccaggugaagacggagaccacaauccuggacguggacuugcgacccgccuccgcguggacccuguacgccguggcgacaacaauacucaccccgaugcugcgacacaccaucgaaaacacuagcgccaaucuguccuuagcugcgaucgccaaucaggccgccgugcugaugggacuaggcaagggcuggcccuuacacaggauggaucugggugugccccugcucgccauggggugcuacucacagguuaacccaaccaccuugacggcgucgcuggugaugcuccuggugcauuacgccauaaucgggccgggccugcaggccaaagcuacgcgagaggcacaaaagcgcaccgccgccggcaucaugaaaaacccuaccguugacgggaucacggugauagaucucgagcccauaaguuacgaccccaaauucgaaaaacagcuuggacaaguaaugcuguuagugcuuugugccgggcagcugcuccugaugcggacgaccugggccuucugcgagguccugacacucgcgaccggcccgauacugaccuugugggaggguaauccggggagguucuggaacaccaccaucgccgucucuaccgccaacaucuuccggggcagcuaccuugcaggggccggccuggcguucucccugaucaagaacgcccagacuccccgccgagguaccggcacugccggagagacgcucggcgagaaauggaagcgacagcugaacucacuggaccggaaggaguuugaggaguacaaacguaguggcauacucgagguggaccgaacggaggcaaagagcgcacugaaggacgguuccaagauuaagcaugcggucagcagaggguccagcaagauccgguggauaguugagcgcgggauggugaagcccaagggcaaggucguagaccuuggaugcggccgaggcggcugguccuacuacauggccacgcucaagaacgugaccgaagugaagggauacacuaaagggggcccgggccacgaggagccaauaccgauggcaaccuacggguggaaucuggucaagcugcacaguggcguggacguauucuauaaacccacggaacaggucgacacacuccugugugacaucggggagucuuccagcaacccgaccaucgaagagggccggaccuuaagggugcugaagaugguggagcccuggcuguccagcaaacccgaauuuuguaucaaagucuugaaucccuacaugccgaccgugaucgaggaacucgaaaagcuccaacgaaagcacgggggaaaucuggugcgaugcccccuguccaggaacagcacccacgagauguauugggucuccggcgccagcgguaauaucguguccucagucaacaccacuucgaaaaugcugcugaaucgcuucacuacccggcaccgcaagcccaccuacgagaaggacguggaucugggcgcggggacaaggagcguguccacggagaccgaaaagccugacaugacuaucauuggccgucgccuccagcgccugcaggaggagcacaaggagaccuggcacuaugaccaggagaacccguaccggacgugggcguaucacgggagcuacgaggcccccuccaccggcucagccucuagcauggucaacggcguggucaagcugcugacuaagcccugggaugucauaccgauggugacacagcuggcaaugacggacaccacccccuucgggcaacaacguguguucaaggaaaaggucgacaccaggacgccucagccuaaaccggguacaaggauggugaugaccacaacggcgaauuggcucugggcccuccugggaaagaagaagaacccccgucucugcacccgugaggaguucaucucgaaggugcggagcaaugccgcaaucggcgccgucuuucaggaggaacagggguggaccagcgcuucugaagccgugaacgacagccguuucugggagcucguggacaaagagcgggcccuacaucaagagggcaagugcgagagcugcgucuauaacaugauggggaaacgcgagaaaaagcugggggaguuuggccgcgccaaggggagccgagcuaucugguacauguggcucggcgcgcgcuuccuugaguuugaggcccuuggguuccuaaaugaggaucacugguucgggcgggaaaauucuuggagcggcguugagggcgagggcuugcaccgccuuggguauauccuugaagaaaucgacaagaaggacggcgaccugauguacgcugacgacaccgccggcugggacacgcguaucaccgaggaugaucugcagaaugaggagcugauuaccgagcaaauggcgccccaccauaagauccuggccaaggcgauauucaaguuaaccuaccagaacaaggucguaaagguacuccgccccaccccgcguggggcggucauggacaucaucucccgaaaggaccagcggggcuccggacaggugggcacguacgggcugaauacauucaccaacauggaggugcagcugauccgccaaauggaggccgagggcgugaucacgcaggacgacaugcagaaccccaagggucucaaggagcgggucgaaaaguggcuucgcgagugcggcguugaucggcugaagcgaauggcgaucagcggugacgacugcguugucaaacccuuggacgagcgguuugguaccagccuccuuuuucucaacgacauggguaagguacgcaaggacaucccccagugggaaccgucgaaaggguggaagaacuggcaggaggugcccuucugcucccaucacuuccacaaaaucuuuaugaaggauggacggagucucgucguaccuugucguaaccaggacgaacugauaggcagagcacgcaucagccaaggggcgggguggucccuccgcgaaaccgccugucuggggaaagccuacgcgcaaauguggagccugauguacuuccaccggcgcgauuugcggcuggccucuauggccaucugcagugcugugcccacggaaugguucccgacaaguagaacgaccugguccauccacgcccaucaccaguggaugacgacugaggacaugcuuaaggucuggaaccggguguggauugaggacaacccuaacaugaucgacaaaacgcccgugcacagcugggaggacaucccuuaccucggcaaacgagaggaccucuggugcgguucacugaucggccucagcucgcgggcgaccugggccaagaacauucacaccgcgaucacacagguccgcaaccugaucggcaaagaggaguacguagacuacaugccggugaugaagcgguacagcgcccccuccgagagcgaggggguccuguaa

SEQ ID NO: 26227 - RNA, 9867 nt, Artificial Sequence
  derived and/or modified CDS sequence (opt11) from DENV-4__KF041260__SS-prME
aguaccauuacccucuugugccugaucccaacggugauggccuuccauuuaucaacucgugacggugagccgcucaugaucguugccaagcaugagcgggggcguccgcuguuguucaagacuaccgaagggaucaauaagugcacgcuaauagcgauggaccugggggagaugugcgaagacaccgucaccuacaagugcccccuucuggugaacaccgaacccgaggauauugauuguuggugcaaccugacgagcgccuggguaauguauggcaccuguacccaauccggggaacgucggcgggaaaagcgcagcguugcucugaccccacacuccggcaugggucucgagacgcgcgcugaaaccuggaugagcagcgagggggccuggaaacaugcacaacgcgucgaaagcuggauucugagaaauccaggcuucgcccugcuagcuggguucauggccuauaugaucggccaaaccgggauacaacggaccguauucuuuauccugaugaugcugguggcgccaucuuacggcaugcggugcgugggcgucggcaaccgagacuuugucgagggcgugagugguggagcuugggucgacuuagugcuugagcauggggguugugugaccacaauggcccaaggaaagcccacccuggacuucgagcugaucaagaccacagccaaggaggucgcccugcuucguaccuacugcaucgaggcuucaauaagcaacaucacgacugcaacgcgcugucccacccagggugagccuuauuuaaaagaggagcaagaccaacaguauaucugccggcgugacgugguggaccggggcugggggaacggcugugguuuauuugggaagggugggguugugaccugcgcgaaguuuuccuguagcggcaaaauuaccgggaaucuaauacaaaucgagaaccuugaguacacgguggucgucaccgugcauaacggcgacacgcacgccgucggcaaugacacguccaaucacggggugacugcaacugugacgccucguucccccuccguggagguggaacuaccggacuacggcgagcugacccucgauugcgagccccggagcgggaucgacuucaacgagaugauucugaugaagaugaacaagaagaccuggcugguccacaagcagugguuccucgaccugccccuccccuggaccgcaggcgccgauacguccgagguccacuggaaccacaaagagcguauggucaccuucaaagugccccaugcaaagcggcaggacgugacuguucuggguucucaggagggcgccaugcacagugcccugaccggagccaccgaggucgauuccggggacggcaaccacauguuugccgggcaccugaagugcaaagugcgcauggaaaaacuccggaucaagggcaugagcuacaccauguguagcgguaaguuuagcauugacaaagaaauggcagaaacccagcaugggacgaccguugucaaaguaaaguacgaaggggcgggggccccuugcaagguaccuaucgaaauccgcgaugucaacaaggagaaggugguggggcguauaauuuccaguaccccguucgcggaaaacacuaacucggucacgaacaucgagcuugaaccgccguucggcgacuccuacaucgugaucggagugggggacucagcuuugacgcuacacugguuccgcaaggggagcagcaucgguaagauguucgagagcaccuaccgcggagccaagcggauggccauucucggggagacagcgugggauuucgggucugucggcggccugcuuaccagccucgguaaggccguacaccaaguguucggcucugucuauaccacaauguucgggggcgugagcuggauggugaggauucugauaggguuccucgugcuguggaucggcacuaacucccggaacacgucgauggccauguccuguaucgcggugggagggauuacacuguuccugggcuucaccguacacgccgacaugggaugcgcggucagcuggagcggcaaggagcucaagugcggcuccggcauuuuuauaauugauaacguacacacguggacggagcaauacaaauuccagcccgagagccccgcgcgccuggccuccgcaauacugaaugcgcacaaggaugggguguguggaauccggagcaccacccgacucgagaauguaauguggaaacagaucaccaacgagcugaauuacgugcugugggaaggcggucacgauuugacagucgucgcgggcgacguuaagggcgugcuguccaaggggaagcgggccuuggccccuccagugaacgauuuaaaguacucuuggaagaccuggggcaaagcgaaaaucuucacgcccgagacccgcaacuccacguuccugauagaugggcccgacaccagcgagugcccuaacgagcggcgagcguggaacuuccuggagguggaggauuacggcuuugggauguucaccacaaauaucuggaugaaauuccgugagggauccagcgaagugugcgaucaucgccucauguccgcggcgaucaaggaccagaaggccguccacgcggacaugggcuacuggauagagaguuccaagaaccaaacguggcaaaucgaaaaggcuagcuuaauagagguuaagaccugcuuauggcccaagacccacacccuuugguccaacgggguucuggagucccagaugcuuauccccaaagcguacgcggggccuuucagccaacacaacuaccggcaagguuacgccacccagaccaugggccccuggcaccuugggaaguuggagaucgacuuuggcgagugccccggcacuaccgucaccauccaagaggacugcgaccaccgcggucccagccugcgcacgacuaccgccucgggcaagcucgugacccaguggugcugccgcagcugcacgaugccgccucugcguuuucugggagaggauggcugcugguacgggauggagauucguccccucuccgaaaaggaagagaacauggucaagucccagguaagcgcgggccagggcacaagugagaccuucagcauggggcugcuuugccucacacuguucguggaagaaugucugagacggcgcguuacgcggaagcauaugauccucgucguggucacaaccuugugugccauuauacuaggcggccuaaccuggauggaccuacugcgcgcccugaucaugcugggaaacacgaugagcucacggaugggaggacagacccacuuagcuaucauggccguguucaagaugagccccggauaugugcucgggaucuuccugcgaaaacuuaccagcagggagaccgcgcucauggugaucggaauggccaugacaacagugcuaucaaucccgcacgaccugauggaguucauagacgggauuucgcucggcuugaucuuacuaaaaauggucacccacuucgacaacacacaggucggaacucucgcccugucguugacauucauaaagagcaccaugccccuggugauggcguggcgcacgaucauggccgugcuguuuguggucacacucauaccccugugccggacuuccugccuacaaaaacaaagccauuggguggagaucacggcccucaucuuaggggcccaagcacugccugucuaccucaugacucucaugaagggcgccucgaaacggagcuggccacuaaacgaggggaucauggcugugggccucguaaguuugcugggaagcgcccuacucaagaacgacguccccuuggcuggccccaugguggccggcggucuccuucuggccgcguacgugaugagcggcuccagcgccgaccucucccuugaaaaggccgccacgguucaaugggacgaaauggccgacaucacugggaguucgccaauuauugagguaaagcaagacgaggauggcagcuucuccauacgggacguggaagagacuaacaugauaacgcugcuggucaaacuugcgcugaucacggugaguggguuguacccauuagccaucccugugaccaugacacuuugguacauguggcaggucaaaacccagcgcuccggggccuuaugggacgugcccucgcccgccgccacgcaaaaggcgacgcucaccgaggggguguaccggaucaugcagcgcggauuauucggcaaaacccaagugggaguggggauucacauggaggggguguuccauacuauguggcauguuacgagaggcuccgugaucugccacgagagcggccgccuugaaccgucuugggccgacgugaagaacgacaugaucagcuacggaggaggguggcggcuuggcgacaagugggacaaggaggaagacguccagguacuagccguggagcccggcaagaacccgaagcacguccagacgaagccuggucucuucaagacccuuacaggagagaucggggccgugacgcuggauuucaaaccgggaaccucagguaguccuauaauaaaccgcaagggcaaggucaucggacucuacgguaacggcguuguuaccaagagcggggacuaugugagcgccaucacccaggcggaacggaucggcgaaccugacuaugaagucgacgaggacaucuuccgcaagaaaagacugaccaucauggaucugcauccgggcgcuggcaagaccaagaggauccucccguccaucgugcgugaggcguugaagcggcgacugcggacgcugauccuggcucccacccgcguggucgcagccgagauggaggaggcccugcggggccugccuauacgguaucagacgccggcggugaagaccgagcacacgggccgggaaauuguagaucucaugugccaugcgacguucacgaccagguugcugaguucgacacgcguccccaauuauaaccucaucgugauggaugaggcgcacuucaccgauccauccucuguggccgcucggggcuacaucaguacacguguagagaugggggaggcugccgcgauuuucaugaccgccacuccaccgggcaccaccgacccuuucccacagucuaacucccccaucgaggacaucgagcgcgagauaccggagagaagcuggaauacuggguucgacuggaucacggacuaccagggcaagacaguaugguuuguccccucgaucaaggcuggcaacgacauugccaacugucucagaaagagcggcaagaaggucguccagcugucccggaaaacauucgacaccgaguaccccaaaaccaagcucaccgacugggacuuuguagugacuaccgacauuagcgagaugggcgccaacuucagggcuggccgggugaucgacccccgccgcugucugaagccggucauuaucacggauggaccagagcgggugauacuggcagguccgauucccgucaccccagccuccgccgcccagagacggggcagaaucggccggaaucccgcacaggaggacgaccaauacguguucucuggggaucccuugcguaacgacgaagaccaugcgcacuggacggaggcaaagaugcugcuggacaacauccacacccccgaggguaucaucccaacuuuguucggucccgagcgggagaagacccaggccaucgacggcgaguuccgucugcggggcgaacaacgcaagaccuuuguggaacugaugcggcgcggggaccuccccguguggcuguccuauaaggucgccagugccggaauuagcuacaaggacagggaauggugcuucaccggggaacgaaacaaccagauccuggaggagaacauggaggucgagaucuggacccgcgagggugaaaagaagaagcuccgcccgaaguggcuggaugcacggguguaugccgacccgguugcccucaaagacuucaaggaguuugcgagcggccgcaagagcaucacacucgacauccugacggagauagccagucuccccacguaucucuccagccgggccaaacuggcccuagauaacaucgugauguuacacacaaccgagcgcggcggcaaggcuuaccagcacgcgcugaaugaguuaccugagagccuugagacccugaugcugguggcccucuugggggcaaugacggcggguauauuccucuucuuuaugcaagggaaggggauggggaagcuaucgaugggccuuaucgcgaucgcggucgccagcgguuuacuuuggguggccgagauucaaccgcaguggaucgcggccagcaucauccuugaguucuuucugauggcgcuucugaucccggaaccggaaaaacaacggacaccccaggacaaccaacugauuuacgugaucuuaaccauucugacgaucauuggccuugucgccgcuaaugagaugggucuaaucgaaaagacgaagaccgacuucggguucuaccaagugaagacagagaccacgauucuagacguggaccugaggccggcaagcgccuggacccucuaugcuguggccaccaccauucucacgccgaugcugcgucacacaaucgagaacaccucugcuaaccucucccuugccgcgauugccaaccaggcggcuguguugaugggccuggggaaaggguggccccuucaucggauggaccugggagugccacucuuggcgauggguugcuacucccaagucaacccuaccacacugaccgcgucccucgugaugcuacuggugcauuacgccaucaucggcccgggucuacaagccaaggccacccgcgaggcccagaagcggaccgccgccgguaucaugaagaauccuaccgucgacggaaucaccgugauagaccuugagcccaucucauacgaccccaaguucgagaagcaacuuggucaggucaugcuccuaguucucugcgcuggccagcuccuacugaugcgcaccaccugggccuucugugaaguguugacgcuggcuaccgggcccaucuugacacucugggaggggaaccccgggcgguucuggaauacuacgaucgccgugagcaccgcaaacaucuuccgugguuccuauuuggcgggagccggccucgcguucaguuuaaucaagaacacccaaacaccccggcguggaacggggacuaccggcgagacacucggcgagaaguggaagcggcaguugaacucucuggaccgcaaggaguuugaggaauacaaacggucuggcauauuggagguggaccgcaccgaggcgaaguccgcccuuaaagacggcagcaagaucaaguacgccguaucccgggggacaagcaagauccgcuggaucgucgagcgcggcauggugaagccgaagggcaaagugguggaccucggcuguggccggggcgggugguccuacuacauggccacacuaaagaacgucaccgaaguaaagggguacaccaagggcggucccggccaugaagaacccauaccgauggcgacauacggguggaacuuggucaaguugcacucaggcgucgauguuuucuauaagccaacagaacagguggauacacugcugugugauauuggcgagucaagcagcaacccuaccauagaggagggccggacgcuacgcguccugaaaaugguggaacccuggcugaguagcaagcccgaguuuugcaucaaggugcucaacccuuacaugccgacagugaucgaggagcuagaaaaacugcagcguaagcauggugggagccuagugcgcugcccauugucuagaaauuccacgcacgagauguacuggguaucuggaguauccgggaacauagucucgucugucaacaccacgucaaagauguuacucaacagauucacgacccgcuaccggaagcccaccuacgagaaagacgccgaccucggugcaggcacaaggagcguaaguaccgaaacggagaagccagacauggccaucaucggucggcgcuugcaacggcuucaggaggagcauaaggagaccuggcauuacgaccaagaaaaccccuaucgaacgugggcguaccacggcucguacgaagccccaucuacgggcagcgccagcuccauggugaacggcgucgugaagcugcuaaccaaaccgugggacgugauccccauggucacacagcuggccaugaccgacacaacccccuuuggccagcaacggguguucaaagagaagguugacacucggaccccacagccuaagccggggacccguaugaucaugaccaccacugccaacuggcucugggcgcuccucggcaagaaaaagaacccacgauugugcacgcgggaagaguucaucagcaagguacgcucuaacgccgccaucggggccguuuuccaggaggagcagggcuggacuuccgccagugaggcaguuaacgauucucgcuucugggaacuugucgacaaggagcgcgccuugcaucaagaggggaagugcgaguccugcguauacaacaugaugggcaagcgggagaagaagcucggcgaguucgggcgcgccaagggcagucgugccauuugguacaugugguugggagcccgauuccuggaguucgaggcccucggcuuccugaaugaggaccauugguuugggcgggagaacagcuggagcggcgucgagggcgagggucugcaccgguuaggguacauuuuggaggacaucgacaagaaggacggggaucugauuuacgccgacgacacagcaggcugggacacccgaaucacugaagacgaucugcugaaugaggaacugaucacugagcagauggcuccacaccauaaaauuuuagcgaaagccaucuucaagcugacguaccagaacaagguggucaagguacuucggccgaccccaaaaggugcagucauggacaucauaagccgcaaggaccagcggggcuccggacagguggguacguacggccucaacaccuucacgaacauggaggugcaacuaauacgccagauggaggccgaggggguuaucacccgagaugacaugcacaaucccaaaggccucaaggagcgcguggaaaaguggcucaaggagugcgguguggaucgucugaagcguauggcuaucagcggagacgacugcguagugaaaccccucgaugagcgauucagcacgagccuccuguuccugaacgacaugggcaaaguccgcaaggacaucccgcagugggaacccuccaaggguuggaagaacuggcaggaggugccguucugcagccaccauuuccauaagaucuucaugaaagacggcagguccuugguggugccgugccgaaaccaggacgaguugaucggucgggcucgcaucucccagggcgcaggauggucccuccgggaaaccgccugccucgggaaggccuacgcccaaauguggagccuuauguacuuccaccgacgggaccugaggcucgcuagcauggcgaucugcuccgccgucccuaccgagugguuccccaccagucgcacgaccuggagcauucacgcccaccaccaguggaugacuacagaggauaugcucaagguguggaaccgaguguggaucgaggacaaccccaacaugaccgacaagacccccguccacagcugggaggacaucccguaccugggcaagcgugaagaucuuuggugugguucacucauuggccugagcucucgggcaaccugggcgaagaauauucacaccgccauaacgcagguacgaaaccucaucgggaaggaggaguacguggacuacaugcccguuaugaagcgguauagcgcccccuucgaguccgagggcguauuauaa

SEQ ID NO: 26228 - RNA, 9867 nt, Artificial Sequence
  derived and/or modified CDS sequence (opt11) from DENV-4__FJ024476__SS-prME
uccaccauaacuuugcucugccuaauccccacuguuauggccuuccaccuguccacccgggacggugagccacucaugauuguagccaagcaugagcggggccguccccugcuguucaagaccaccgagggcaucaauaagugcacccuaaucgcgauggauuugggagagaugugugaggacaccguuaccuacaagugcccgcugcucgugaacaccgagccagaagacaucgacugcuggugcaaccugaccgccaccuggguuauguacgggaccugcacccagagcggggagcggcgcagagagaagcgcuccguggccuugaccccgcacucgggcaugggucucgagacccgagcagaaacuuggauguccagcgagggggccuggaagcaugcacaacgcguggaguccuggauccugcggaaucccggcuucgccuugcucgccggguuuauggccuauaugaucggccagacugggauccagcgaacuguauucuucgugcucaugaugcugguggcucccucguacggcaugcggugcgucgguguggggaaccgcgacuucguggagggugucuccggcggagccuggguggaucucguacuggagcacggcgggugugucacgaccauggcccagggcaagccgacccuggauuucgagcucacaaagaccaccgccaaagagguggccuuacuucggaccuacugcaucgaggccagcauuuccaacauaaccacagccacucgcugcccgacccagggggagcccuaccucaaggaggagcaggaccagcaauauaucugucgacgcgacgugguagaccggggcugggggaacggcuguggucuguucgggaagggcgguguggugacgugcgccaaguucucaugcuccggcaaaauaaccgggaaccugguccagauugagaacuuagaguacaccguggugguuaccgugcacaacggcgacacgcacgcaguuggcaaugacaccaguaaccacggcgucaccgccaugaucaccccgcgguccccguccguagaagucaagcugccggacuauggcgagcugaccuuggacugcgagccgcgguccgguauugacuucaacgagaugauucugaugaagaugaagaagaagaccugguuagugcacaagcagugguuucuugacuuaccccugccauggaccgcgggugccgacaccucugaggugcacuggaacuacaaagaacgcauggucaccuuuaaggugccgcacgcuaagcggcaggacguaacgguccucggaucccaggagggcgccaugcacagcgcccuggcgggcgccaccgaaguggacagcggggacggcaaccauauguucgccgggcaccugaaauguaaggugcgcauggagaagcuccgcaucaagggcauguccuacaccaugugcagugguaaguucuccaucgacaaggagauggccgagacccagcacgggacgaccgucgucaaggugaaguacgagggcgcuggggcgccuugcaaggugcccaucgagaucagagacguaaacaaggagaaggugguagggcggaucauaagcuccacuccccuggcggagaacaccaacagcgugacgaauaucgaguuagagccucccuucggggacuccuacaucguuaucggcgucgguaacagcgcucucacgcuacacugguuccggaaaggcuccagcauuggcaaaauguucgagucgacuuaucgcggcgccaagcggauggcgaucuuaggcgagaccgccugggauuucgggucggugggcggccucuucacgucccuaggaaaggccguucaccagguguucggaucuguguacacaaccauguuuggaggcguguccuggaugauccgcauccuuaucgggcuccugguacuguggauuggcaccaacucucguaacacguccauggccaugaccugcaucgcagucggagguauaaccuuguuccucggcuucaccgugcaggcggacaugggaugcgucguaagcuggucgggcaaagagcugaaaugcgggagcggcaucuucgugguagacaacgugcacacauggaccgagcaguauaaguuccagcccgagagccccgccaggcuggccuccgccauccucaacgcccacaaggacggugugugcgggauccggagcaccacacgccuggagaacgugauguggaagcagauaaccaacgagcugaacuacgugcucugggagggugggcacgaccugaccguggucgccggcgacguaaagggagugcugacaaaggggaagcgggcacucacgccgcccgucuccgaucugaaauauagcuggaagacgugggguaaggcccggaucuucacccccgaggcccggaacuccaccuuucugaucgacgggcccgacaccagcgagugcccaaacgagcgccgagccuggaauucccuugagguggaggauuacggcuucgggauguucacgaccaacaucuggaugaaguuccgcgagggcagcagcgagguuugugaccauagacugaugagcgcggccauuaaagaccagaaggcuguccaugccgacaugggcuacuggauagaguccagcaagaaucagaccuggcagaucgagcgcgcgaguuuaauagaggugaagacgugccucuggcccaagacccacacccuguggucgaacggggugcuggagagccagaugcucauccccaagagcuacgccggcccguuuucgcaacacaacuaccggcaaggguacgcuacccagacgaugggcccguggcaucuggggaagcuggagaucggcuucggcgaaugccccgggaccaccgucacaauccaagaggacugcgaccaccgaggcccgucucucagaaccaccacggccagcggcaagcuggugacacaguggugcugccggaguugcacuaugccuccucuucgguuccucggagaggacgggugcugguacggcauggagauacggcccuuaucagaacgcgaagagaacauggugaagucccaggugaccgccggccaggggacgagcgagacauucagcaugggucugcuuugccuuacccuguucguggaggaaugccuccggcgccgugucacucguaaacacaugauacugguggugguaaucacgcugugcgcgaucauucucgggggccugaccuggauggaccugcuccgggcccugaucaugcugggcgacaccaugucugggcgcaucggcgggcagauucaccuagccaucauggccguguucaagaugucccccgguuacguucugggggucuuccuccggaagcucaccagccgcgagaccgccuugauggugaucgggauggcgaugaccacggugcuguccauuccacacgacuugauggagcugaucgacggcaucagucuggggcucauccugcuaaagaucgugacucaguuugacaacacccaggugggcaccuuggccuuaucccuuaccuucauccggagcaccaugccccucgugauggccuggcgcacgaucauggccguccuguucguggugaccuugaucccccucugcaggaccuccugccugcaaaagcaaucucauugggucgagaucaccgcgcuaauccucggggcgcaagcccugccuguguaccugaugacgcuaaugaagggagccuccaggcggagcuggccgcugaacgaggguaucauggccgugggccuggucucccuccugggcagcgcgcugcugaagaacgacgugccccuagccggccccaugguagccggcgggcugcucuuggccgccuaugucauguccggaagcagcgcggaucugucccucgagaaggcugcgaacgugcagugggaugaaauggcugacaucaccggcagcucccccaucaucgaggugaaacaggacgaggacggcagcuuuuccauucgcgacguagaggagaccaauaugauuacgcuguuagugaaguuagcccuuaucacugugagcggucuguacccgcucgcaauccccgugaccaugacucugugguacauguggcaggucaagacacagcgauccggcgcccugugggacgugcccagucccgccgccacccagaaggccgcucucuccgagggcguauacaggaucaugcagcggggccuguucggcaagacacaggucggugugggcauccacauggagggggucuuccauaccauguggcaugugaccagagggagcgugaucugccaugagacgggccgccuggagccguccugggccgacguacggaacgacaugauaaguuacggggggggcuggaggcucggcgacaaaugggacaaggaagaggauguccagguccuggccaucgagcccgguaaaaaccccaaacauguccagacgaagcccgggcuguucaaaacacucaccggcgagaucggggcggugacccuggacuucaaaccgggcacguccggcucacccauaaucaaccggaaggggaaagugaucggccucuacggcaacggcgucgugacuaaguccggggacuacguuagugccaucacccaggcugagcgcauuggcgagccagacuacgaaguugacgaggauaucuuccggaagaagcgccucaccaucauggaccugcacccuggagccggaaagacuaaacggauccugcccuccaucguacgcgaggcacugaaacggagacuccguacccugauccuggcccccaccaggguggucgcggccgagauggaagaggcauuacgaggacugcccauacgcuaccagacuccggccguaaagagcgagcacacggguagagagauuguggaccugaugugccacgcgaccuucacaacccgucucuugaguaguacgagaguccccaacuacaaccugaucgugauggacgaagcgcacuucaccgaccccucguccgucgccgcacgcggcuacaucagcacccggguggagaugggggaggccgccgcgaucuuuaugacugcaacgcccccgggcgcuaccgaccccuucccucaaagcaacucccccaucgaggacauugagcgagagauuccggagagaagcuggaacacugguuuugacuggaucacugacuaccaggggaaaacggugugguucguaccaagcaucaaggccggcaacgauauagccaauuguuugcggaaguccgggaagaagguggugcagcuuagccgcaagaccuucgacacagaguacccgaagaccaagcuuacugacugggauuuugucgugacuaccgacaucuccgagaugggcgcgaacuuccgggccgggagagugaucgacccccggcgcugccucaaaccggugauucuaacugacggccccgaacgggugauucucgccgguccgaucccugugacgccggccagcgcggcccagcgcagggggcgcaucggccguaaccccgcccaagaagacgaccaguacgucuucucaggcgacccucuuaagaacgacgaggaucacgcacauuggaccgaggccaagaugcugcuggauaauauauacacccccgaagggaucauuccaaccuuauucgguccggagcgcgaaaagacgcaggcgaucgacggagaauuccggcugcgcggcgagcagcguaagaccuucguggagcugaugcgcagaggcgaucuccccguguggcugagcuacaaaguugccuccgcggggaucagcuacaaggaccgcgagugguguuucaccggggaacggaauaaccagauucuggaggagaacauggaggucgaaaucuggacccgggagggcgagaagaaaaagcuccgcccacgauggcuggacgcccggguguaugccgacccgauggcgcugaaggauuuuaaggaguucgccucaggccgcaagagcaucacauuagauauccuuaccgagaucgccagccugcccacguaccucagcucccgcgcuaagcuggcccuggacaacaucgucaugcuccacaccaccgagcgcggcggucgugcguaucagcaugcuuugaacgaguugccagagagccucgagacgcugaugcugguggcccuccugggggcuaugacagcugggaucuuccuguucuucaugcagggcaagggcaucggcaaacucucuaugggacugaucaccaucgcuguugcuuccggccuguugugggucgccgagauccagccgcaauggaucgccgcgagcaucauccuggaguucuuccugauggugcucuuaauccccgagcccgaaaagcagcggacgccccaggacaaucaguugauuuacgugauccucacgaucuuaaccauuaucgggcugaucgccgccaacgagaugggucucauagagaagaccaagaccgacuucggcuuuuaccaagucaagaccgagaccaccauccuggauguggaccuccggccggcguccgccuggacgcucuacgcgguagccacgaccaucuugacccccaugcugcggcacaccaucgagaacacgagcgccaaccucucccuggcagcuaucgcgaaccaggccgcgguccugaugggccugggcaaaggguggccgcugcaccgcauggaccugggcgugccacuccuggccauggggugcuacagccaggugaacccuaccacccugacugccucccucguuaugcugcuggugcacuacgcaauuaucggccccggccuccaggccaaagccacgcgggaggcccagaagagaaccgcggccgggaucaugaagaaccccaccguagacgguaucaccgucauugaucuggagcccaucagcuacgacccgaaguucgagaaacagcugggccagguaaugcuccugguucugugcgcuggccaguuacugcugaugaggacaaccugggccuuuugcgagguacucacgcuggccaccggacccauucugacucucugggaggggaaccccggccgcuucuggaacaccaccauagcggucucgaccgcuaacaucuuccgugggagcuaccuugccggcgccggccuggcuuucucccucaucaagaacgcgcagacgccccgucggggcaccgggaccaccggcgaaacgcugggcgagaaguggaagcgccagcugaacucgcucgacagaaaggaguucgaggaguacaagcgcagugggauccuggagguugaccggaccgaggccaaaagcgcgcugaaagaugguuccaaaaucaaacacgccgucagccgaggguccucuaagauccgcuggaucguggagcggggcaugguaaagccgaaagggaaggucguagaccucgguugcggucgcgggggcugguccuacuacauggccacucuaaagaacgugaccgaggucaagggguacaccaagggcgggcccgggcaugaggagcccaucccgauggcgacguacggauggaaccuagugaagcuccacucggggguggacguauucuacaagccgacagagcaggucgacacccugcugugcgauaucggagaaucaaguagcaaccccacaaucgaggaggggcggacacuucgcgugcugaagauggucgagcccuggcuguccucaaagcccgaguucugcaucaaggugcugaauccguacaugcccaccgucaucgaggagcuugagaagcugcagcggaagcauggcggcaaccuggugcgcuguccccucucccggaacucuacccacgagauguacugggucuccggggcuagcggcaacaucgugucuagcguaaacaccacgaguaagaugcugcugaaccgcuucaccacgcggcaccgcaagcccaccuacgagaaagacguggaccucggagccggcacgcggagcgucuccaccgagacagagaagccggacaugaccaucaucggccgccgucugcagcgccugcaggaagagcauaaagagacguggcacuacgaccaggagaaucccuaucggaccugggcauaccacggcucauacgaagcgcccaguaccggcagugccuccaguauggugaaugggguggugaaguuguugacaaagccgugggacgucauccccauggugacgcagcuggccaugaccgacaccacccccuucggccaacagcgcgucuucaaagagaagguugacacucggacgccacaaccgaagcccggaacgcgcauggugaugacaaccaccgcgaacuggcucugggcgcugcugggcaagaaaaagaacccgcggcucugcacccgcgaagaguucaucuccaagguccggagcaacgccgccaucggggccguguuccaggaggagcagggcuggaccagugcaucagaggcagugaacgacucacgcuucugggagcuaguggacaaggagcgcgcgcugcaccaggagggaaagugcgagagcugcguguauaacaugauggggaaacgggagaagaaguuaggagaguucgggcgcgcuaagggaagccgggccaucugguacauguggcucggcgcucgguuccuggaguucgaggcguuaggcuuccucaacgaagaccacugguucggccgggagaauuccuggagcgggguagagggcgaggggcugcaccgccucgguuacauacuggaagagaucgacaagaaggacggagaccugauguacgcggacgauacggccggaugggacacccggauaacagaggacgaccuccagaacgaggagcugauuaccgagcaaauggcgccccaucacaagauucuggcaaaagcuaucuucaagcucacguaccaaaacaaggucgugaaggugcugcgcccgacuccccguggcgccguaauggacaucaucagucgcaaggaccagcgggggagcggccagguggggacauacggguuaaacaccuucacaaauauggaggugcagcuuauccgccagauggaggccgagggcgucaucacucaggacgacaugcagaaccccaaaggucugcgagagcgcguggagaagugguugaaggagugcgguguggacaggcucaagcguauggccaucuccggggacgacugcguaguuaagccgcucgaugagcguuucggcaccucucuccucuucuuaaaugacauggggaaggugcgcaaagacauuccgcagugggagcccagcaaaggcuggaagaacuggcaagagguccccuucugcucgcaccacuuccacaagaucuuuaugaaggauggcaggagucugguggugcccugccgcaaccaggacgagcuuaucgggcgcgcccggaucagccagggcgcggguuggucgcugagagaaaccgcaugccugggcaaggccuacgcgcaaauguggagcuugauguauuuccaccggcgugacuuacggcuggcaucaauggccauuugcagcgccgugcccaccgagugguucccaacuucgcgcacaaccuggagcauucacgcccaccaccaauggaugacuacggaggacaugcugaagguguggaaucggguuuggaucgaggacaaccccaacaugaccgauaagaccccaguccauagcugggaggacauaccguaccuggggaagcgcgaggaccuguggugcgggagucuuaucggccugagcucaagggcaacgugggccaagaacauccacacggcgaucacccaagugcgcaaccugaucgguaaggaagaguacguggacuacaugcccgucaugaagcgguacagcgccccaucggagagcgaaggcguacucuga

SEQ ID NO: 26229 - RNA, 9867 nt, Artificial Sequence
  derived and/or modified CDS sequence (opt11) from DENV-4__GQ868579__SS-prME
agcaccauaacccugcucugcuugauccccacgauuauggccuuccaccuguccacccgggacggcgaaccgcucaugaucguggccaagcacgaacggggucgaccucugcuguucaagaccaccgaaggcaucaacaagugcacgcucauagcgauggaucugggggagaugugugaggauacagucacguacaagugcccccuacugaucaacaccgaacccgaggauaucgauugcuggugcaaccugaccagcacuuggguuauguacggaaccugcacccagucuggggagcgacggcgggagaagcgcagcguugcccugacgccgcacucgggcaugggucuggagacucgggccgagacauggauguccuccgagggggccuggaagcacgcccagcgcgucgagagcuggauucugcggaacccuggcuucgcguuacucgccggguucauggccuacaugaucgggcagacugggauacagcggacaguguucuucauucugaugaugcugguggcccccucauacggcaugcggugcgucggggucgggaaccgcgacuucguggagggcgucagcgggggcgcgugggucgaccucguccuggagcacggcgguugcgucaccaccauggcccagggcaagccaacccuggauuucgagcucacuaagaccaccgcuaaggaaguggcccugcugcggacguacuguaucgaggcccucaucuccaacaucacgaccgcgacacgcugcccgacccagggggaacccuaccucaaggaggagcaggaccaacaguacaucugccggcgcgacguggucgaucgagggugggggaacggcugcgggcuguuugggaagggcggggugguuacgugcgccaaguucagcugcuccggcaagaucaccgggaaccugguccagauugagaacuuggaguacacgguggucgucaccguucacaacggcgacacgcaugccguggggaaugacaccagcaaccacggcgucacggcgacaaucacgccacgcucacccagcguggaggucaaacuuccggauuacggcgagcucacccuggacugcgagccccgguccgggaucgauuucaacgaaaugaucuuaaugaagaugaagaagaagaccugguugguucacaagcagugguuccuugaccugccccuccccuggacggcaggcgcggacaccagcgagguccacuggaacuacaaggaacgcauggucacguucaaggugccucacgccaagcgucaggaugugacagugcugggcucccaggagggugcuaugcauagcgcccuggcuggcgccacugagguugacagcggggauggcaaccauauguucgccgggcaccucaagugcaagguccgcauggagaagcugcgcaucaagggcaugucuuacaccaugugcagcggcaaguucagcaucgacaaggaaauggcggagacacagcacgggacaaccgucgugaaggugaaguacgagggcgccggggcccccugcaagguccccauugaaaucagagacgugaauaaggagaaaguggugggccgcgugaucagcuccacaccccuggcagagaacacuaacucggugacgaauaucgagcuugagccgcccuucggggacuccuacauugucaucggcguuggcaacagcgcucuaacccugcauugguuucggaaaggguccagcauagggaagauguucgaauccaccuaucgcggggccaaacggauggcuauucucggcgagaccgccugggacuucgggagcgugggcgggcuguuuacuucccuggggaaggccguccaucagguguucggaagcguguacacuacaauguuugguggcgucuccuggaugauacgcauacucaucggauuuuugguccucuggaucggcaccaacagccggaacaccuccauggccaugaccugcaucgccgugggcgggaucacccuguuccucggcuucaccgugcgugccgacauggggugcguggugagcugguccggccgagagcugaagugugggagcggcaucuucgucguggacaacgugcacacauggaccgagcaguacaaguuccagcccgagucacccgcucggcuggccuccgccauccucaacgcgcacaaggacggcgucugcgggauccggucaaccacgagacuggagaacgugauguggaagcagaucacaaacgaacugaacuauguguugugggagggcggacacgacuuaaccguuguggcuggcgacgucaagggugugcugaccaagggcaaaagagcgcucacgccgcccguguccgaccugaaguacagcuggaagaccuggggcaaggccaaaaucuucacccccgaggcccgcaauuccacguuccuuaucgacgggccggacacgagcgagugcccuaacgagcggcgcgccuggaacucccucgagguggaggauuacggcuucgggauguucaccaccaacauauggaugaaguucagagaggguagcuccgaggucugcgaccaccgccugaugagcgcggcgaucaaggaucaaaaggccgugcaugccgacaugggcuacuggaucgagucguccaagaaccagaccuggcagaucgaacgggcaucccuuaucgaggugaaaacgugucucuggcccaagacccacacccuguggagcaacggggucuuggagagccaaaugcucauccccaaaagcuacgcugguccguucucucaacacaacuaccgccagggauaugcgacucagacugugggucccuggcaccuagggaaacuggaaaucgacuucggggaaugccccggcacgaccgugacaauccaggaagacugcgaccaccgcgggcccagccuccggacuacgaccgccagcggaaagcuggugacccaguggugcugccgcuccugcaccaugccaccccuacgguucuugggagaggacggcugcugguacgggauggagauccgaccacuguccgagaaggaagaaaacaugguaaagagccaagugacggccggccaaucaaccuccgagaccuucagcaugggccuccucugccugacccuguucguugaggagugccugagaaggagaguaacccgcaagcacaugauccuggccgucgugaucacccugugcgcgaucauucucgguggacugaccuggauggaccuucuucgggcccugaucaugcugggagacacaauguccggccgcaucggugggcagacgcaccuagccaucauggccgucuucaagaugagcccgggcuacgugcuggggguguuccugcggaagcucacaucacgcgagacugcacugauggugauuggcauggcgaugaccacgacccugagcaucccgcacgaucucauggagcugaucgacgggaucucccugggccucaucuuacugaagaucgugacccaauuugacaacacucaagugggcacgcucgcccugucguuaaccuucauccgguccacuaugagccucguaauggccuggcgcaccaucauggccgugcuuuucgucgugacacugaucccccucugucggacguccugccugcagaagcaaucucacuggguggaaauuaccgcccugaucuuaggggcgcaggcccugcccguguaccucaugacccucaugaagggcgccucccggcgaucuuggccccuaaaugaggggauuauggcugugggccuggucucccuccuggggagugcgcugcucaagaacgacgugccgcuggccgguccaaugguugccggcggguuacuccuagccgccuacgucaugagcggcucaagcgcugaccuaagucucgagaaggccgcuaacguccagugggaugagauggccgacaucacugggagcucucccaucaucgaggugaagcaggacgaggacggcucguucuccauccgcgacgucgaggagacuaacaugaucacccugcuggugaagcucgcccucaucaccguuagcgggcuguacccccucgcaaucccggucacgaugacucugugguauauguggcaagugaagacccaacgguccggcgcacugugggacgugcccucccccgccgccacccagaaggccgcgcuauccgagggcgucuaccgcaucaugcagcgagggcuguuugggaagacccagguggggguaggcauccacauggagggggucuuccacacaauguggcaugugaccaggggcagcguaauuugccacgagaccggccgcuuagaacccuccugggccgacguccggaacgacaugaucagcuaugggggcggcuggcgccucggcgacaaaugggaucgggaggaggacgugcagguucuggccauugagccgggcaagaaucccaagcacguccagaccaagcccggucuguucaagacccuaaccggugaaaucggggccgugacccuggacuucaagcccggcaccuccggcagcccgauaauuaacaaaaagggcaaggugaucggccuguacgggaacggcgucgugacaaaguccggggauuauguaagcgccauuacgcaggccgagcgcaucggcgagcccgacuacgaaguagaugaggacaucuucaggaaaaagagacucacaaucauggaccugcacccaggggccggcaagaccaagcggauacugccauccauugugcgcgaggcccuaaaaaggcgccuccggacgcugauccuggcccccacccgcguggucgcggccgaaauggaggaagcgcuccgcggccugcccauccgcuaccaaacgccagccguaaagagcgagcacaccgggcgagagaucguggaccugaugugccacgccacguucaccacccgccugcucaguucgacgcggguucccaacuacaaccucaucguuauggaugaggcgcacuucacggaccccagcuccguggcagcccgcggcuacauaagcacccgugucgagaugggggaagccgccgccauauuuaugaccgccaccccaccgggcgccaccgacccguucccccaauccaacagcccuaucgaggauaucgagcgcgagauucccgagagaucuuggaauaccggguuugacuggaucaccgacuaccagggcaagaccgugugguucgucccgagcaucaaggccggcaacgacaucgccaauugucuccggaaauccgggaagaaggugauucagcugucccgcaagaccuucgacaccgaguacccgaagaccaaacuuaccgacugggacuucgugguaacaaccgacaucuccgagaugggugcgaacuuccgggcgggcagaguaauagacccccguagaugccucaagcccguuauucuuaccgacggcccggagcgggucauucuggcgggucccaucccggugacgcccgcaucagcugcccaacgccggggccgcaucgggcggaauccagcccaggaggacgaccaguacguguucucaggggacccccuuaagaacgacgaggaccacgcccacuggacagaggccaagaugcugcuggacaauauauacacccccgagggcauuauccccacccucuuugggccggagcgcgagaagacccaggcgaucgauggcgaguuccggcugcgcggcgaacagcggaagacguucgucgagcugaugcgccgaggggaccuccccguguggcugucguacaagguggccuccgccggaaucucauacaaggaccgggaguggugcuucaccggagagcggaacaaccagaucuuagaggagaacauggaggucgagaucuggacacgcgagggggagaagaagaagcuccggcccagguggcuggacgcccgaguguacgccgaccccauggcccugaaggauuucaaggaguucgccuccgggcguaagucgaucaccuuagacauccugaccgagaucgcaucccugccuacguacuugagcagccgcgccaaacuugcccuggacaacaucgugaugcuccacacuacggagcggggcggcagggcguaccagcacgcccugaaugagcugccugagucuuuagagacccugaugcuugucgcauuacugggggccaugacggcgggcaccuuccuguucuucaugcaggggaagggcauagggaaguuauccaugggccugaucaccaucgcuauggccuccggccugcucuggaucgcugagauccagccacaguggaucgccgcgagcaucauccuugaguucuuucugauggugcucuugaucccggagcccgagaagcagagaaccccgcaagacaaccaacugaucuacgucauccucacuauucuagccaucaucgggcugauagccgccaacgagaugggccucauugagaagaccaaaaccgauuucggguuuuaccaggucaagaccgagaccaccauccuggacguggaccugcgccccgccuccgcuuggacgcucuacgccguggccaccacaauucugacuccgaugcuucgccacaccaucgagaauacaagugccaaccucuccuuggccgcaauugcaaaccaggcugccguccugaugggccucgguaagggcuggccacugcaccgcauggaccucggcgugccccuguuggcaauggggugcuacagccagguuaaccccacaacgcugaccgcgucccucgucaugcugcuggugcacuacgccaucaucggccccggucuccaggccaaggccacccgggaggcgcaaaagcgcacggccgcaggcaucaugaaaaaucccaccguggacgguaucaccgucaucgacuuagagccuaucucauaugaucccaaguuugagaaacaacuuggacaggugaugcuccugguacugugugccggacagcuucugcucaugcggacgacgugggccuucugcgagguccucacgcuggcgaccgggccgauccugacccuuugggaaggaaaccccggccgauucuggaacacgaccaucgccgugaguacugccaacaucuuccgaggcagcuaccuggccggagccgggcuggcguucucccugaucaagaacgcccaggcaccccgccggggcacagguaccaccggcgagacucugggcgagaaguggaaacgccagcugaacagccucgaccggaaggaguucgaagaguacaaacgcuccgguauccuggagguggaccgaaccgaggccaagagugcccugaaggauggcaguaagaucaaacacgcgguuagccgcggguccucgaagauucgcuggaucguggagcggggcauggugaagccaaaggggaaggucguggaccucggcuguggaaggggcgggugguccuacuacauggcaacccugaagaacgugacggaagucaagggauacaccaagggcgggccgggccacgaggagcccauccccauggcgaccuacggguggaaccuggugaaacuucacuccgggguggacgucuucuacaagcccaccgagcaaguggacacguuacugugcgacaucggcgaaagcagcagcaacccgaccauugaggaggggcggacccuccgcgugcuaaagauggucgagcccuggcugucuagcaaacccgaguucugcaucaaggugcugaaccccuauaugccgaccgugaucgaggaguuggagaaacugcagcguaaacacggcgggaaccuggugcgcugcccccucucccggaacucgacgcaugaaauguauuggguguccggugccagcgggaacaucguguccuccgucaauaccaccuccaagaugcuguugaaccgcuuuaccacgcggcaccgcaagccuaccuacgagaaggacgucgaucucggagcgggcacccgcagcgucagcacugaaacugagaagccagacaugaccauaauagggcgccgguuacaaaggcugcaggaagaacacaaggagaccuggcacuacgaccaggagaauccauaccgaacgugggccuaccauggcagcuacgaggcccccuccacggggagcgccuccagcauggugaacggcguagucaaguuauugaccaagccuugggacgugaucccgauggugacccagcuggcgaugaccgacacaacccccuucggucagcagcgcgucuuuaaggagaagguggacacccggacaccccagcccaagccggggacucgcaugguuaugacuacaaccgcgaauuggcucugggcccugcugggcaagaagaaaagcccccggcucugcacgcgggaggaguuuaucucaaagguccggagcaacgccgcaaucggggcgguguuccaggaggagcaaggauggaccucggcgagcgaagccgugaaugacucccgcuuuugggagcuggucgacaaggagcgugcacugcaccaagaagggaagugcgagagcuguguguacaacaugauggguaagcgugagaaaaaguuaggcgaguucggucgcgccaagggcucccgggcgaucugguacauguggcugggugcgcgcuucuuggaguucgaggcacucgguuuucugaacgaggaccacugguucgggcgggagaacagcugguccggcguggagggggagggguugcaccgucucggcuacauccuggaggaaauagacaagaaggacggggaccugauguacgcugacgacaccgccggcugggacacccggaucaccgaggacgacuuacaaaacgaggaacugaucaccgagcagauggcgccccaccacaagauacuggccaaggccaucuuuaagcucaccuaccagaacaaagucgucaaagugcugcgccccaccccuagaggggccgucauggacauaauuagcagaaaggaucagcggggguccggccagguggggaccuacggccugaacacguucacuaauauggagguacaacucauccgccagauggaagccgagggggucauuacccaggaugacaugcagaaccccaagggucugaaggagcggguggaaaacuggcugcgcgagugugguguggacagacucaaacgcauggcgaucagcggggacgauuguguagugaaaccuuuggacgagcgguucggcaccucccuucuguuccugaacgacauggggaaagugcgcaaggauaucccacagugggaaccgagcaagggcuggaagaacuggcaggagguccccuucugcucccaccacuuucauaagaucuucaugaaggacgggcguagccugguagugcccugccggaaucaggacgaguuaaucggcagagcccggaucucccagggcgccggguggagccuccgcgagacggccugcuugggcaaggccuacgcgcagauguggucgcucauguacuuccaccggcgagaccugaggcuggccucaauggccauaugcagcgccguacccaccgagugguucccgacgagucgcaccacauggagcauacacgcgcaccaucaauggaugaccaccgaagacaugcucaaaguguggaaccggguauggaucgaggacaauccuaauaugaucgacaaaacuccaguacacuccugggaggacauucccuaccuggggaagcgagaggacuuauggugcggcagccuuauugggcuguccagccgagcgacgugggccaagaacauccacaccgccaucacccaggugaggaaccugaucggcaaggaagaguacguggacuacaugccggucaugaagcgguacuccgcccccucggagucagagggcguucucuga

SEQ ID NO: 26230 - RNA, 9867 nt, Artificial Sequence
  derived and/or modified CDS sequence (opt11) from DENV-4__GQ868580__SS-prME
agcaccaucacccugcucugccugauacccacgaucauggcguuccaccucuccacccgcgacggcgagccauuaaugaucguggccaagcacgagcgugggcgcccacugcuguucaagaccaccgagggcauaaacaaauguacgcugaucgcgauggaccugggggagaugugcgaggacaccgugaccuacaaguguccccuguuaaucaacacugagcccgaggacauagacugcuggugcaaccugacgagcaccugggugauguacggcacgugcacccaauccggggagcggcgccgggagaagcgcagcguggcccugacgccgcacuccggaaugggccuugagacccgggcagagacguggaugagcucggagggggccuggaagcaugcccaacgcguugagagcuggauccugcggaaccccggguucgcccuucucgccggguucauggccuacaugauaggccagaccgggauccaacgcacgguguucuucguguuaaugaugcucgucgcccccucauacggaaugcggugcguggggguggggaaccgcgauuuugucgagggcgugagcgggggcgcauggguggaccuuguccuggagcauggcgggugugugacuacuauggcccagggcaagcccacccuggacuuugaguugacuaagaccaccgcaaaagaagucgcccugcugcggaccuacugcaucgaagcccucaucuccaacaucacgacggcgacccgcuguccgacccaaggggaacccuaccugaaggaagaacaagaccagcaguauauaugucggagggacgucguggaucggggcuggggcaacggcuguggccuguucgggaagggcgggguggucacgugugccaaguucagcugcuccggcaagaucaccgggaaccucgugcaaaucgaaaaccuggaguacaccgugguggugaccgugcacaacggcgauacucacgccgucggcaacgacaccuccaaccauggagugaccgcuacgaucacuccccgcucgcccagcgucgaggugaagcuaccggacuacggcgaauugacccucgacugugaaccgcgaagugggaucgacuucaacgagaugauucugaugaagaugaagaagaagacuuggcucgugcacaagcagugguuccuggacuugccccuccccuggacugccggcgcagacaccagcgaggugcacuggaacuauaaggagcgcauggugacguucaaggugccgcacgccaagcgacaggaugucaccgugcuggggucccaggagggcgccaugcacucugcccuggccggcgcgaccgagguggauaguggcgacgggaaccacauguucgcgggccaccucaagugcaagguccgcauggagaagcugcgcaucaagggcaugagcuauaccaugugcuccgggaaguucucuaucgacaaggaaauggccgagacgcaacacggcaccaccguggugaaggucaaguacgagggcgcgggggcccccugcaaggugcccauugaaauccgcgacguuaacaaggagaaggucguagggcgcaucaucaguaguacaccccuagcggagaacacgaacuccgugaccaacaucgagcucgagccgcccuucggggacuccuacaucgucaucgguguuggcaacagcgcucugacucuucacugguuucggaaggggucaucaaucgguaagauguucgagucuacauaucggggcgcaaagcguauggccauccucggcgagacagcgugggacuucgggagcguagggggccuguucacaucccuggggaaggccguccaccaaguguucggcagcguguauacuaccauguuuggaggcgucucuuggaugauccgcauccuaauaggguuucuggugcuguggaucgggacaaacucacggaauaccuccauggccaugacaugcauagccgugggcgggaucacccuguuucucggcuucaccguccaggccgacaugggcugugucguguccugguccgggcgcgaacugaagugugggagcggcaucuucgucguggacaacguacauaccuggacagagcaauacaaguuccagcccgaaagccccgcucggcuggcgucggcgauccucaacgcccacaaggauggugucugcgggaucaggagcacuacgcggcuggagaaugucauguggaagcagaucacgaacgagcugaauuauguguugugggaaggcggccacgaucugaccgugguggccggcgacguuaaaggcguccugaccaaggggaagcgcgcgcucacgccgcccguguccgaccuuaaguauagcuggaagaccuggggcaaggcaaaaauuuucacccccgaggcccggaacuccacguuccugaucgacgguccugacacgagcgagugcccgaacgaacgacgggccuggaacucccuagaaguggaggacuacggcuucggcauguucaccacuaacauuuggaugaaguuccgcgagggcagcuccgaagucugugaccaccggcuaaugagcgccgcgaucaaggaccaaaaggcaguucacgccgacauggguuacuggauagaguccagcaagaaccaaaccuggcaaaucgagcgggccuccuugaucgaggugaaaacgugccucuggcccaagacccacacgcuguggagcaacgggguccuggagucccaaaugcucauacccaaaucuuacgcgggccccuucagucagcacaacuaccgacagggauacgccacccagaccgugggccccuggcaccuggggaagcuggagaucgacuucggagaguguccggguacaacugugacgauacaggaggacugcgaccacagggggcccagccuccgcacuacgacggccucggguaagcuggucacccaguggugcugucgguccuguaccaugccgccacugcgcuuccucggcgaggacggcugcugguaugggauggaaauccggccccugaacgagaaggaggagaauaugguuaagucucaagugacggcaggccaguccacgagcgaaaccuucuccauggggcuucucugccugacgcuguucgucgaagagugcuuaagacgcagagucacgcggaaacacaugaucuuagccgucgucauuacgcugugcgcgaucauccucggaggccuuaccuggauggaccugcuccgcgcccugaucaugcucggggacacaaugagcggcaggaucggcgggcagacacaucucgccaucauggccguguuuaaaaugucgcccgguuauguccuggggguguuccugcgcaagcucaccagccgggagacagcgcugaugguuauuggcauggcgaugacgacaacguucuccaucccucacgaccucauggagcucaucgaugggauaagccugggccugauccuccugaagaucgucacccaauucgauaacacccaggugggcacgcuggcccucuccuuaaccuucauucgcucgaccaugagucucgucauggcguggcguaccaucauggccgugcuuuucgugguaacgcugaucccucugugucgcaccagcugccuccaaaagcaaagucacugggucgagauuaccgcacugauacugggggcgcaagcccugccaguguaucugaugaccuuaaugaaaggcgcgucacggagaucguggccccucaacgaggggaucauggcaguuggcuuggucagcuuguuggguuccgcgcugcugaaaaacgacgugccacucgccgggcccaugguggccggcgggcuucugcucgccgcauaugucaugagcggcagcuccgcggaccugagcuuggagaaggccgccaacguccagugggacgagauggccgacauuacgggguccucccccaucauugaggugaagcaggacgaggauggcuccuuuagcauucgggacgucgaggagacaaacaugaucacccuccuggugaagcuggcccucaucaccgugucgggguuguaccccuuagcgauaccgguaacgaugacccucugguacauguggcagguaaagacccaacgcagcggcgcccugugggacguacccucccccgccgcuacccagaaggccgcgcugagcgagggaguguaccggauaaugcagcgcgggcuccugggcaagacccaagugggggucggcauccacauggagggggucuuccacacaauguggcacgugacccggggcuccgucauaugccacgagacaggcagacuggagcccagcugggccgacguccgcaacgacaugauaucuuacgggggcggguggcggcuuggcgacaagugggaucgcgaggaggacguacaggugcuggcgaucgagccgggcaagaaccccaaacacguccagaccaagcccgggcuauucaaaacccucaccggcgagaucggggccguaacccuggauuucaagcccggcaccagcggguccccgaucaucaaccggaagggcaaagugauuggccuguacgggaacggugucguaacuaagagcggcgacuaugugucggccauaacccaggccgaacgcauaggagagccagacuaugagguagacgaggacaucuuccggaagaagcgccuuaccaucauggacuuacaucccggggccggcaagaccaaaaggauccuaccgagcaucgugcgcgaggcccucaagcgucgcuugcggacuuugauccuggcacccacacgcguggucgcggcugaaauggaagaagcguugaggggccucccaauacgcuaucagacgcccgccgugaaguccgagcacacaggccgggagaucguggacuugaugugccacgcgacguucaccacccgccuccuuagcagcacccggguaccgaacuauaaccucaucgugauggacgaggcgcacuucacggaccccuccucuguggccgcccgcggcuacaucuccacucggguagagaugggggaggccgccgccaucuucaugaccgccacgccgcccggugccaccgacccguucccccagagcaacagucccauagaagacaucgaacgagagauacccgagagaaguuggaacacaggguucgacuggaucaccgacuaccagggcaagaccgucugguucguccccuccauuaaggcaggcaacgacauagccaacugccuuaggaaaagcgguaagaagguuauccagcuguccaggaagacauucgacaccgaguaccccaagacaaagcugaccgacugggacuuuguggucacgaccgauaucagcgagaugggggcgaacuuucgugccggucgcguaaucgacccccgccgcugccuaaagcccgugaucuugaccgacggucccgagcgcgucauucuggccgguccaauccccgugacuccugccuccgcggcccagagacggggccguaucggccggaacccugcccaagaggacgaucaguauguuuucaguggugacccccucaagaacgacgaggaucacgcgcacuggacggaggccaagauguugcuggacaacauauacaccccagaggguaucaucccuacccucuucgggcccgagcgcgagaagacccaggcgaucgacggcgaguuccgguugcgcggcgagcagcggaagaccuucguagagcugaugcgccggggugaccuccccguguggcuguccuacaagguagcaucugccggcaucuccuacaaggaucgcgagugguguuucaccggggagcggaauaaccaaauccuggaggagaacauggagguugagaucuggacacgagaaggcgagaagaagaaacuuaggcccagauggcucgacgcccgcguguacgccgaucccauggcguugaaggacuuuaaggaguucgccagcgggcggaagucgaucaccuuggacauccuuaccgaaaucgccagccugccgacguauuuguccagccgggccaagcuggcucuggacaacaucgucauguugcacacuaccgaaagaggcgggcgggcguaccagcacgcccugaacgaguugcccgagagccucgagacacugaugcucguagcccuccuuggggccaugaccgccgggaucuucuuguucuucaugcaggggaagggaaucgggaaacucuccaugggccugaucaccaucgccauggccagcggccuccucuggauagcggagauacagccccaauggaucgcagcguccaucauucuggaguuuuuccugauggugcuccugaucccggagcccgagaagcaacggacaccccaggacaaccagcugaucuacgugauacucaccauuuugacgaucaucggguugaucgccgccaacgaaaugggccucaucgagaagaccaaaacagacuucggguucuaccaggucaagaccgaaacgaccauccuugauguagaucugcgccccgccucagcguggacgcucuacgcgguagccaccacgauccugacccccauguugaggcacaccauugaaaacaccagugccaaccucucucuggccgccaucgccaaccaggccgcgguccugaugggccucgggaaaggcuggcccuugcaccggauggacuugggggugccgcuccucgccauggggugcuacucccaggugaacccaacuaccuugacagccagccucgucauguugcuggugcauuacgcgaucaucggcccggggcuccaggccaaggccacccgugaagcccagaagcgcacggcggccggcauaaugaagaaccccaccguggacgguaucacugucaucgaccuggagccuauauccuacgaccccaaguucgagaagcagcugggccaggugaugcucuuggugcugugcgccggccaguuguuacugaugcggaccacgugggccuucugcgagguccuaacccuggccaccgggcccauucugacccucugggagggcaaccccgggcgcuucuggaauaccaccaucgcggugagcacugccaacaucuuucgggguucuuacuuggccggugccgggcuggccuucucgcucaucaagaacgcgcagacuccccgccggggcacggggacgaccggcgagacccugggggaaaaguggaagcgccaguuaaacucccucgaccggaaggaguucgaggaguacaagcgcagcgggauacuagagguugaccggaccgaagccaaauccgcccugaaagauggcagcaagaucaagcacgccgucuccagggggagcucaaagauacgcuggauuguggagaggggaauggugaaaccuaaaggcaaggucguugaccucggcuguggccgcggcggcuggagcuacuauauggccacacugaagaacgugaccgaggucaagggguacacaaaaggcgggccggggcacgaggagccaauccccauggcgaccuacggguggaaucuggugaaacuucauagcggcguggacgucuucuacaagcccacggaacagguggacacgcuguugugcgacaucggcgaguccaguuccaaccccaccaucgaagaggggcggacccuccgcguccugaaaauggucgaacccuggcugucgucaaagccagaguuuuguauuaaagugcugaaccccuacaugccgacggugauagaggagcucgagaagcugcagcggaagcacgguggcaaucuaguacgcugcccgcucagcagaaauuccacccacgaaauguacugggugagcggcgccaguggaaacaucgugagcuccgucaauacgacaaguaaaaugcuguuaaaccgguucacgaccaggcaucguaagcccacguacgagaaggacguggaucucggggccgguacccggucagucagcacggagacggagaagcccgacaugaccauaaucggccgccggcugcagcgccugcaggaggaacacaaggaaaccuggcacuacgaccaggagaacccguaccggacgugggccuaccacggcuccuacgaggcgcccagcaccgguucggccagcuccauggugaacggcguggucaaguugcugaccaagcccugggacgugaucccaauggugacccagcuggcuaugacggacacaacuccauucggccagcagcgcguuuucaaggagaagguggacacccggacgccccagccgaagccggggaccaggauggugaugaccaccacggcuaacuggcucugggcccugcucggcaagaaaaagucaccccggcucugcacacgcgaggaguucaucagcaagguccggucuaacgcugccaucggggcaguguuucaggaggagcaggguuggacuagcgccuccgaggccgugagcgacuccagguucugggagcuggucgacaaggaaagggcgcugcaccaggagggcaagugugaaagcugugucuacaacaugaugggcaagcgggaaaagaagcucggcgaguucgggcgcgccaagggcucccgggccauuugguacaugugguuaggggcucgcuucuuggaguucgaggcccucgguuuccugaacgaggaccacugguucgggcgggagaacagcugguccgggguggagggcgaggggcuccaccgccucggcuacauccuugaagagaucgacaagaaggauggggaucugauguacgcugacgacaccgccggcugggacacacguaucaccgaggacgaucuucagaacgaggaacugauuaccgagcagauggccccgcaucauaaaauccuggcuaaggcgaucuuuaagcucaccuaccagaacaagguaguaaagguguuacgccccaccccgaggggcgccgucauggacaucaucagcaggaaggaccagcgggggagcggacaggugggaacguauagccugaacaccuucacuaacauggagguucagcucauccgccagauggaggccgagggcgucaucacccaggacgacaugcagaaccccaagggccugaaagagaggguagaaaacuggcuucgcgagugcggcguugaccgccugaagagaauggcgauaucgggcgacgacugcgucgugaaaccccuggacgaacgguucgggacgucacuacucuucuugaacgacaugggcaaggugcguaaggacauuccccagugggagccguccaagggguggaagaacuggcaagaaguacccuucugcagccaucacuuccacaagaucuucaugaaggacgggcgaucacugguggugcccuguaggaaccaggacgagcuaaucgggcgggcccggaucagccagggugcgggguggagccugagagagaccgccugcuuggggaaggcuuacgcccaaauguggagucucauguacuuccaccggcgcgaccugcggcuggcgucgauggcuaucugcuccgccgucccgacugagugguucccuaccagccgcaccaccugguccauucacgcccaccaccaauggaugacgacggaagauauguugaagguuuggaaccgggucuggauugaggacaauccaaacaugauugacaagacgccuguccacagcugggaggacauccccuaccugggcaaaagggaagaucuguggugcggaucccucaucgggcuuagcucccgggcgaccugggccaagaacauccauacugcgaucacccaggugcgcaaccugaucgggaaagaggaauauguagacuauaugccggucaugaagcgauacagcgcccccuccgagagcgagggcgugcucuga

SEQ ID NO: 26231 - RNA, 9867 nt, Artificial Sequence
  derived and/or modified CDS sequence (opt11) from DENV-4__GQ868583__SS-prME
ucgacgauaacgcugcuuugucucauccccaccgucauggcguuucaucucucgacgcgggacggggaaccccugaugaucguagcaaaacacgaaagagggcgcccacuacucuucaaaacaacggaagguauaaacaaaugcacccucauagcaauggaucucggggaaaugugcgaagauacagucacguauaaaugcccccuguuagucaauacugaaccagaggacauagacugcuggugcaaccugacgaguacgugggucauguaugggaccugcacccaaucaggggagcgccgacgugaaaagcgaucggucgcacugacaccacacucaggcaugggacucgaaacacgcgcagaaacguggauguccucagaaggagccuggaaacaugcccagcgagucgaaucauggauccugagaaacccgggguucgcgcuacucgcuggguucauggcauacaugaucggucaaacugggauacagcgcacaguguucuuuguacugaugaugcucguagcgcccaguuacggaaugagaugcguuggugucggaaaccgcgacuuuguagaaggagugaguggaggcgcauggguggacuuaguacuagaacacggagggugcgucaccaccauggcccaagggaaacccacccuagacuucgaguugacgaaaacaacggcgaaagagguagccuuacugcggacauacuguauugaagcacugauaucgaacauaacgaccgcaacgcgcugcccaacccaaggggaaccguaccucaaagaagaacaagaccaacaauacauaugccgacgcgacguuguugauaggggauggggcaacgguuguggauuauucgggaaagguggaguugugacaugcgccaaauucucgugcuccgggaaaauuaccgggaaccuaguacaaauugagaaccuagaauacacgguugucguaacaguccacaauggcgauacacacgcagucggaaaugacaccaguaaucacgguguuacggcgaccaucaccccgcgaagcccaaguguggagguaaaauugccugacuacggcgaacuuacgcuggacugcgagccacgcagcggcaucgacuucaaugagaugauacuuaugaaaaugaagaagaaaaccuggcucguccacaaacaaugguuucuggacuuaccauuaccguggacaaccggagcagacacuucagaggugcacuggaacuacaaagagagaaugguaacauucaaagugccacacgcgaaacggcaagaugugacaguccuagguucacaagagggggcaaugcacuccgcgcucgcgggcgcaacggaggucgacucaggagaugggaaucacauguucgccggacaccuaaaauguaaggugcgaauggaaaaacuucggauaaagggaaugagcuacaccaugugcucggguaaauucucuauagauaaggaaauggccgagacacaacacggcacgacaguagugaaggugaaauacgaaggagcgggagcaccgugcaaagugccaaucgaaauaagagacguaaacaaggagaaaguggucggaagagugaucucugcgacgccacuggccgaaaauacgaauaguguaacgaacauagaacuggaaccaccguucggcgacaguuauauaaugaucggcguggggaacucggcccugacauugcacugguucagaaagggcuccucaaucgguaagauguucgaaagcacguacaggggcgcgaagaggauggcgauccuuggcgagacugccugggacuucgggaguguaggcgggcuauuuacuucgcuuggcaaggcaguucaucaggucuucgguagugucuacaccacaauguucgggggagucagcuggaugauacgaauccucaucggguuccuaguacuauggauaggaaccaacucaaggaauacguccauggcaaugaccuguauagcagugggcggcauaacccuguucuuaggauucaccgugcaggccgacaugggguguguggugaguuggagcggccgugagcucaaaugcgguaguggcauauucguaguagacaauguacacacguggacagaacaauacaaguuccagccggaaaguccggcccggcuagccucggcaauccugaacgcccacaaagacggcgucugcggaauacgcaguacuacccgccuagagaaugugauguggaagcaaauaaccaaugaacucaauuauguauuaugggaaggagggcaugaccucacaguagucgccggugauguaaaggggguccugacaaaggguaagcgcgcccucgcgccacccgccucggauuuaaaguacagcuggaaaaccuggggaaaagccaagauauucacuccggaagcacggaacucaacguuccuaauagacggaccagauaccagcgaguguccgaacgaaaggagagcauggaauagcuuugaaguugaagacuauggauucggcauguucacgaccaacaucuggaugaaauucagagaagggaguucagagguaugcgaccaucgccuaaugucugcagccaucaaagaccagaaagcaguacacgccgacaugggauacuggaucgaaaguagcaagaaucagacauggcaaauagaacgggcaucgcuaauagaggugaaaacgugccuuuggccgaaaacgcacacgcuguggucaaacggcgugcuagaaucccaaaugcugaucccaaaaucguacgcagggcccuucagccaacacaacuaucgccaagguuaugcgacccaaacaguagguccuuggcaccucggcaaacucgaaauagacuucggagaauguccgggcacuacaguaacaauccaggaagacugcgaucaucgaggaccaagccuacggacaaccaccgcaagcggaaaauuaguaacccagugguguugccgaagcugcaccaugccgccgcugagauuccucggcgaggauggaugcugguaugggauggagauacgcccucuuucggagaaggaagagaacauggugaaaucccaaguuacagcaggccaaggcaccagcgaaacuuuuucaaugggauuacucugccugacacuuuucguagaggagugucuucggcgucgggucacgagaaagcauaugauucuagccgugguaauuaccuugugcgcuauuauccugggcggucuaacauggauggaccuauuacgugcacugauaaugcuaggcgacacaaugucaggacgaauaggagggcagacacaccuagccauaauggcugucuucaaaaugucgcccggcuaugucuugggaguauuccugcgcaagcuaacgagcagagaaacugcccuaauggugauaggcauggccaugacgacaacacuaagcauaccacacgaccucauggaauugauugacggcauuucgcuaggccuaauucuccugaaaaucgucacacaguucgacaauacacaaguugggacgcucgcacucucucuaacguucauccgaucaacgaugucauuagugauggcauggaggacaaucauggcagucuuauucgucgucacccuuauaccguugugucgcacuucgugucuccagaagcaaagccacuggguagagauaacagcucuaauacugggggcacaggcacucccagucuauuugaugacguuaaugaaaggcgcgagcaggcgauccuggccacucaacgaaggaaucauggcggugggcuugguuagcuuauuaggcucagcccugcugaaaaacgaugugccccucgccggcccaaugguggcaggaggccugcuccucgccgccuacguaaugagcgguucaagcgcggaccugucccucgaaaaggccgcuaauguacagugggaugagauggccgauauaacaggcucgaguccaaucauagaaguaaagcaagacgaagacgggaguuucaguaucagggauguugaggaaacaaacaugauaacgcugcuugugaaguuggcccucaucacagucagcggccuauacccgcuagcgauaccagugacgaugacacuaugguacauguggcaggucaaaacccaaagauccggggcacuaugggacgugccaagcccagcugcaacucagaaagccgcacuaagugaaggcguguacaggauaaugcaaagaggcuuauuuggcaaaacacagguaggaguggguauacacauggaggguguguuccacacaauguggcacguaacucgagggagcguaaucugccacgaaacaggcaggcuagaacccagcugggcagacguaaggaaugauaugaucagcuacggaggcggguggcggcuaggggacaagugggauaaagaagaagacguccaaguacuggccauagaacccggcaaaaaccccaaacacgugcaaaccaagccgggccuguucaaaacacuuacaggggaaauaggggccguaaccuuagauuuuaagccgggcaccuccgguagcccaaucaucaaucgcaagggcaaaguuauaggauuauacggaaacggcgucgucacaaaaagcggggacuauguaagcgcaaucacacaggcagaacggauaggagagccagauuaugaaguggaugaggauaucuuucgaaagaaacgacucacaaucauggaucuucacccgggagcaggcaagacaaagcgcauacucccgucaaucgugagggaggcccugaaacggagauuacgcacacuuauacucgccccaacccguguagucgcggcugagauggaggaagcacuacgcggacucccuauccgauaccaaacucccgcgguaaagagcgaacauaccgggcgagagaucguagaccucaugugccacgccaccuuuacgacaagauuacucucgagcacgcgagucccaaacuauaaccuaauuguaauggacgaggcccacuucacagauccaucaucgguugcugcacgcggguacaucuccacaagaguagagaugggggaagcagcagcuaucuucaugaccgccacaccgccaggggccacggaccccuucccacagagcaauucccccauagaggauaucgagcgcgagauccccgagcggaguuggaacacaggguucgacuggauaacagacuaccaaggaaagacaguaugguucguaccgucaauaaaagccgggaaugauauugcgaacugcuuaagaaaaagcggcaaaaaggucauccaacucucccgcaagacguucgacacagaauacccgaaaaccaagcuaacggacugggacuucguaguaaccacggacaucagcgaaaugggggccaacuuccgagcggguagggucaucgauccacgaagaugccugaagcccgucauccuaacagacggcccagaaagggugauccucgcaggcccaauaccggucacccccgcaagcgcagcgcagcgacgcggucgcauaggaagaaaccccgcacaagaagacgaccaauauguuuucagcggcgacccccuaaagaacgaugaagaucacgcacacuggacggaagcuaaaaugcuauuagauaacauauauaccccugagggcaucauaccaacgcuauucgggcccgagagggagaaaacacaggcuauagacggggaguuccgccugcggggagagcaaaggaagacuuuugucgaacugaugcgacgcggagaccugcccgucuggcugagcuauaagguagcaagcgccggcauuagcuacaaagacagagaaugguguuuuacgggagaaaggaacaaucaaauacuggaagagaauauggaaguagaaauauggacgagagaaggggagaagaagaaacuacgccccaaauggcucgacgcccgggucuacgccgacccgauggcauuacaagacuucaaggaguucgcaucaggaagaaaaucaaucacccuggauauccucacagaaauagcaucgcucccaacauaccucagcagccgggcaaagcucgcacuggacaacauagugaugcuacacacaacugagagaggcggccgggccuaccagcaugcucuaaacgaacucccggagagucuggagacgcuaaugcuaguagcccuccugggagcaaugacugcagggaucuuccuguuuuucaugcaagguaaaggcaucggcaaacuaaguaugggacucauaacaaucgccguggcaucaggacuacuauggguagccgagauccaaccccaauggauagcggcguccauaauacuugaguucuucuuaaugguauuacucauuccugagcccgagaaacaaaggacaccccaagacaaccaacuaauauacguaauccugacaauucuuacaaucaucggacucauugccgcaaacgaaaugggacuaauugagaaaacaaagacagacuucggcuuuuaccagguuaagacagaaacaacaauacucgacgucgaccugcgacccgccuccgccuggaccuuauacgcgguugcgacaacaauauugacgccuaugcucaggcacaccaucgagaacaccagcgcaaauuugucguuggcggcaauagccaaucaggcggccguacuaauggggcucgggaagggauggccgcuucacagaauggaccuggguguuccccuccuugcuaugggaugcuacagccaagucaaccccacuacuuuaacugcgucccuggucauguugcugguccauuacgcaaucaucggaccaggccuucaagcaaaggcaacgcgugaagcccaaaaacggacagcagcggggaucaugaaaaaccccaccgucgacgggauuacaguaauugaucuagaaccgaucagcuacgaccccaaauucgagaaacaacuuggccaagugauguugcuaguacucugugcaggccaauuacuauugaugaggacaacgugggccuucugcgaaguucuaacccuggcgacaggaccaauucuaacauugugggaagggaauccggggcgauucuggaacacgacaauagcugucaguaccgcaaacauuuucagaggcucguaccuggcaggcgcgggucucgccuuuagcuuaaucaaaaacgcccagacaccccgccgcggcaccggcaccacaggcgaaacgcuaggggagaaguggaaacgacagcuuaauucgcuagaccgaaaagaguucgaagaauacaaacguagcggcauucuagaaguagaccggacugaagcaaaguccgcguugaaagaugggucuaagauuaaacacgcggugucucggggaucgagcaagauacgauggauaguugagcgcggaauggugaagccuaagggaaaagucguagaccuuggaugcggccgaggcggaugguccuacuacauggccacacuuaagaaugucacagaggucaaaggcuacacgaaagggggccccgggcacgaggaacccauuccaauggcaacauacgguuggaacuuagugaaacuccauaguggcguggacguguucuacaaaccaacggaacagguggacacacucuuaugugacauaggagagagcucuagcaaccccaccauagaagaaggacguacacuccgaguguuaaaaauggucgagcccugguuaucuaguaaaccagaguucugcaucaagguccuaaaccccuacaugcccacggucauagaagaacuugaaaagcugcagcguaagcacggugggaaccugguccggugcccccuaagcagaaauucgacucaugaaauguacugggucagcggugcaagcggaaacauagucaguagugugaacacgacgagcaaaauguuacuuaaccguuuuaccacccgacaccgaaagccuaccuaugaaaaggacguggaccuaggcgcgggcacccgcucuguaagcacagaaacagaaaaacccgacaugacuauuaucggcagaaggcuacaacgacuacaagaggaacauaaagaaacauggcacuacgaccaagaaaauccauauagaaccugggccuaccacggaaguuaugaggcgccgucgaccggaagcgcguccagcaugguuaaugguguggucaagcugcuuacaaaacccugggacguaauaccaaugguuacgcaacuggcgaugacugacaccacgcccuuuggucagcagagaguuuucaaggaaaaagucgauacgcgaaccccucaaccaaaacccggaaccagaauggugaugacgaccacggcaaacuggcuaugggcgcuauugggcaagaagaaaaacccuaggcuuugcacucgggaagaguucauaucaaaagucagaucaaaugccgcaaucggggcgguauuccaagaagaacaggguuggaccagcgcaagugaggccgugagcgacucaagauucugggaguuagucgacaaagagagggcgcuacaccaagaggggaaaugcgaaucgugcgucuacaacaugaugggcaagcgcgagaagaaacuaggcgaguucggccgggccaaggguagucgagccaucugguacauguggcuaggagcccgauuucuagaguuugaagcgcuaggauuccugaacgaggaucacugguucggccgagaaaacagcuggaguggggucgagggggaagggcuccacagauuaggauacauucucgaagaaauagacaaaaaggauggagaucuaauguaugcugacgacaccgccggaugggacaccagaauuacggaggacgaccuucagaacgaagaguuaauuaccgaacaaauggccccgcaccacaaaauauuagcaaaggcaauauuuaaacucacauaccagaauaagguggucaaaguccuccgacccacaccaaggggcgcugucauggacauaaucagucguaaagaccaacgcgggaguggacaaguaggaacguacgggcuaaacacguucacaaacauggaaguccaacucauacgccagauggaggcagaagggguaauaacucaagacgacaugcagaacccgaaaggccucaaagaacgugucgagaagugguugagggaaugcggagucgaccgcuugaaaagaauggcaaucuccggugaugacugcguggucaagcccuuggacgaaagguucggaacuucccugcuuuuccucaacgacaugggaaagguacgaaaggacaucccacagugggaacccagcaagggcuggaaaaacuggcaagagguaccauucugcucccaccacuuucacaagauauucaugaaagacggucgcuccuuggucgucccgugccgaaaccaagacgaacugauagguagagccagaauaagccagggagcaggcuggucucuccgugagaccgcaugccuuggcaaggcauacgcgcaaauguggagccuaauguacuuccaucgcagggaccuacgacuggccuccauggccaucugcucggcgguaccgacagaaugguuuccgacuagccgaaccacguggucaauucaugcgcaccaucaguggaugacgacggaggacaugcucaaggucuggaaccgcguuuggauagaggacaauccaaacaugaucgacaaaacgccagugcacaguugggaagacauacccuauuuagggaaaagagaagacuuauggugugguucccucauaggacucucuucaagagcuacaugggcgaaaaacauccacacagccaucacccagguucggaaccucauaggcaaggaagaauacguagacuacaugccaguaaugaagcgguacucugcccccuccgaaagcgagggcguucuguag

SEQ ID NO: 26232 - RNA, 9867 nt, Artificial Sequence
  derived and/or modified CDS sequence (opt11) from DENV-4__GQ868584__SS-prME
agcaccaucacccuguuaugccugauccccacaguuauggccuuccaccuguccacccgcgacggcgagccccucaugauugucgccaagcacgagcgagggcggccucugcuguucaagaccaccgaaggcaucaacaagugcacgcucaucgcgauggaccugggugagaugugcgaggacaccgugaccuacaagugcccacugcucgucaacaccgagcccgaagauaucgacugcugguguaaucuaacgagcacaugggucauguacgggacauguacccaauccggggagcggagacgggagaagcgcagcguggcccugacgccgcacagcggcaugggccucgaaacucgggccgagaccuggaugagcuccgaaggggcauggaagcacgcccagaggguggaaaguuggauccuccgcaaccccggcuucgcguuacucgccggguucauggccuacaugaucggccagaccgggauucagcguacgguauuuuucgugcuuaugaugcuuguggcacccuccuacggcaugcggugcgucggagugggaaacagggacuuuguggagggcgucagcgggggcgcguggguggacuuggugcuggagcacggcgggugcgucacaaccauggcacaaggcaagccaacccuggacuucgagcucacgaagaccaccgccaaggagguggccuuacugcguaccuacugcaucgaagcucucaucuccaauaucacgaccgcgaccaggugcccgacgcagggggagcccuaccugaaggaggagcaggaccggcaguacaucugccgccgggacguggucgaucggggcugggggaacggcugcggccuguuuggaaagggcgggguggugacuugcgccaaguuuagcugcuccggcaagauuaccgggaaccucguccaaaucgagaaucuggaguacaccguggugguuaccgugcacaacggcgacacgcacgcugucggcaacgacaccagcaaccacggggugaccgcaaccaucacgccccggucccccagcguugagguaaagcugccggauuacggcgagcucacccuggauugcgagccccgcuccgggaucgacuucaacgaaaugauucugaugaagaugaagaagaaaaccuggcuuguccauaagcaaugguuccuggaccugccucugcccuggacgaccggggccgacaccuccgaggugcacuggaacuacaaggagcggauggucaccuucaaaguaccgcacgcgaagcgccaggacguuacgguccuugggucccaggagggcgccaugcacagugcgcuggccggggccaccgaaguggacagcggugacggcaaucacauguucgcggggcaccucaagugcaaggugcgcauggaaaagcugcggaucaaaggcaugucuuacacgauguguagcggcaaguuuuccauugacaaagagauggccgagacgcagcacgguaccaccguagugaaggugaaauacgagggcgccggggcccccugcaagguccccaucgagauacgcgacgugaacaaggagaagguggucggccgggugaucagcgcgacgccccucgccgaaaacaccaacucagugaccaacaucgagcucgagccucccuuuggagacucuuauaucaugaucggcgucggcaacagcgcacucacuuuacacugguuccgcaaggggucgucaauaggcaaaauguucgagagcacuuaccgcggggccaagcgcauggcuauucucggcgagaccgcgugggacuucgggucggucggcggccuguuuaccagccuggggaaggcugugcaccaggucuucggcaguguguacaccacgauguucgggggcguuuccuggaugauacggauacuuaucgguuuccugguccuauggaucgggacuaauucccgcaacacgagcauggccaugacgugcaucgcagugggcgggaucacgcuguuucucggcuucaccguucaggccgacauggggugugucguguccugguccggccgcgaacugaagugcggguccgggaucuucguggucgacaacgugcacaccuggacagaacaguacaaauuccagcccgagagcccggcgcgcuuggccagcgccauccucaacgcccacaaggacggcguguguggaauucggucaacgacccgccuggagaaugugauguggaagcagaucacaaacgagcugaacuacgugcucugggagggcgggcacgaccuuaccguggucgcuggggacgugaagggcguguugacgaaagggaaacgggcguuagccccgcccgccagcgaccuaaaguacagcuggaaaacguggggcaaggccaagauauucacccccgaggcccgcaacagcaccuuccucauugacgggcccgacacguccgaaugccccaacgagcggcgcgcguggaacagcuucgaggucgaggauuacggauucgggauguucaccaccaacaucuggaugaaguuucgggagggcuccucagaggugugcgaccaccgccucaugagugccgccaucaaggaccagaaggcaguacacgcggacaugggcuacuggauugagagcuccaagaaccagacuuggcagauagagcgggccagcuugaucgaagucaagacaugccuguggcccaaaacccacacccucugguccaauggggugcuagagagccagaugcugauccccaaguccuaugccggcccguucagccagcacaacuaccgccagggguacgccacccagaccguggggcccuggcaccucgggaagcuggagaucgacuucggagagugcccuggcacgaccgucaccauucaggaggauugcgaccacagggggccaucccuacgaaccacgaccgccucaggcaagcucguuacucaguggugcugccgcucuuguaccaugccgccccugcgguuccugggggaggacggcugcugguacgggauggagauccgcccccucuccgagaaggaagagaacauggugaagagccagguuaccgcgggccagggaaccuccgagaccuucagcaugggacugcugugccuaacguuauucguggaggaaugccugcggcgcagagucacgcgcaagcacaugauucucgccguggugaucacccuaugcgccauuaucuugggagggcucacauggauggaccugcugcgggccuuaaucaugcugggagacacaauguccggccgcaucggaggccagacgcacuuagccauaauggcggucuucaagaugagcccgggguacgugcucggcguguuccugcggaagcugaccucccgcgagaccgcccucauggucaucgguauggccaugacgacgacccugagcaucccgcacgaccugauggagcucaucgacggcaucucccugggccugauccucuuaaagauuguuacccaguuugacaacacccaggucggcacccuggcauuaagucugaccuucauccggucgaccaugagccuggucauggcguggcgaaccaucauggcggugcucuucguggugacucugaucccucugugccgcacauccugccuccagaagcaaagccacuggguggagaucaccgcccugauccugggggcccaggcacuccccguuuaccugaugacccugaugaaaggggcgagccgccggagcuggccccuuaacgagggcaucauggccgucgggcucgugagccuguuggguagcgcccugcugaagaacgaugugccccucgcaggcccaauggucgccgguggccugcugcucgcggccuacgucauguccgggagcagugccgaccugucccuggagaaggccgccaacguacaaugggacgaaauggcggauaucacgggcagcagccccaucaucgaggucaagcaggacgaggacgggagcuucuccauucgcgaugucgaggagaccaauaugaucacccuccuagugaagcuggcauugaucacggucagcggccuguacccacuagccauuccggugaccaugacccucugguacauguggcaaguaaagacccagagauccggugcccugugggacgugcccagccccgcagcgacccagaaggccgcuuuaucagagggggucuaccgcaucaugcagcgggggcucuucgggaagacccaggugggggucgggauccacauggagggcguguuccacacgauguggcaugugacacgcggcagcgugauuugucacgagaccgggcgccuagagcccuccugggccgacgugcguaaugacaugaucagcuacggcgggggguggcgccucggagacaagugggacaaggaggaagacgugcagguccucgccaucgagcccgggaaaaaccccaagcacgugcagaccaagcccggccuguucaagacgcuaaccggcgagaucggcgcggugacacucgacuucaaacccgggacguccggaagcccgaucaucaaccggaagggcaaggucauugggcuguauggcaacgggguggugacgaaauccggcgacuacgugagcgccaucacccaggcagagaggaucggggagccggacuacgagguugacgaggauaucuuccggaaaaagcgccugaccaucauggacuuacacccaggcgccggcaagaccaagcggauccugccguccaucgugcgcgaggcgcugaagcgccgacugcggacgcugauccucgccccaacccgcgucguggcugcugagauggaggaggccuugcgagggcuccccaucagguaccagacccccgcgguuaaaagcgagcacaccggccgggaaaucgucgaccugaugugccacgccacuuucacuacacgccuucucuccagcacccgugugccgaacuacaaccucaucgugauggaugaggcacacuucacggaccccucauccgucgcugcccgcggcuacaucuccacccggguggagaugggugaggcggccgccaucuucaugaccgccaccccccccggcgccacggacccguucccccaguccaacagccccauugaggacaucgagcgugagauccccgagcgcuccuggaacacaggcuucgacuggaucacagacuaccagggaaagaccgucugguucgugccgucuaucaaggcggggaacgacaucgccaacugccugcggaaguccggcaagaagguuauccagcucucgcgcaagacguucgacaccgaauaccccaagacuaaacugaccgacugggacuucgucgugacgaccgacaucuccgagaugggggcgaacuuccgggcgggccgugugaucgaccccagacgcugccugaaacccgugauccuuaccgaugggccggaacgggugauccuggcgggccccaucccugugacucccgccagcgccgcccagcgccggggcaggaucgggaggaacccggcccaggaagacgaucaguacguguucuccggagauccacugaagaaugaugaggaccaugcgcacuggacggaggccaagauguugcuugacaacaucuacacccccgaggggauuauacccacccuguucggcccggaacgcgagaagacccaggccaucgacggcgaguuccggcuccgcggggagcagcgcaagacguucguggagcugaugcggcggggcgaccuccccguauggcucagcuacaaggucgccuccgcugggauuagcuacaaggacagagaguggugcuucacaggcgagaggaacaaucagauccuggaggagaacauggagguggagaucuggaccagggagggagagaagaagaagcuacggcccaaauggcucgacgcgaggguguacgcagacccaauggcccugaaggacuucaaggaguucgccucggggcgcaagagcauaacguuggacauccucaccgagaucgccucccugccgacuuaccugagcucccgcgcgaagcucgcccuggacaacaucgugaugcugcacacaaccgagcgcggcgggcgagccuaccagcacgcccucaacgagcugcccgagagccuggagacccucaugcugguggcgcugcuaggcgcuaugacggcagggauuuucuuauucuucaugcagggcaaggggaucggcaagcugagcaugggccucaucaccaucgccguggccuccggguugcugugggucgcagagauucagccccaguggaucgcagccagcaucauccucgaguucuuccugauggugcugcuuaucccggagccagagaagcaacgaaccccgcaggacaaccagcugaucuacgugauccugacgauccucacgaucaucggguuaauugcagccaacgagauggggcugaucgagaagaccaagaccgacuucgguuucuaccaggucaagaccgaaacgaccaucuuagacguggaccuaaggcccgcuuccgccuggacccuguacgccguggccaccacgauacucaccccgaugcugcgccauacuauagaaaacaccucggccaaccugucccucgcggccaucgcgaaccaggccgccguccuaauggggcucggcaagggcuggccucuccaccggauggaccugggggugccacugcuggcuaugggcugcuacagccaggugaauccuacgacccugaccgccucccuggucaugcuccugguccacuacgcuaucaucgggccuggcuuacaggccaaagcgaccagggaggcgcaaaaacguaccgccgcuggcaucaugaagaaccccaccguggacgggauuaccgugaucgacuuagagcccaucagcuacgaccccaaauuugagaagcagcugggccaggugaugcugcucgugcugugcgccgggcagcugcuccugaugcgcaccacaugggcguucugcgagguccucacccucgccaccggacccauccugacucugugggaggggaacccaggccgguucuggaacacgaccaucgccguguccacggccaacauauuccgcggcagcuaccucgccggggcggggcuggccuucucccugaucaagaacgcccaaacgccuaggcgcggcacaggcaccaccggggagacgcucggcgagaaguggaagcggcaguugaacagccuggaccggaaggaguucgaggaguacaagcgcucgggcauauuggagguggacagaacagaggccaagagugcccugaaggacggguccaagauaaagcacgcggucucccgaggcuccagcaagauccgcuggauaguggagcgcgggauggugaagcccaaaggcaaggucguugaccuggggugcggccggggcggguggaguuacuauauggccacgcuuaagaacgucaccgaggucaaaggcuacaccaaggggggcccugggcacgaggagccgauccccauggccaccuacggcuggaauuuggugaaguugcacucaggcguggaugucuucuacaaacccacggaacagguggacacccuccugugcgacaucggggaaucguccagcaacccgacaaucgaagagggccgcacacugcggguccucaagauggucgagcccuggcuguccagcaagccugaguucugcauuaaggugcuaaacccauacaugccgacggugaucgaggagcuggagaagcuccagcgcaagcauggggguaaccugguucguuguccccugucccgcaacagcacccacgagauguacuggguguccggugccucgggcaacaucguuuccagcgugaacaccaccucgaagaugcuccucaaccgguuuacaacccgccaccggaagcccacauaugagaaagacgucgaccugggcgcggggacccgcagcgucuccacggagaccgagaagcccgacaugaccaucaucggccggcgccugcagcgucugcaggaggagcacaaagagaccuggcacuacgaucaggaaaacccguaccgcacgugggccuaccacgggagcuacgaggcacccuccaccggcucugcuuccagcaugguaaacggcgugguaaagcuccucacgaagccuugggacgugauuccgauggugacucagcuggcuaugacagacaccacgcccuucggccagcagcgggucuucaaggagaagguggacacacgcacgccccaacccaagccgggcaccaggauggugaugaccacgacggcgaacugguuaugggccuuacuagggaagaagaagaauccacgcuugugcacacgggaagaauucauuucuaaaguccgcagcaacgcggccaucggugccguuuuccaggaagagcagggguggaccagcgcguccgaagccgucagcgacagucgguucugggagcucgucgacaaagagagagcccugcaccaggaaggcaagugcgagagcugcguguacaauaugauggggaagcgcgagaagaagcuaggggaguucggcagggccaaagggucccgcgccaucugguacauguggcucggcgcgcgguuccuggaguuugaggcccugggguuccucaacgaggaccacugguucggccgcgagaacagcugguccggcguggagggagagggccuccaucgacugggguacauccucgaggagaucgacaagaaggauggagaccugauguacgcagacgacaccgccggcugggacacgcggaucaccgaggacgaccugcaaaacgaggagcucaucacugagcagauggcgccccaccacaagauccuugccaaggccaucuucaagcugaccuaucaaaacaaggucgugaaggugcuccggcccaccccgcgcggggccgucauggauauuauuagccggaaggaccagcgcggcuccgggcaggugggcaccuacgggcugaacaccuucaccaacauggagguacagcuuauccggcagauggaggccgagggcguuaucacccaggacgacaugcaaaaccccaagggccucaaggaacgcguggagaaaugguugcgggagugcgggguggacagacugaagcggauggcgaucagcggcgacgacugcgucgugaaaccccucgacgagcgcuucgggaccucccuguuguuccucaacgacauggggaaggugcggaaggacaucccccagugggagccgagcaagggguggaagaacuggcaggagguccccuucugcucccaccacuuccacaagaucuuuaugaaggacggcaggucccugguugugcccugccggaaucaggacgagcuuauuggcagagcacgcauaucccaaggggcagguuggagccuccgggagaccgcuugccuugggaaggccuacgcgcagauguggucccugauguacuuccacagacgggaccuccggcuggccagcauggcgaucugcucugcgguccccaccgagugguuuccgaccucccgaacgaccuggagcauacacgcccaccaccaguggaugaccaccgaggauaugcugaagguguggaaucgcguguggauagaggacaaccccaauaugaucgacaagacgcccguacacucuugggaggacauccccuaccucgggaagcgggaggaccuguggugcgggagucugaucggccucuccucacgcgcgaccugggccaaaaacauccacacggccauuacccaggugagaaaccugaucgggaaggaggaguacguggacuacaugccggucaugaagcgcuacucugccccaagcgaguccgagggggucuuguga

SEQ ID NO: 26233 - RNA, 9867 nt, Artificial Sequence
  derived and/or modified CDS sequence (opt11) from DENV-4__GQ868585__SS-prME
agcaccauaacacuguuaugcuuaauacccacugugauggccuuucaccuguccacucgcgacggugagcccuugaugaucguagccaagcacgagcgagggcgcccccugcuguuuaagacaaccgaggggaucaacaagugcacgcuuaucgccauggaucugggggagaugugcgaagacaccgugaccuacaagugcccccuacucgugaacaccgagcccgaggacaucgacuguuggugcaaccugacgucuaccugggugauguacgggaccuguacccaauccggggagcgacgccgggagaaacgaucuguggcccuaaccccacauuccggaaugggccucgagacccgggccgagaccuggauguccucggagggugccuggaagcaugcccagcgcguugagagcuggauccuccggaacccuggcuucgcuuuacucgcaggguucauggccuacaugaucggccagaccgggauccagaggacggucuucuuugugcuaaugaugcuuguggcccccuccuacggcaugcggugcgucggcgugggaaaccgcgacuucguggagggugucagcgggggugccuggguggaccucgugcuggaacacggcgggugcgugaccacuauggcucagggcaagcccacccuggacuucgaacucacgaagaccaccgccaaggagguggcccugcuaagaaccuacugcaucgaggcccugaucucgaauaucaccaccgcgacccguugcccgacacagggggagcccuaucucaaggaagagcaggaccagcaguacaucuguaggcgcgacgugguagaccggggcugggggaacggcugcggccuguucgggaagggcggagugguaacgugcgcuaaguucagcugcuccggcaagaucaccggcaaccucgugcagaucgagaacuuagaauacaccguaguugucaccguucacaacggcgacacccaugcagugggcaacgauaccagcaaccacgggguaaccgccacuaucacgccccgcucccccaguguggaggucaagcugccugacuacggcgagcucacguuggacugcgagccccgguccgggaucgauuucaacgagaugauacugaugaagaugaagaagaagaccuggcucguucauaaacagugguuccuggaccugccgcucccauggaccaccggugccgacacgagcgaggugcacuggaacuacaaggaacguauggugaccuuuaagguaccgcacgcgaagcggcaggacgugacgguccuggggucccaggagggcgccaugcacucugcccuggccggggccacugagguagauagcggggacgagaaucacauguucgcgggucaccucaagugcaaaguucgcauggagaaacugcgcaucaaggggaugaguuauacgaugugcucgggaaaguucucgauugacaaggaaauggccgagacccagcacggcacgaccgucgugaagguuaaguacgagggggccggggcccccugcaagguacccaucgagauccgggacgugaacaaggaaaagguggucgggcggguuaucagcgcuaccccucuggcugagaacaccaauuccgugaccaacaucgagcuugagccucccuucggagacucuuacaucgucaucgggguaggcaacuccgcccuuacucugcacugguuccggaagggcucuagcaucgggaaaauguucgagagcacguacagaggcgcuaaacggauggccauucucggcgagaccgcgugggacuuugggagugucggcgggcuguucacaagcuuggggaaagccguccaccaaguauucggguccguguacaccacgauguucggcggggugagcuggaugauucgcaucuugaucggcuuucuggugcuguggaucgguaccaacagcagaaacaccagcauggcaaugaccugcaucgccgucggcggcaucacgcuguuccuuggguucacaguccaagccgacaugggcugcguggugucguggagcgggcgcgaacugaagugcggcuccgggaucuuuguaguggacaacgugcacaccuggaccgagcaguacaaguuccaaccggagagccccgcccggcuggccuccgcuauccucaacgcccacaaagauggugucugcgggauccgcuccacgacccggcuugaaaauguaauguggaagcagaucaccaaugaguuaaacuaugugcucugggagggcggucacgaccugacggucguggcaggggacgugaaggguguucuuacuaagggcaagcgcgcgcugaccccuccugccagcgaccugaaguacucauggaagaccugggggaaggcaaagaucuucacccccgaggcccggaacuccacguuccugaucgauggccccgacacuagugaaugcccgaacgagcgucgcgccuggaacagcuucgagguggaagacuacggguucggcauguucaccaccaauaucuggaugaaguuccgcgaaggguccagcgaggugugcgaccaccggcucaugucggccgcgaucaaggaucagaaggcaguccacgcugacaugggguacuggauagagucuuccaagaaccagaccuggcagaucgagcgcgcgagccuaaucgaagugaagaccuguuuguggccgaagacccacacccucugguccaacggcgucuuagagagccagaugcugauucccaaguccuacgcugggccauucagccaacacaacuacagacagggcuacgccacccagacgguuggccccuggcaccucgguaaacuggagaucgacuucggggagugccccggaacuacagugaccauccaggagaacugcgaccaccguggccccucccugcgcacgacuaccgccagcgggaagcucgugacccaguggugcugccggucuugcacgaugccgccccugcgcuuccugggcgaggacggcuguugguacgguauggagauucggccucucuccgagaaggaggaaaauauggucaagagccaggugacugccgggcagggcaccuccgagaccuucagcaugggacugcugugccucacgcuguucgucgaggagugccugcgccggcgcgugacccggaagcacaugauccuagcggucgugauuacucugugcgccaucauccucgggggccucaccuggauggaccuccuucgcgccuugaucaugcucggggacaccauguccggccggaucggaggacagacccaccuggcuaucauggccguguucaagaugagcccugguuacguucucggggucuuccugcgcaagcugaccucccgggagacugcgcucauggucaucggcauggcaaugacgaccacccugagcaucccgcacgaucuaauggagcucauagacgggaucucccuggggcuuauccuccugaagauagugacccaauucgacaacacgcagguaggcacucuggcgcucucccugacauucauccgcuccaccaugagccuggugauggccuggagaacgaucauggccguccucuucgucgugacccugaucccccugugccgcaccucgugccuccagaagcaaagccauuggguggagaucaccgcgcugauacugggggcccaggcccuccccguauaccugaugacgcugaugaagggcgccucccggcgcucauggccgcucaacgaggggaucauggcgguagggcucgugucccugcuugggagcgcccuauuaaagaacgacgucccgcucgccggccccaugguggccggcggguugcuccucgcagcuuacgugauguccggcagcagcgccgaccugucccuggagaaggccgccaauguccaaugggacgagauggcugacaucacagggagcucccccaucaucgaggugaagcaggacgaagacggcagcuucuccauccgggacguggaggagaccaacaugaucacgcuccuggucaaguuagcgcucaucacgguuagcggucucuaucccuuagccauuccgauaaccaugacccucugguacauguggcaggucaagacccaacgcuccggcgcccugugggacguaccuagcccugccgcaacccagaaggcggcccuguccgaggguguuuaucggaucaugcagcgcggccucuucggcaagacucaaguuggggucggcauccacauggaggggguuuuccauaccauguggcacgugacccgggguagcgucauuugccacgaaaccggucgacuggaacccuccugggccgauguacggaacgacaugaucagcuaugggggggguuggcggcugggcgacaaaugggauaaggaggaggaugugcagguccucgcaaucgagccgggcaagaacccaaagcacgugcagacgaagcccgggcuguucaaaacccuaaccggggagauaggugccgugacccucgacuucaagcccggcacguccggauccccgauuaucaaccgcaagggcaaggucauaggccuauacgguaacggcguggugaccaagucaggugacuacgucagcgcgaucacccaggccgaacgcaucggcgagcccgauuaugagguggacgaggacaucuuccgcaagaagcggcugacuauaauggaccuccauccuggggccggcaaaacgaagcgcauccuuccuuccaucguucgggaagcguugaaacgccggcuacgcacucucauccuggcgcccacccggguggucgccgccgaaauggaggaggcccugcguggccuacccauccgguaucagacccccgccgucaagucugagcacacugggcgcgaaaucgucgaucucaugugccaugccaccuucaccacccgucuucucuccaguacacguguuccgaacuacaaccugaucgugauggacgaggcccacuucaccgacccuagcuccguggccgcccgggguuacauaagcacccgcguggagaugggugaggccgcggcaaucuuuaugaccgcuacgccacccggcgccacggauccguuuccccaguccaacucccccaucgaggacaucgagcgggaaauccccgagagauccuggaauaccggguuugacuggauuaccgacuaccagggcaaaacggucugguucgugccguccaucaaggcuggcaacgacaucgcgaacugccuucgcaaguccggcaaaaaggugauccaacucucgcgcaaaaccuucgauaccgaguaccccaagaccaagcugacggacugggauuucguagugaccaccgacauauccgagaugggcgccaacuuccgcgccgggcgggugauugauccaagacgcugccugaagcccgucauucugaccgacggcccggagcgcgugauccuggccgggccuaucccggugacgcccgcguccgccgcacagcggcggggccgcaucggccgcaacccggcccaggaggacgaccaguacgucuuuuccggagaucccuuaaagaacgacgaggaccacgcccauuggaccgaggcaaaaaugcuccuggacaacauauacacacccgagggcaucauccccacccuguucggcccggagagggagaaaacucaggccaucgacggugaauuccgacucaggggggaacagcgcaagacuuucguggagcugaugcggcgcggcgaccugcccguauggcucucguacaaggucgcguccgccggcauuagcuauaaggaccgggaguggugcuucaccggggaacgcaacaaccaaauucuggaagaaaacauggaggucgagaucuggacucgggagggcgagaagaaaaagcugcgccccaagugguuggacgcccggguguacgcggaccccauggcccugaaggacuucaaggaguucgccuccgggcgcaagagcaucacccuggauauccucacggaaaucgccucccucccgaccuaccugagcucccgcgccaaacucgcgcuggacaacaucgucaugcugcauaccaccgagcguggggggcgcgccuaccagcacgcgcuaaacgaauuacccgagucucuggagacacucauguuaguggcacugcucggggcaaugaccgcaggcaucuuccuguucuucaugcaggggaagggcaucgggaagcugagcaugggccucauaaccaucgcaguggccuccggccuucugugggucgccgagauccaaccccaguggaucgcagccucuauuauacucgaguuuuuccucauggugcugcuaauaccggagcccgagaaacagcggacuccccaggacaaccagcuuauuuacgucauccugacgauucucaccaucauugggcucauugccgcaaacgaaaugggcuugaucgaaaagacaaagaccgacuuuggguucuaccaagucaaaacggaaaccaccauuuuggacguggaccugcgccccgccuccgcuuggacauuauacgccguggcgacgaccaucuuaaccccuaugcugcggcauaccaucgagaacacgagcgcuaaccucucacuggccgcgaucgcuaaccaggccgcagucuugaugggccuggggaagggcuggccucuucaccgcauggaccugggggugccccugcucgccauggggugcuacagccagguaaaccccaccacccugaccgcgucccuggucaugcucuuagugcacuacgccaucaucggcccgggccugcaggccaaggccacgcgggaggcccagaagaggacagccgccggcaucaugaagaaccccaccguggacggcauaaccguuaucgaucucgagcccaucagcuacgaccccaaguucgagaagcagcugggccaggugaugcuguuggugcugugcgccggccaacuucuccucaugcggacgacaugggccuuuugcgagguccugacccucgcgaccgggccgauacugacgcugugggaggggaaccccgggcgcuuuuggaacacuaccaucgccguguccaccgccaacauuuuccggggcuccuaccucgcuggcgccgggcuggccuucucccugaucaagaaugcccagacgccccgccggggcacugggaccaccggcgagacccuuggugagaaauggaagcgccagcuuaacucgcuggaccgcaaggaauucgaagaguacaagcgcuccggcauccucgaaguggaccggacggaagcgaaaagugcucugaaggacggauccaagaucaagcacgccgucagccgcggauccucgaagaucagguggaucguggaacgcggcauggugaagccgaaggggaaggucaucgaucuggguugcggucgcggcgguugguccuacuacauggcuacccuuaagaacgugaccgagguuaagggauacaccaagggcgggccgggccacgaggagcccauccccauggccacguacggguggaaccuggucaagcugcauagcggcguggacguuuucuacaaaccaacugagcaagucgacacacuauugugcgacauuggcgagagcuccaguaacccaaccauugaggaggggcggacgcugcgcguacucaagaugguggagcccuggcuguccagcaagcccgaguucugcauuaagguccugaacccuuauaugccgaccgugauugaggagcuugaaaagcuacagaggaagcauggcgggaaucuugugcgcugcccccugagucgaaauucaacccaugagauguacugggucucuggcgccagcggcaacaucgugucuagcgucaacacuacgagcaagaugcuucuuaaccgcuucaccaccaggcaucgcaagcccacauacgagaaggacguagaccugggcgcaggaacgcggagcgugaguaccgagacugaaaagcccgauaugaccaucauagggcgccggcuccagcgccugcaagaggagcacaaggaaacguggcacuacgaccaggagaauccguauagaaccugggcguaucauggcagcuacgaagccccguccaccgggagugccuccucaauggucaacggcguggugaagcugcucacuaaacccugggacgucaucccgauggugacgcagcucgccaugacggacaccacccccuucggccagcagaggguuuucaaagagaagguggacacgcggacaccccagccuaaaccugggacccgcauggugaugaccaccaccgccaauuggcugugggcccuccuggguaaaaagaagaauccgcggcuguguacccgagaggaauucaucucaaaggugcggagcaacgcagcaauaggggccgucuuccaggaggagcagggcuggaccucagccagcgaagcgguaaacgauagcagauucugggagcucguggacaaggagcgagcguuacaccaagaggggaagugcgaauccugcgucuacaauaugaugggaaagcgcgaaaagaaacugggcgaguucggccgugcuaagggcagccgugccauuugguacauguggcucggggcuagauuccuggaguuugaggcgcugggguuccucaacgaggaccacugguucgggagagagaacuccuggagcggcguggaaggcgaggggcugcaccgccuggguuacauucucgaggagaucgacaaaaaggacggggaucugauguacgccgacgacacggccggcugggacacccggauaacagaggacgacuugcagaacgaagagcucaucaccgagcagauggcuccccaccacaagauccuggcuaaagcaauauucaagcucaccuaccagaauaaggugguaaagguucuccgccccacgccgcguggugcggugauggacaucauaucccgcaaggaucaacgcgggagcggccaggucggcacuuacggacugaacaccuucacaaacauggaggugcagcugaucaggcagauggaggccgagggggugaucacccaggacgauaugcaaaaucccaagggucugaaggagcgggucgagaaguggcugagagaguguggcguggaccggcugaagcggauggcuaucuccggggacgacugcguugucaagccccucgacgagcgguucggcaccucacugcuguuccucaacgauauggguaaggugcgcaaagauauuccacagugggaaccuuccaagggauggaagaacuggcaggagguucccuucuguagccaccacuuccacaagauuuucaugaaagacgggcggucccuugucgugcccugcagaaaucaggacgagcugaucggccgggcgaggaucagccagggcgcgggguggagucuccgcgagaccgccugccugggcaaagccuaugcccagauguggucuuuaauguauuuccaccggcgcgaccuccggcuggcguccauggccaucuguagcgccguaccuacagagugguucccgacgagucgcaccaccugguccauccacgcucaucaucaguggaugaccacggaggacaugcuaaagguuuggaacagaguuuggaucgaggacaaccccaacaugaucgacaagaccccugugcacagcugggaggacauccccuaccucggcaagcgcgaggaccuguggugcggcucacugaucggccucagcagccgggcuaccugggcgaagaacauccacaccgccauaacucaaguccgaaacuugaucggcaaggaggaguacgucgacuacaugcccgugaugaagcgcuauagcgcccccagugagagcgagggcguccuguga

SEQ ID NO: 26234 - RNA, 9867 nt, Artificial Sequence
  derived and/or modified CDS sequence (opt11) from DENV-4__JQ922560__SS-prME
agcaccaucacgcugcucugucugauccccaccguaauggccuuucaccuguccacgcgggacggcgaaccguugaugauuguggccaagcacgagcgggggagacggcuacuguucaaaaccaccgaggggaucaauaagugcacccugauugccauggaccugggagagaugugcgaggauaccgugaccuacaagugcccccuucuagugaacacggagcccgaggauauugacugcuggugcaaccugaccagcgccugggugauguacgggaccugcacccaguccggggaacgacggcgcgagaagcgcagcguugcccugacgccccacuccgggaugggauuagagacccgagcagagaccuggaugagcucugagggggccuggaagcacgcccagcgaguggaaucauggauccuacggaaccccggcuucgcccugcuggcgggcuucauggccuacaugaucggccagacugggauucaaaggaccguguucuuuauccuaaugaugcugguagcgcccuccuacgggaugcgaugcgugggcguggggaaccgugacuucguggagggcguuucugggggggccugggucgaccucguccuggagcacggugggugcgucaccacaauggcucaaggcaagccaacccuggacuucgagcucauaaagacgacagccaaggaggucgcacugcugcgcaccuacugcaucgaggcguccauuagcaauaucacuacugcuacgcgguguccaacccagggugaaccuuaucucaaggaggagcaagaucagcaguacaucugccgccgggaugugguugaucgcggcugggggaacggaugcggccuauucgggaaggggggugucguaaccugcgccaaauucuccugcaccgguaagauaacggggaaccugauccagauagagaaccucgaguacaccgugguuguaaccgugcacaacggggacacucacgccgucggcaaugacacguccaaccauggggugaccgcaaccaucacgccgcggucccccucaguugagguggagcugccagacuacggggagcugacacucgacugcgagccccguucugggaucgacuuuaacgagaugauccuaaugaaaaugaacaaaaaaacguggcuggugcacaagcagugguuccucgaccugccccugcccugggcggcuggugccgacacgagcgagguacacuggaaccacaaggagaggauggucacguucaagguuccccaugccaagaggcaggacguaaccguccucgggucccaggaaggagccaugcacagcgcgcugaccggcgcgaccgaggucuacucaggggacggcaaucugauguucgccgggcaccucaaauguaaagugcgcauggaaaaguugcggaucaaaggcauguccuauacuaugugcucaggcaaguuuuccaucgacaaagagauggccgaaacccagcacgggaccacaguugugaaggucaaauacgaaggcgccggagcucccugcaaaguucccaucgaaauccgcgauguuaacaaagagaaggucguaggccgagugaucucaucaaccccauucgccgaaaacaccaacagcguaacgaauauagaauuggagccgccuuuuggagacuccuacauuguuaucggcgugggagacagugcgcuaacccugcacugguuuaccaagggcuccucuauuggaaagauguucgaauccacuuaccgaggggcaaagcggauggccaucuuaggcgagacggcgugggacuucgggagcgucggcggccuacugaccucccuggggaaggccgugcaccaaguguuugggagcguguacacaacuauguucgggggcgugucuuggauggugagaauccucauuggguuccugguccuguggaucggcaccaacucucggaacaccucaauggcgaugagcugcaucgcugucggcgggauuacccuguuccugggcuucacugugcacgcggacauggggugcgccgucaguuggucgggcaaagagcuuaaaugcgggucgggcauuuucaucaucgauaacgugcauacuuggacggagcaguacaaguuccagcccgagucuccagcacgccuagccagcgccauccugaacgcgcacaaagacggcguaugcggcauccggaguaccacccgccuggagaacgucauguggaaacagaucacgaacgagcugaauuacgugcucugggaggggggccacgaccugacaguugucgccggggacgugaagggcgugcucagcaaggguaagcgcgccuuagcgccgcccgugaacgaccugaaguacucguggaagaccuggggaaaggccaagaucuuuacucccgagacgcgaaacagcacguuucuaaucgacggucccgauaccuccgagugcccuaacgagaggagagccuggaacuuccucgagguagaggacuacggcuucgggauguuuacuacgaacauauggaugaaguuccgggaaggcagcucggaaaugugugaccaucgccugaugagcgccgcaaucaaggaccagaaagccgugcacgcggacaugggcuacuggaucgagucgagcaagaaccagacguggcagaucgaaaaggccucacugaucgaggugaagaccugccucuggccaaagacgcacacgcugugguccaacggcgugcucgagucccagaugcucauacccaaggccuaugccggcccauucagccagcauaacuaccggcaagguuacgcgacccaaaccguggggccauggcaccugggcaagcuggagaucgacuucggcgagugcccgggcaccacgguuacgauccaggaagacugcgaucaucgugguccauccuugcggaccacaacugcgaguggcaagcuggucacccaauggugcugccggucguguacaaugcccccucugcgcuuccucggcgaggacggcugcugguaugggauggagauacggccccuauccgagaaggaagagaauauggucaagucgcagguauccgccggccaaggaacuagcgagacguuuuccaugggguuauuaugucuaacguuguuuguagaggagugucuccgccguagggugaccagaaagcacaugauccuugucguggucacuacacuaugcgccaucauccugggcgggcugacguggauggaccuucuacgugcgcugaucaugcugggcaacacuaugucuucccgaauggggggccagauacacuuggcuaucauggcaguguucaagaugucaccaggcuauguccugggaauauuucugagaaagcucaccucacgggaaacggcccugauggucauagggauggccaugacgacggugcugagcaucccucacgaccugauggaguuugucgacgggauaucacuaggucucauccuccugaaaaugguuacgcacuucgauaacacccagguuggaacacucgcccucucgcuuaccuucauuaagucgaccaugccguuagugauggccuggcguacuaucauggcgguccucuucguaguaacgcugaucccccugugccggacgagcugcuuacaaaagcagucacacugggucgagauuaccgcccucauacugggagcucaagcccuccccgucuaccugaugacacuaaugaagggagcgucaaagcgcuccuggccccucaacgagggaaucauggccgugggcuuggucucucugcucgguuccgccuugcuaaaaaacgacgugccguuggccggcccuaugguggcaggcggccuucugcucgcugcauacgucaugagcgggucuagugccgaccuaagccucgagaaggcagccacgguucagugggaugagauggcggacaucaccggauccagccccaucaucgaggugaagcaggacgaggacgguuccuucucuauucgggaugucgaggagacaaacaugauaacccuccuggucaagcuugccuuaaucacgguguccgggcucuacccccuggcuaucccggucaccaugacacuaugguacauguggcaggucaaaacccaacgcaguggcgcccugugggacguucccuccccggcagcggcccagaaggccacgcuuaccgaaggaguauaccggaucaugcaacguggccucuucgguaagacccaggucgguguggguauccauauggagggcgucuuucacacuauguggcaugugacgcgaggcucgguaauaugccacgaguccggccgcuuagagccgagcugggccgacguccgcaacgacaugaucuccuacgggggcggauggcgccuuggcgauaagugggauaaggaggaagacguacaggugcucgccguagagccgggcaagaaccccaaacaugugcaaacaaagccaggccuguuuaagacucuaaccggcgaaaucggggcggugacccucgacuucaagcccgggacgagcgguuccccgauuauaaaccggaaagggaaagucaucggccuguauggaaauggcguggugacgaagucgggggacuauguuuccgcgauaacccaggccgagcgcaucggcgagcccgacuacgaaguggacgaggauauuuuccgcaagaaacgguuaacaauaauggaccuccaccccggggccggcaagaccaagaggauucugccaagcauagugcgggaggcgcugaagaggcggcuucgcacccucauccuugcccccacccggguagucgcugccgagauggaagaagcccugaggggcuuacccauccguuaccaaacccccgcggugaaaucggaacacacggggcgcgaaaucgucgaccuuaugugccacgccaccuucaccacccggcugcucagcucaacgcgugugccgaacuauaaccuuauaguuauggacgaggcccauuuuaccgaccccuccucuguagcggcgcggggcuauaucagcacgcgcguggaaaugggagaggcggccgccauuuucaugaccgccacgccgcccggcaccaccgacccguucccgcagagcaacucccccaucgaggacaucgagcgggaaauccccgagcgcagcuggaauaccggguucgacuggaucacugacuaccaaggcaagacugucugguucguuccuuccaucaaagcaggcaacgacaucgcgaauugccugcgaaagucugggaaaaagguaguccaguugucgcggaagaccuucgacaccgaguacccgaagacgaagcugacagauugggacuucgucgugaccacagacauaucugaaaugggcgccaacuuccgugccgggcgaguaaucgacccccgccggugccugaagcccgugaucaucacagauggcccugagcggguaauacucgccggacccauccccgucacccccgcguccgcggcccagagacgcggucgaaucggccgcaacccagcccaggaggacgaccaguacguauucucgggcgacccucugcggaacgacgaggaccacgcacacuggaccgaggcaaaaaugcuacucgacaacaucuauacacccgagggcaucauccccacgcuguucgggccagagcgcgaaaagacucaagcaauugacggcgaguucaggcugcgcggcgagcagcgaaagaccuucguggagcucaugaggcgcggugaccugccugucugguuauccuacaaggucgccagugcuggcaucuccuacaaggaccgcgaguggugcuucaccggggagcggaauaaccaaauacucgaggagaacauggaggucgagauauggacaagagagggugagaagaagaagcuccgacccaaguggcuggacgcccgcguguaugcggauccaguggcacucaaggacuucaaggaauucgccagcgggcggaaguccauaaccuuagauauauugaccgagaucgccagccucccuaccuaucugucaagccgugccaagcuggcguuagauaacaucgugaugcugcacacaacggagcggggcggaaaagccuaccagcacgcccugaacgagcuacccgagagccucgagacccuaaugcucaucgcccuacugggggcgaugaccgcgggcaucuucuuauuuuucaugcaaggcaaagguaugggaaaguuaucgaugggccucaucgccaucgccgucgccagcggccuccuguggguggcggagauccagccgcaauggauugccgccucaaucaucuuagaauucuuccugauggcguugcugaucccagagcccgagaaacagagaacgccccaggacaaccaacucaucuacgucauauugacuaucuuaaccauuauugggcucguagccgcgaaugagaugggccugaucgaaaagacaaaaaccgacuuugguuuuuaucaggagaagacggagaccacuauucuggacguagaccucagacccgcuagcgccuggacccuguaugcgguggccacgaccauccugaccccgaugcuccggcacaccauugagaacacgagugcgaaucugagccucgccgccaucgcuaaucaggccgcgguguuaaugggccuggggaagggcuggcccuuacaccgcauggaccucggcgugccgcugcuggcaauggggugcuauagucaggugaaccccaccacacuaaccgccagccuggucauguugcucgugcacuacgccaucaucgggcccgggcuucaggcuaaagcuacccgggaggcccagaagcggacugcagccggcaucaugaagaaucccacgguagacggcaucaccgucaucgaucuggagcccauuuccuaugacccgaaguuugagaagcagcucggacaggugaugcuucuggugcucugugcuggucagcugcugcucaugcguacgacuugggccuucugcgaggucuugacacuagccaccgggccgauucuuacgcuuugggagggcaacccuggucguuucuggaacacaaccauagcagugagcaccgccaauauauuccggggcucuuaccuggcgggugccgggcuagcauucagccuuaucaagaauacucagaccccucggcgggggaccgggaccacgggagagacccugggagagaaguggaagcgccagcucaacuccuuagaucggaaagaguucgaagaguacaagcgcucgggcauacuggagguggaucggaccgaggcuaaauccgcccucaaggacggcagcaagaucaaguacgcgguuucucgcggcaccagcaagaucagauggaucguggagcgcggcauggugaagccaaaggggaaggugguggaccuaggcugugggcggggcggcugguccuacuacauggcaacccucaagaacguuacggaggucaagggguacaccaaggguggcccaggccacgaagagcccaucccgauggcgacauacgguuggaaucucgugaaacugcauagcgggguggacguauucuauaaaccaaccgagcagguggacacucugcugugcgacauaggagaaagcuccuccaauccgaccauagaggaagggcgaacccuucggguccugaagauggucgagccuuggcucuccagcaaacccgaauucugcaucaaggugcugaauccuuacaugcccaccguaaucgaggaacuggagaagcuccaacgcaagcaugguggcucccuuguccgcugcccccuaagccggaauuccacacacgagauguacugggugagcggcgucucccgcaauaucgucucuucugugaacacaacgagcaaaauguuacucaaccguuucaccacgcgcuaccggaaacccacguacgaaaaagaugccgacuugggugcggggacgcgcagcguaagcacugaaaccgaaaaacccgacauggccaucaucggccggcgcuugcaacggcuccaggaggagcacaaggaaacauggcacuacgaccaggagaauccauaccguaccugggccuaccacggcagcuacgaggccccgagcacaggcucagcuagcuccauggucaacggcguggucaagcuccugacaaaacccugggacguggugccaauggucacccagcuagcuaugacagacaccacucccuucggccagcagcggguauuuaaggagaaaguagacacccggacgccucagccuaagccggggacccggaugauaaugaccaccacugccaacugguugugggcccugcucggcaaaaaaaagaacccccggcucuguacccgggaggaauucaucucaaaaguucggagcaacgcugcuaucggggcggugucccaagaagagcaaggguggacgagcgccuccgaggccgugaaugauagcagguucugggagcuugucgacaaggagcgcgcgcuccaucaagagggcaagugcgaguccugugucuauaacaugauggggaagcgggagaagaagcugggggaguucggccgggcuaaggggagccgggcaaucugguauaugugguugggcgcacgcuuccuugaguucgaagcccugggauuccugaaugaggaccacugguucgggcgugagaauuccuggagcggagucgagggcgagggccuccacaggcugggauacauccuggaggacaucgacaagaaagauggugaccuuauauaugccgacgacacugcgggaugggauacuaggaucacugaggacgaccugcuaaacgaggagcuaaucacggagcagauggcgccccaucacaagauucuggccaaggcaaucuucaaacugaccuaccagaacaaaguugugaagguccuccgucccacuccgaagggggccgucauggacaucaucuccagaaaggaccaacggggguccggccaggucggcaccuauggacucaacaccuucacgaauauggaagugcaacuuauccgacaaauggaggcggagggggucaucacgcgggacgacaugcacaaccccaagggucucaaggagcgcguggagaaguggcuaaaagagugcgguguggaucgguugaagcggauggcuaucucaggcgacgacugcguugugaagccccucgaugaacgguuuucaaccucgcugcuguuccucaacgacauggggaaagugcgcaaggacauuccccaaugggagccgaguaagggcuggaaaaacuggcaggagguucccuucugcagccaucauuuccacaagauuuuuaugaaggacggacggagccuaguggugccaugccgcaaccaggaugagcuuaucggccgggccaggaucucccagggggccggcuggucacuaagagagaccgcaugccugggcaaagccuacgcccaaauguggucgcugauguacuuccaccgacgagaccuccgucuugccucaauggccaucugcagugccguacccacggagugguucccgaccaguaggacgaccuggagcauacacgcgcaccaucaauggaugacgacugaagacaugcugaaaguguggaaucguguguggaucgaagacaaccccaacaugaccgauaaaaccccaguccauuccugggaagacaucccguaucucggcaagcgggaggaccuguggugcgguagccuuaucggacucuccuccagggccacgugggccaagaacauccacaccgcaaucacgcaagugcgcaaccugaucggcauugaggaguacguggauuacaugccggucaugaagcgguauucagcccccuucgagagugaggggguucuguga

SEQ ID NO: 26235 - RNA, 9867 nt, Artificial Sequence
  derived and/or modified CDS sequence (opt11) from DENV-4__JQ922558__SS-prME
ucaacccucacccuucuaugccugauuccuacggugauggccuuccaccugucaacucgcgacggcgagccgcuuaugaucguugcuaagcaugagcgcggccguccccugcuauucaagacuaccgagggcaucaacaagugcacgcugaucgcgauggaccugggggagaugugcgaggacaccguaaccuacaagugcccccuccuggugaacaccgagcccgaggauaucgacugcuggugcaaccugacgagcaccugggugauguaugggacuugcacccaguccggggaacggcgccgggagaagcguagcguggccuuaacgccgcacucaggcaugggccuggagacccgggcggagaccuggaugagcuccgagggggccuggaagcacgcacagcggguggagucuuggauccugcggaacccuggcuucgcgcuccuggcugguuucauggccuacaugaucggccagaccgggauucagaggacgguguucuucguacugaugaugcucguggcccccuccuacggcaugcggugcguagggguggggaaccgcgacuuuguggagggcgugagcgggggcgcguggguggaccuggugcucgagcacggcgggugcgucaccacaauggcccaggggaagcccacccuugacuuugagcugauuaaaacgacagccaaagagguggcccugcuaaggaccuacugcaucgaggccuccaucagcaacaucacuacggcgacccgcugcccaacccagggggagccuuaccugaaagaggaacaggaccaacaauauaucugcaggcgcgacguagucgaccggggguggggaaacggcugcggccuguucgggaagggcgggguggugaccugcgcuaaguuccucugcuugggcaagauuacggggaaccucguucagaucgagaaccuggaguacaccgugguggucaccguccacaacggcgacacccacgccguaggcaacgacaucuccaaccacgggguaaccgcuaccaucacgcccaggagccccuccguggaggucaagcugccggacuacggagagcugaccuuagacugcgagccccggagcgggaucgacuuuaaugaaaugauccugaugaagaugaagaagaagacguggcugguacauaagcaaugggugcucgaccugccacugcccugggccgcgggcgccgacacguccaaaguccaguggaacuacaaggagcgcauggugaccuucaaggugccgcacgcaaagcggcaggaugucacgguguuggggagccaggaaggagccaugcacuccgcauuaaccggggcgacggagguggacagcggggacgggaaccauauguucgccgggcaccugaagugcaaggugcgcauggagaaacuccgcaucaagggcaugagcuacacuaugugcuccggcaaguucaguaucgacaaagagauggccgagacccagcaugggaccacgguggugaaggucaaguacgagggcgcuggggcacccugcaaaguacccaucgagauccgggacgugaacaaggaaaaggucgugggccgcauaaucuccucgacccccuuugcggagcauaccaacuccgugaccaauaucgagcuggagccgccguucggggacaguuacaucgucaucggcgugggcgacuccgccuuaacgcuccacugguuccggaaggggagcucgaucggcaagauguucgagagcaccuaccgcggagccaagcggauggccauccugggggaaaccgcaugggacuucggcuccgugggcggccuguucacaagcuuaggaaaggccguccaccaggucuucggcuccguguacacgaccauguuuggcggaguuagcuggauggugcgcauccugaucggacugcugguguuguggaucgguaccaacucccggaacaccagcauggccaugacgugcauugccaucggcggaaucacccuguuccugggcuucaccguacacgccgacauggggugugcuguguccuggagcggcaaagagcuaaagugcggguccggcaucuucguugucgacaacguacacaccuggacggagcaguacaaguuccagcccgagagccccgcccggcuggccagcgccauccugaaugcucacaaggacggcgugugcgggauccgguccaccacccgccucgagaacguuauguggaagcagaucaccaacgagcugaacuacgugcugugggagggggggcacgacuugacgguggucgccggcgacgugaaaggcgugcugaccaagggcaagcgggcccugacgccacccgucaacgauuugaaguacuccuggaagaccuggggcaaggccaagaucuucacgcccgaggcccgcaacuccacauuccugaucgacgggcccgauaccagcgagugcccgaacgagcggcgcgccuggaauuuccuggagguugaagacuacggcuuugggauguucaccacgaacaucuggaugaaguuucgggagggcuccagcgaggugugcgaccaccgcuuaauguccgccgccaucaaggaccagaaggcuguccacgccgacaugggauacuggaucgagagcuccaagaaccagcccuggcagaucggaaacgcgagccugaucgaggucaaaaccugucuguggcccaagacccacacccuuuggucuaacggcgugcuggagucgcagaugcuaauuccgaaagcuuacgccgggccuuuuucacagcauaacuaccggcaaggcuacgccacgcagacgaucgggcccuggcaccucggcaagcuggagauagacuucggggaaugccccggcacuaccgucaccauccaggaggacugcaaccaucgcggaccgagccugcgaacgaccacugccuccggcaagcucguaacccaguggugcugucgcagcugcacgaugccgcccuugcgguuccugggggaagauggguguugguacggcauggagauucggccccucucugagaaggaggagaauauggucaaaagccaggucagcgcgggccaagggaccucagagaccuuuagcaugggccuacugugucucacccuguucguggaggagugccugcgccggcgcgugacgcgaaagcacaugauccucguggucgucaccacccugugcgccaucauacucgguggccucaccuggauggaccugcugcgcgcccucaucauguugggggauacaaugucugggagaaugggaggacagauccaucugaccaucauggccguguucaagaugucaccgggcuacguccucggggucuuccugcgcaagcugaccucucgggagacugcccucaucgucaucggcauggcuaugacgacgguguuaagcaucccucacgaccugauggaguucaucgacggcaucucccuagguuugauccuccucaagauggucgcccacuucgacaauacgcaggugggcacccuggcccugagcuugacguucauacgcuccacaaugccuuuagugauggccuggagaacuaucauggccguccucuucguggugacccuuaucccccugugccgcacgagcugcuugcagaagcaaucgcacugggucgagaucaccgcccucaucuugggggcucaggcccugccgguguaccucaugacccucaugaagggugccagcaaacggucuuggccccuuaacgaggguaucauggcugugggccucgucagccugcugggguccgcccugcugaagaacgacgugccccuggccgggcccauggucgccggcgggcuccugcuugccgcguacgucauguccggcucgagcgccgaccucucccuggagaaggccgccaacguucacugggacgaaauggccgacaucaccgguagcagcccgaucaucgaagugaagcaggaugaggacggcuccuucucaauccgcgacgucgaggagacgaacaugaucaccuuacucgugaagcuggcgcugaucaccgugucaggccuuuaccccuuagccauucccgucaccaugacgcugugguacauguggcagguuaagacccaacgcagcggggcccucugggacgugcccucccccgccgcggcgcaaaaggcgacccugaccgagggcgucuaccgcaucaugcaacguggucuguucggcaagacccagguuggggugggcauccauauggagggcgucuuucacaccauguggcacgucacgcgcgggagcgugaucugccacgagaccggccgucucgagcccuccugggccgacguccgcaacgacaugaucagcuacgggggcggcuggcggcugggggacaagugggacaaggaggaggacguccaggugcuugcgaucgagcccgguaagaacccaaaacacguccagaccaagcccggacuguucaagacgcugacaggggaaaucggggccgugaccuuagacuucaagccuggcaccucaggaagccccauaaucaacaaaaaggggaagguaaucgggcucuacgggaacggcguagugacgaaguccggggauuacgugagcgcgaucacgcaagccgagcgcaucggcgauccggauuacgagguugacgaggauaucuuccgcaagaagcggcucacgaucauggaucugcacccgggcgccgggaagaccaagcgcauacuccccuccaucgugcgggaggcccucaagcgccgccuacgcacccugauccucgcgcccacccggguugucgccgccgaaauggaggaggcauuacgcggauuaccgauccgauaucagacacccgccgucaaaagcgagcauacagggcgcgagaucguggaccucaugugccaugcuacguucacugccaacccacuguccagcacccggguccccaacuacaaccuaaucgugauggacgaggcccaucuccaggaucugaguaucgucgccgcucgcggcuacauaagcacccggguugagaugggggaggcugcggccaucuucaugacggcaaccccgcccggcgccaccgaccccuuuccccagucaaauucaccaaucgaggacaucgagcgcgagaucccagagcggagcuggaacacaggcuucgacuggaucacggacuaucaggggaagaccgugugguucgucccuuccaucaaagcgggcaaugacaucgccaauugccugcgcaagagcgggaaaaaagugauccagcugucccggaagaccuucgacaccgaguaccccaaaacgaaguugaccgacugggacuucguggucacuaccgacaucagcgagaugggcgccaauuuccgcgcccgccgcgugaucgacccgcgccggugccuuaagccggugauccucacggacgggcccgagcgcguaauccuggcgggucccaucccggugacacccgccuccgcggcucagcggcgaggccggauagggcgcaaccccgcccaagaggacgaccaauacguguucaguggggauccccugaaaaacgacgaggaccacgcccacuggaccgaagcgaagaugcuccucgacaauaucuacaccccggagggaaucauccccacgcuuuuuggccccgagcgggagaagauccaggccaucgacggcgaguuccgccuacgcggggagcagcgcaagacguucgucgaacucaugcggcgcggcgaccugcccgugugguuauccuacaagguugcaagcgcggggauuuccuacaaggaucgggaguggugcuucaccggcgagcguaacaaccagauccuagaggagaacauggaaguugagaucuggacacgggagggggagaaaaagaagcugcgccccaaguggcucgacgcgagggucuacgccgaccccauggcccugaaagacuucaaggaguucgccuccggucguaaaucaaucacgcuggacauccucaccgagauagccagccugccgaccuaccuauccucccgggcgaagcuugcgcuggacaacaucgugaugcugcacacuacggagcgcggcgggcgagccuaucagcacgcucucaacgagcugccggagagccuggagacccucaugcugguagcccugcucggcgccaugacugcuggaaucuuccuauucuucaugcagggaaaggguaucggcaagcuuagcaugggccucauggccauagccguggcguccggccugcuguggguggccgaaauccagccccaguggaucgccgcuagcaucaucuuggaguucuucuccauggcuuugcuuauucccgagcccgagaagcagcgcacaccucaggacaaccagcuuaucuacgucauccugaccaucuuaacgaucauagguuuaaucgcggccaacgagaugggccuuauagaaaagaccaagacugauuucggauucuaccaggugaagaccgagacgaccauccuggacguggaccuccgccccgccagcgccuggacccuguacgccgucgcgaccacgauacugacccccaugcuccggcacaccaucgaaaacaccagcgcaaaccucucccuggccgccaucgccaaccaggcggccgugcucauggggcugggaaagggcuggcccuuacacaggauggaccucggggugccgcugcuggccaugggcugcuacucucagguuaaccccacaacccucaccgcaucucuugugaugcuguccgugcacuacgcaaucaucgggcccggccuccaggccaaggccacccgcgaggcacagaagagauccgccgcgggcaucaugaagaaccccacggucgacggaaucaccgugaucgaucuagagccgauuagcuacgaucccaaguuugagaagcagcugggccagguuaugcuucuggcccugugcgccgggcagcuuuugcugaugcggaccacaugggcguucugcgaggucuuaacucuggccaccggccccauucuaacccucugggaggggaaccccggcagauucuggaacaccacgaucccaguguccacugcgaacaucuuccggggcuccuaccuggccggagccgggcucgccuucucccucaucaagaacgcccagacgccccgucgggggaccggcacgaccggggagacccugggugagaaguggaaacgccagcugaacucacuugaccggaaggaguuugaggaauacaaacgcaguggaaucuucgaaguggaccgacacgagaucaaguacaccuuaaaggacggaagcaagaucaaccacgcgauguccaccggcagcaucaagauccgcggcaucgacgaacgggguauggucaagcccaagggaaaggucguggaccaggggugcggccgcgggggauggucccacuauaccgccacggcuaagaagguuaccgaggugaagggguacacgaaaggugggcccggccacgaggagcccauccccauggccaccuauggcuggaaccuggugaagcuccacagcggggucgacguguucuacaagccuacugagcagguggacacucugcugugcgacauaggcgaauccagcuccaaccccacuaucgaggaggggagaacucuccgcguccugaagaugguggaaccguggcuaagcagcaagcccgaauuuugcaucaaagugcucaaccccuacaugcccaccgucaucgaggagcuggagaagcugcagcgaaaacacggcggcucccuggugcgcugcccgcucagccgcaauuccacccacgagauguacugggugagcggggucucgggcaacaucgugagcuccgucaacaccacgagcaagaugcugcugaaucgguuuacgacccgccaccggaagcccaccuaugagaaagacguggaccuaggggcgggcacgcgcuccgugaguaucgagaccgagaaacccgacaugaccaucaucgggcggcgccuccagcggcugcgugaagagcacaaggagaccuggcacuacgaccaggagaauccguaccggacaugggcauaucacggcuccuacgaagcccccagcacgggcuccgcuagcuccaugguuaacgggguggugaagcuccugaccaaacccugggaugucauacccauggugacacagcuggccaugacggacaccaccccuuucggccagcagcgcgaguucaaggagaagguguacaccagcacgccccaccccaagcccuggacucggaugguuaugacgaccacggcgaacuggcucugggcucucgggggcaagaagaaguccccgcgccugugcaccugggaggaauucauuagcaaggugcgguccaaugccgccaucggggccguguuccaggaggagcagggcuggaccucagcuagcgaggcugucaacgacucccgcuucugggagcucgucgacaaggagcgcgcccugcaccaagagggcaagugcgagagcugcguguacaacaugauggggaagcgcgagaagaagcugggcgaguucgggcgggccaagggcucccgcgccaucugguacauguggcucggugcgcguuuccuggaguucgaggcccugggcuuucucaacgaggaccauugguucgggcgcgagaacagcugguccggggucgagggcgagggccugcaucgccugggguacauccucgaggacaucgacaagaaggacggcgaccucaucuacgccgacgacaccgccgggugggacacgcgcaucaccgaggacgaccuacucaacgaggagcuuaucaccgaacagauggcgccccaucaccgcauccuggcuaaggccaucuucaaacuuaccuaccacucgaaggugaugaaagugcuacgccccacgccaaaaggggcugucauggauauaauuagccguaaggaucagcgggggagcggccagguggggaccuacggacuuaacaccuuuaccaauauggaaguucaacucauccgccagauggaggcggagggcgucaucacgcaggacgacaugcaaaauccgaaaggacugaaggagcggguggagaaauggcugaaagaaugcggaguagaccgucucaagcggauggcuaucucgggggacgacugcgucgugaagccucuggacgagcgcuucagcaccucccuccuguuucugaacgacaugggcaaggugcggaaagacauuccccagugggagcccagcaagggguggaaaaacuggcaggaggucccuuucugcucccaccacuuucacaagauuuucaugaaggacggacgcagccucgugguucccugccggaaccaggaugagcuuaucggccgcgccagaaucucccagggggccggcuggagucugcgcgagaccgccugccuggggaaggcguacgcgcagauguggucccucauguacuuccaccggagagaccugcgguuagccucuauggccauaugcagcgccgucccaaccgagugguuccccaccucccgcacgaccugguccauccacgcccaccaucaguggaugaccaccgaggacaugcucaagguguggaaccggguguggaucgaggacaacccuaacaugacagacaagacccccguccacuccugggaggacgugcccuaccugggcaagcgggaggaccuguggugcgggucccucauaggccuguccagcagggcgaccugggccaagaacauccacacagcaaucacccaagugcggaaccugaucggcaaagaggaguacgucgacuacaugccugugaugaagcgcuacuccgcccccaucgagucagagggggugcuguga

SEQ ID NO: 26236 - RNA, 9867 nt, Artificial Sequence
  derived and/or modified CDS sequence (opt11) from DENV-4__JQ922559__SS-prME
uccaccauaacacuucuaugccugauacccaccguuauggcauuccaccugucaacgcgcgauggagaaccgcuaaugauaguagcuaaacaugaaagaggacggccccuacuauuuaaaaccacggaaggaauaaauaaaugcacuuugaucgcgauggaucugggagaaaugugcgaagacacggucaccuacaaaugcccccugcuagugaacaccgaaccggaagacauagacugcuggugcaaccuaacgucagccuggguaauguacggcacaugcacacaaucgggagaacggagaagggagaaaagaucugucgcgcuaacaccccacagugggaugggccuugaaacacgggcggaaaccuggauguccucggaaggcgcguggaaacacgcgcaaagagucgaauccuggauccuaagaaacccaggauucgcccugcuggcaggguuuauggcguacaugauaggccaaacaggcauacagcggaccguauucuuuauccugaugaugcuaguugcaccaagcuacgggaugcgaugcguggggguugggaaccgcgacuucguagaaggggugagcgggggugcuuggguggaucuaguccucgaacacgggggcugugucacaaccauggcccagggaaaaccaacccuggacuucgaauuaaucaaaacuacagcaaaagaagucgcgcuucuacgaacauacugcaucgaagcaucuaucagcaacaucacuacggcaacacgcuguccaacccaaggcgaaccguaccuuaaagaagaacaagaucagcaauacauaugucgccgcgauguggucgaccgcggguggggcaauggaugcggccuuuucgguaaaggugggguaguaaccugcgcaaaauuccugugcuccgggaaaaucacgggcaaccuuguacaaaucgagaaccuagaauacacugugguaguaacgguacacaacggggacacccacgccguagguaacgauaucuccauucacgguguaacggcaacaaucaccccucguaguccaaguguagaaguaaaguugccggacuauggcgaacuaacacucgacugcgaaccacggaguggcauagauuucaacgaaaugauacucaugaaaaugaagaagaaaaccuggcuagugcauaagcaaugguuucucgaccuaccccucccauggaccgcaggcgcggauaccagcgaagugcaauggaacuacaaggaacggaugguaacguuuaagguuccucacgcgaaacgccaggauguaaccguauuaggaucccaagaaggcgcgaugcacagcgcgcucacgggcgcgaccgaaguagauagcggggacggcaaccacauguucgcgggacaccuaaagugcaaagugcgaauggagaagcugagaauaaaagggaugagcuacacgaugugcucaggaaaauucagcauugacaaagagauggccgagacccagcacggaacuacagugguuaagguaaaauacgaaggggcgggggcgcccugcaaaguuccgaucgaaauacgcgacgucaacaaagagaagguagugggaagaauaaucagcucaaccccguucgccgaaaauaccuacucugugacaaacaucgagcuagaaccaccguucggagacuccuacaucauaaucggaguuggggacuccgcacucacguugcacugguuccguaaaggaucaagcaucggcaagauguucgaguccacguaccgaggcgcaaagagaauggccauccucggagaaaccgcaugggacuucgguuccgucgguggucuccugacaucucuggggaaagccguacaccagguauucgggagcgucuacacgacuauguucgggggcgucaguuggauggugcgcauccugauuggauuacuuguccuauggaucggaacgaacucgcgcaauaccuccauggccauguccugcaucgcagugggcggcauaacgcuauuccucggauucacuguccaugccgauaugggaugcgcaguauccugguccggcaaggaacucaagugcggcaguggaaucuucguuauagacaacguccacaccuggacugaacaguacaaauuccaacccgagucaccagcgcgacucgcaucagccauucugaacgcgcacaaggacgggguaugcgggaucagauccaccacuagacuggaaaaugugauguggaaacaaauaacaaacgaacucaauuacguacuaugggagggcggacacgacuugacaauugucgcaggagaugucaagggcguccuaucaaaaggaaaacgcgcacucgccccgcccguuaacgaccucaaauacucauggaagacguggggcaaagcgaagaucuucaccccugaaacgcgcaauagcaccuuccugauagauggcccagacaccagcgaaugcccaaacgaacgccgagcguggaauuucuuagaagucgaagacuauggguuuggaauguucaccaccaacaucuggaugaaauucagggaagggagcuccgaagucugugaucacagacugaugucugcugccauuaaagaucagaaagcgguccacgcugacaugggauacuggaucgaaagcuccaagaaccagacauggcagauagaaaaagccucgcuuauugaggucaaaaccugucucuggccgaaaacccauacccuuugguccaacggcguccuagaaucacagaugcugauaccaaaggccuaugcgggaccguuuucacagcauaacuaucgacaaggcuacgcaacacaaacggugggccccuggcaccuagggaaauuagaaauagacuucggugagugccccgguaccacggucacuauucaagaagacugcgaucaccgcggacccucacuccgaacuacaaccgcguccgggaaacuggugacacaauggugcugccggaguuguacgaugccaccccugcgcuuucuaggugaagacgguuguugguauggaauggaaauaaggccccugagcgagcgagaagagaauaugguuaaaucccaagugagcgcagggcaagguacaucugagaccuucucgaugggacuucuuugccugacgcuauuuguugaggaaugccugagaagaagaguaacccggaagcauaugauccuaguagucgucacaacgcuaugcgccaucauccucggcggccucacuuggauggaucuucucagagcacugauaaugcuaggugauaccaugaguucccgaaugggaggccaaauccaucuagccauaauggcaguguucaaaaugucucccggguacgucuuaggcaucuucuuaagaaagcugacaucucgcgagaccgccuuaaugguuaucgguauggcuaugaccacggugcuauccaucccacaugaccuuauggaguuuauagauggaauuucgcucggccucauccuauugaaaauggugacccacuucgacaacacacagaugggaacccuagcccuaucacuaaccuucauuaaaucgaccaugccccucguaauggcguggcgaaccauuauggccguccuguucguggugacccuaaucccacuaugcaggaccagcugucuccaaaaacaaucgcauugggucgaaaucacugcccugauauuaggcgcacaggccuugccagucuacuugaugacacucaugaagggagccucaaaaagaucuuggccacugaacgaaggaaucauggcggugggacucgucucacuacuaggaucugcgcuauugaaaaacgacguuccucucgcaggacccauggucgccgguggacuccuacuugcagcauacgucaugagcggcucgagcgcggacuuaucucuagaaaaggcggccaacguucaaugggacgagauggcagacauaacgggcagcucacccaucauagagguaaagcaagacgaggacggcaguuucagcauccgagauguagaagaaaccaauaugauaacgcugcugguuaaguuagcacucauaacgguuucgggccuauacccacucgcuauccccgucacaaugacgcucugguacauguggcaaguuaagacucaaaggagcggcgcauuaugggacguuccgagucccgcagcugcccagaaggcgacacuaacagaaggcguuuacagaauaaugcaaagaggccuauucgggaaaacacaggucggggucgggauacacauggaaggcguguuccauaccauguggcacgucacaagaggcagcgucauaugccaugaaagcggaaggcucgaacccucaugggcagauguccggaaugauaugaucagcuacggcggaggcuggcgacuaggagacaagugggacaaggaagaagacgugcagguauuagccaucgaaccuggaaagaacccgaaacauguacaaacgaagccagggcuguucaagacgcucacaggcgaaaucggugccgucacacuugacuuuaagccuggaacaucgggaucaccgauuaucaaccgcaagggcaaagugaucggccuguaugggaauggggucguaaccaagaguggggacuacgugucggcaaucacccaagcugagaggauaggggagccugacuaugaaguagacgaagacaucuuccggaagaagaggcucaccauuauggaccugcaccccggcgccgggaagaccaaacgcauucugccaaguaucguaagagaagcacucaagcgacgccucagaacacucauauuagcccccacccgcgucguagcagcagaaauggaggaggcgcugcgagggcuaccuauaagauaucaaacccccgcaguucuaagcgaacacaccggaagagaaauaguggaccuuaugugccacgccaccuuuacaacucgauugcucagcucaaccagagugcccaacuacaacuugauuguuauggaugaagcccacuucacggacccgaguagcgucgcugcccguggauacaucuccacuagagucgaaaugggagaggcagcagcaauauucaugacugcaacaccacccgguacuaccgacccguucccacaaaguaacucaccgaucgaagacaucgaacgugaaaucccagagcgaucauggaauaccggauucgauuggauaaccgauuaccaaggcaagacagucugguucgugccauccaucaaggcaggcaacgacauagcaaacugccuuaggaaaagcgggaagaaagugauucaacugucccgaaagaccuuugacacggaguacccgaaaacaaaacuaaccgacugggauuucgugguaacuacggauaucagcgugaugggggcaaacuuccgagcagggagaguaauagacccaaggaggugccucaaacccgugauaaucacagaugguccagaaagaguaauccucgcaggucccaucccggucacaccagcgucagcggcucagcgacguggccgcauaggcaggaauccggcccaagaagacgaccaauacgucuucucuggcgacccucuacgaaaugacgaggaccacgcccauuggacugaggcaaaaauguuacuagacaacauuuacacgccagaaggcaucauacccacacucuucggacccgaacgagagaaaacacaagccaucgauggagaguuccgacuccggggugagcaacggaagacauuugucgaauuaaugcggaggggugacuugccaguuuggcucagcuacaagguugcaucagcagggauaaguuacaaagaccgcgaauggugcuucacaggagaacgaaacaaccagauacuagaagaaaauauggaaguggaaauauggacccgugaaggugagaagaagaaacuccgaccgaaguggcucgacgcaagaguuuacgcggaccccauggcucugaaggacuucaaagaguucgcuucaggacggaagaguaucacccuugauauccuaaccgagauugcaucacugccaacauaccugagcagccgugccaagcuggcguuggacaacauaguaaugcugcauacgacggaaagaggcggaaaggcuuaccagcacgcacucaacgaacuaccagaaucgcuggagacucucaugcuagucgcgcuacucggagcaaugaccgccggcaucuuccuauucuucaugcaaggcaagggcauaggggaacuaagcaugggcuuaauugcuauugcgggcgcaucaggccugcuauggggaacgaaaacaccuccacccuggggagcggcuagcaacauccuagaguucuucuugauggugcuucugauaccagagccagaaaagcaacggacuccccaagacaaccaauuaauauacgugauauugaccauacuaacuaucauaggauugguggcagcaaacgaaaugggucuaaucgagaaaacaaaaaccgauuucggauucuaccaggugaaaacagagaccacgauccucgacguagaccuacgcccugcauccgcauggacauuguacgcgguugcgaccacaauauugacgccgaugcuacgucacaccauagaaaacacauccgcaaacuuaucacuggcagcaaucgcaaaccaggccgcgguacuaaugggccucggcaaaggcuggccacuucauagaauggaccuaggcgugccccuccucgccaugggauguuacagccaagucaauccaaccacauugaucgcgucccucgugaugcuccuaguacacuaugcaauaaucggcccaggacuucaagcuaaagcuaccagggaggcccagaagagaaccgcugccgguauaaugaagaaccccacuguagacggaaucacgguaaucgaucucgaacccaucucauacgacccgaaauuugaaaaacaauuaggacaggucaugcuccuagugcugugcgcagggcaacuguuacuaaugagaacuaccugggcuuucugugaaguccucacccuagcaacgggaccaauccuaacauuaugggaagggaacccgggccguuucuggaacacaacaauagcaguaagcacggccaacauuuuccgcggaagcuaccuggcgggcgccgggcucgccuucagucucaucaaaaacgcucagaccccaagacgaggaacgggcgugacaggugaaacccuuggggagaaauggaaacgccaauuaaauucacuggaccgcaaagaguucgaagaauauaaaagaagcggcauccuugaagucgaccgaacggaggcuaaaucggcucucaaggauggaucaaaaaucaaacaagccguuucccgcggaaccaguaagauuagguggauuguagagcgaggaauggugaaaccuaaaggaaaggucgucgaccucggcugcggccgaggcggcugguccuacuacauggcgacccucaagaacguuacugaagugaaaggcuacacgaaagggggaccaggccacgaagaacccaucccaauggcaacauauggguggaacuugguaaaacuacacuccagagucgacguauucuacaagcccaccgagcaaguggacacccuacuaugcgauaucggugaguccucaagcaacccuaccaucgaagagggacggacgcuaaggguccugaaaaugguugaaccgugguuaucuagcaaaccugaguucuguaucaagguccuuaauccuuacaugcccacuguaaucgaagaauuagaaaaacuccaacggaagcauggcgggucguuaguccgcuguccucucagccggaacuccacacacgaaauguauuggguguccgguguuucgggaaauauagucucauccgucaacaccaccucaaagaugcugcucaacagauuuacgaccaaacaccgcaagccaaccuaugagaaagacgcagaccugggagcgggcacucggagcguauccaccgaaacagagaaaccagacaugacaaucauuggcagacggcuccagcgucuccaggaagaacaccaagaaacauggcacuacgaccaagaaaaucccuaucguaccugggccuaccacggcgguuacgaagcgccgagcacuggcagugcgaguucgauggugaacggaguuguaaaacuccuuacgaaaccaugggaugugaucccaauggucacccaacuggcaaugacggacacgacgccauucggacagcaacgcguauucaaggaaaaaguagacacgcgaacaccacagccuaaacccgggacccggaugguuaugacaacgacggcaaacuggcucugggcguuacuaggaaagaaaaagaacccaagacuuugcacgcgcgaagaguucaucaguaaggugagauccaacgcugccaucggggcggucucgcaagaagaacaaggauggacaaguuccuucgaggcugugaacgacagcagguuuugggaguuaguugauaaggagagagcccugcaccaggagggaaagugugaaucauguguuuacaacaugaugggaaaaagggagaagaaacugggcgaguucggcagagcgaaaggcagccgcgcgauuugguauauguggcucggagcucgcuuccuagaguucgaggccuugggguucuugaacgaggaccauugguuugggcgggaaaauuccuggagugggguggaaggagagggccuacauagacugggcuacauucuagaggaccuagacaaacgcgaccgaagucugguauuugcggacgacacagccgguugggacacaaagauucccgaagacgaccugcugaaagaaaaaccgauuccaggaccgauggcaccucaccagcguauaccggcaagagcaaucuucaagcuaaccuaucaaaacaagguagucaaagucuuacggcuaaagcuaaagggagccguaauggacauaauaagccgcaaggagcagcgaggcuccggacaagucggcaccuacggacuaaacaccuucaccaacauggaaguucaauuaauccgacagauggaagcggaagggguaaucacgcgagacgacaugcauaacccaaaaggccuuaaggaacgaguagaaaagugguuaaaggagugcggcgucgaucgccuugagaggauggcaauaucaggcgaugauugcguaguaaagccacuagacgagcgauucagcaccuccuuacuguuccuaaacgacaugggcaaaguccguaaagauaucccacagugggaaccgucaaaaggauggaaaaacuggcaagaagucccauucugcucucaccacuuccacaaaaucuuuaugaaagacggacgcagccucguagucccaugccguaaccaagacgagcuaaucggcagagcaaggauuucccagggggcaggcuggagccuccgcgaaacugccugcuugggcaaggcuuacgcccagauguggucccugauguacuuucaucgacgagaccucaggcucgccucuauggcgauaugcucagcagugccaaccgaaugguucccuaccuccaggacaacauggucaauccacgcucaucaccaauggaugacgacagaggacaugcucaaaguauggaacagaguauggaucgaggacaaccccaacaugaccgacaaaaccccgguccacucgugggaagacaucccguaccuaggaaagcgagaagacuuguggugcgggagccugauaggucucaguagccgagcgacaugggcaaagaacauacauaccgccaucacccaaguacgaaaucuuauaggaauagagggguacgucgauuacuuucuccugaucaagugguacucggcacccuucgaguccgagggcguccucuag

SEQ ID NO: 26237 - RNA, 9867 nt, Artificial Sequence
  derived and/or modified CDS sequence (opt11) from DENV-4__KF955510__SS-prME
agcaccauuaccuuacucugucugauccccacggugauggccuuccaccucuccacccgcgauggugaaccgcucaugauaguggccaaacacgaacgggggcgcccccugcuguucaagaccaccgagggcaucaacaaguguacgcucaucgcgauggaccugggggaaaugugcgaggacacuguaaccuacaaauguccccugcucgugaacacggagcccgaggacaucgacuguuggugcaaccugaccagcgccuggguuauguaugggaccugcacccaguccggggagcggcgccgggagaagcgcagcguggcgcugaccccucacuccggcauggggcucgagacgcggaccgagaccuggaugagcuccgaaggggcuuggaagcacgcccaacgcguggagaguuggauccugcggaagccaggcuuugcgcuuuccgccggguuuauggccuauaugaucggccagaccggcauccagcgcacgguauuuuucauccucaugaugcugguggcccccagcuacggcaugcgcuguguggggguugguaaccgcgacuucguagagggcguguccggcggggcgugggucgaucuggugcuagagcacggcgggugcgugacgacuauggcacagggcaagcccacccuugacuucgagcugaucaagaccacggcuaaggaggucgcccucuugcggaccuacugcaucgaagccagcaucucaaauauaaccaccgcgacccgcugcccgacgcaaggggagcccuaccugaaggaggagcaggaccaacaguacaucugucggcgcgacaugguugacagaggcugggggaacgggugcggacucuucgggaagggcgggguggucacgugcgccaaguucagcugcuccggcaagauaacggggaacuuagugcagauugagaaccucgaguacaccguagucgugaccgugcacaacggcgacacccacgccguagguaaugacacgagcaaccacggggaaacagccacuauaaccccucgcucccccagcguggaaguccgccucccggacuauggggagcugacgcuagacugcgagccccguagcgggaucgacuucaacgaaaugauccucaugaagaugaagaccaaaacuuggcugguacacaagcagugguuucuggaccucccccugcccuggaccgcgggagcggacacaagcgaggugcacuggaaccauaaggagcguauggucacguucaaggucccacacgccaagagacaggacgugaccguccugggcagccaggaaggagccaugcacuccgcacuugcaggcgcgaccgaggucgacagcggggacggcaaccacauguucgccgggcaccucaagugcaaggugcgcauggagaagcugcguaucaaggggauguccuacaccaugugcagcggcaaguucagcaucgacaaggagauggccgaaacgcagcacggcacaaccgucguuaaggugaaguacgagggcaccggggccccuugcaagguccccauagagauccgcgacgugaacaaggaaaagguggucggccggaucaucucgucuaccccuuucgccgagaauaccaacagcguaaccaacauugagcuagagccgcccuucggggacuccuauaucgucaucggcgccggcgacagcgcccugacccugcacugguuccgaaagggguccagcaucggcaaaauguuugagucaacguacagaggggcgaagcgcauggcuauccucggcgagacugcgugggacuucggcagugucggcggccuccugaccucacucgggaaggccgugcaccaggucuucggcucagucuacaccacaauguucgguggcguguccuggauggugcggauccugauagggcuauuaguccuguggaucggcaccaacagccgcaacaccuccauggcgaugagcugcaucguggugggcggcaucacccuguuccugggauucacaguacacgcugacauggggugcguggugagcugguccggcaaagaacuuaagugcgggagcggcaucuucguaaucgacaacguacacaccuggacggaacaguauaaguuucagcccgagucccccgcccgguuagcgucggccauacugaacgcccacaaggauggagugugcgggauacgcucuaccacgcgccucgagaacgucauguggaagcaaaucaccaacgagcugaacuacgugcugugggaggguggucacgaccucaccguugucgccggugacgucaagggcgugcuaaguaaagggaaaagagcccuggccccgcccgucaacgaccuaaaauacuccuggaagaccuggggcaaggccaagaucuucacgccggagacccggaacagcaccuuccugguggacgggccggauaccuccgagugcccgaacgagcgccgggcuuggaacuuccuggagguggaggacuacggguucgggauguucacgaccaacaucuggaugaaauuccgggaggggagcagugaggucugugaccaccggcuuaugagcgccgccaucaaggaccaaaaggcggugcaugccgacaugggauacuggaucgaguccagcaagaaccaaaccuggcagaucgagaaggcuagucugaucgaggugaaaaccugccuauggcccaagacccacacccuauggagcaacggggugcuggaaucccagaugcugaucccgaaggccuacgcgggcccuaucagccagcacaacuauagacagggguacgccacccagaccgugggccccuggcaccucgggaagcuggagauagacuuuggcgagugcccgggcacaacggugaccauucaggaggacugcgaucaucgggggcccagccugcgcacuaccacggccucgggcaagcucgucacccaauggugcugccgcagcugcaccaugccgccccugagauuccugggggaggacggaugcugguacgggauggagauucgcccucucaacgaaaaggaggagaacauggugaagagucaggugagugccggucaaggcaccagcgagacguucucgauggggcugcugugccuuaccuuauucgucgaggagugucugcggcgccgggugacacgcaagcauaugauucucgucguggugaccacguuaugcgccauuaucuuaggcgggcucaccuggauggaccugcuacgggcucuaaucaugcugggggauaccauguccggccgcaugggaggccaaauucaccuggccaucauggcaauguucaagaugucacccggguacguccucggcaucuuccugcggaagcugaccucccgcgagacggcccucauggugauagggauggcaaugacaaccgugcuuucaaucccgcaugaccuuauggaguucauugauggcaucucccugggccugauccuccucaagauggucacccacuucgauaacacacagguggggacacuggcgcugucccucaccuucaucaaguccacuaugccccugguuauggccuggcggaccauuauggccguccuguucgucgugacccucaucccccugugccgcaccuccugucuccagaaacagucccacugggucgaaauuacugcucucauccugggcgcccaagcgcugcccguguaccucaugacgcuuaugaagggggccagcaaacggaguuggccccuaaacgagggcaucauggccguggggcucgucagccuucugggcuccgcccuccugaagaacgacguaccccuagcaggccccaugguggccggaggguuacugcuggcagccuacgucaugagcggaucgucggccgaccucagccuggagaaggcggcgaaugugcaaugggacgagauggcugacaucaccggguccagccccaucaucgaggugaagcaggacgaggacgggagcuucagcauacgcgacgucgaggagaccaauaugauaacccugcucgugaaguuagccuuaaucacggucuccggacucuacccgcuugcuauccccguuaccaugacccugugguacauguggcaagugaagacccagcgaagcggcgcgcucugggaugugcccuccccagccgccgcccagaaggcgacgcugacggagggggcguaucgcauaaugcagcggggucuguucggaaagacgcaagucggcguggggauccauauggagggcguauuccacacuauguggcacgucacccgcggcagcgugaucugccacgagucagggcggcuagagccgagcugggccgacgugcgcaacgacaugaucagcuacggcgggggcuggcggcugggcgacaagugggacaaggaagaggacguacaggugcuggcgauugagcccgggaagaaccccaagcacgugcaaacgaagcccggucucuucaagaccuugaccggggagaucggcgccgugacccuggauuucaaaccggggacgagcggcagucccaucaucaaccgcaaggguaaggugaucggccucuacggaaauggcguggucaccaaaucuggcgacuauguaagugcuauuacgcaggcggaacgcaucggggagccugacuacgagguggacgaagacaucuucaggaagaagcgccugacaaucauggaccugcauccgggggccggcaagaccaagcggaucuuaccguccaucguccgcgaggcccugaagcggcgacugcguacccuaauucucgcccccacccgcgugguugcggccgaaauggaggaggcccugcgggggcugcccauucgguaccagaccccggccguuaagagugaacacacgggccgggaaauaguugacuuaaugugucaugccaccuuuaccacccgccugcuguccagcacgcgggugccgaacuacaaccucauagucauggacgaggcgcacuucaccgaccccucgagcguggccgcccgggguuacaucucuacccgcguagagaugggcgaggccgccgcgaucuuuaugacugccacacccccugggaccaccgaccccuucccccaguccaacucucccauagaggacauagaacgcgagauuccggagcggagcuggaacaccggcuucgauuggaucacggacuaccagggcaagaccgucugguucguccccuccauaaaggccgguaacgacaucgccaacugccugcgcaagagcgguaagaaggucauacagcuguccagaaagaccuucgacaccgaguaccccaagacgaaacucaccgauugggacuucguagugaccaccgauaucagcgaaaugggagccaacuuccgcgcgggccgcgucauugacccccggcgcugccugaagccggugaucuuaacugacgggccugaacgugugauccucgcaggccccauaccgguuaccccggcguccgccgcgcagaggcggggccgcaucggacggaauccagcucaggaggacgaccaauacguguucagcggcgacccccugcgcaaugacgaggaccacgcacauuggaccgaagccaagaugcugcuagacaacaucuacacccccgaagggaucaucccuacgcuauucggccccgagcgggagaagacccaggcaaucgacggcgaguuucgacucaggggcgaacagcggaagaccuucguggagcuaaugcggcgcggggaccugccagucuggcuguccuacaagguggcaagcgccgggaucucuuacaaggaucgggaguggugcuuuaccggggagcgcaacaaccagauccuugaggaaaacauggaaguggagaucuggacgcgcgagggugagaagaagaagcugcgucccaaguggcuggacgcccgggucuacgcugacccuauggcccucaaggacuucaaagaguucgcgucaggcaggaaaagcaucacccuggacauacugaccgagaucgccagccuccccaccuaccuaaguagcagagccaagcuggcccucgacaacaucgugaugcuucacaccacggagcgcggcggcaaggccuaccagcacgcguugaacgagcuccccgaaagccuggagacccugauguugguagcccugcugggcgccaugaccgccggaaucuuucuguucuucaugcagggaaaggggaugggcaaacuguccaugggccuaaucgcgaucgccguugccucaggccuacuguggguggcagaaauacagccgcaauggaucgccgcgucuaucauccuggaguucuuccucaugguguuacuggucccagagcccgagaagcagcgcacaccccaggacaaccagcucaucuacguuauccugacgauccugaccaucauugcccucguggccgccaacgagaugggcuuaauagagaaaaccaagacagacuucgguuucuaucaggcgaagacggagaccaccauccuggacgucgaucuacgcccggcgagcgccuggacucuguaugccguggccacuaccauccuaaccccaaugcuuagacacaccaucgagaacacauccgcgaaccugucccuggcggcgauugccaaucaggccgccguguugaugggacuggggaagggcuggccucugcaccgaauggaccucggcgucccccugcucgcgaugggcugcuacucucaaguuaacccgaccaccuuaaccgccagccuugugaugcugcucguccacuacgccaucaucggccccgggcugcaggcaaaggcgacgcgcgaagcacagaagcggaccgccgccggcaucaugaagaauccuaccguggacggcaucaccgugauugaccuggaaccuauuucuuacgacccgaaguucgagaagcagcuugggcaggucaugcugcugguacucugcgccggccaauuacuccucaugcggacgaccugggcguucugcgaggugcugacacuggccaccgggccaaucuugacgcuuugggagggcaacccugggcgguucuggaauaccaccaucgcugucaguacugccaauaucuucaggggcuccuaccuggcaggagcggggcucgcauuuucacugaucaagaacgcccagacgcccagacgcggcacggggaccacuggcgagacgcugggggagaaguggaagcggcagcucaauucccuggaucgcaagggcuuugaagaguauaagcggagcggcauccuggaggucgaccgcaccgaggccaaauccgcccucaaggacgggagcaagauuaaauacgccgugucccggggcaccagcaagauucgcuggaucguggaacgggggauggugaaaccgaaagguaagguggucgaccugggguguggccgcggcggcugguccuauuacauggccacuuuaaagaaugugaccgaggugaagggcuacacgaaaggggguccugggcacgaggagcccauccccauggccaccuacggguggaaccucgucaaacugcacucgggcguugacguguucuacaagccgaccgagcaggucgacacccuguugugugauauuggggaaagcuccagcaaccccacgauagaggagggccguacccugagagugcugaagaugguggagcccuggcucuccucgaaacccgaguuuugcauuaagguccugaacccguauaugccuaccgugaucgaggagcuggagaagcugcagcgcaagcacggggguucucugguccggugcccccugagccgcaauuccacucacgagauguacugggucagcggcguguccgggaacaucgucagcuccgugaauacgaccagcaaaaugcuucucaaccgcuucaccaccaggcaccggaaacccacguacgagaaggacgccgaccuaggcgcaggaacccgcagugugagcacggagacagagaagccggacaugacgaucaucggccgccgccugcagcggcuccaggaggagcauaaggagaccuggcauuacgaccacgagaacccguauagaaccugggccuaccacggguccuaugaggcccccagcaccggcuccgccagcuccauggucaacggcguggugaaacuucugacaaagccuugggacgucguuccgaugguuacccagcucgcuaugaccgauaccacgcccuuugggcagcaacgggucuucaaagagaagguggacacccgcacaccccagccgaagccugguacccggguggugaugacgacuaccgcuaacuggcugugggcgcugcucgggcgcaagaagaacccccggcugugcacccgcgaagaguucaucuccaaggugcggagcaacgccgccaucggcgccguguuccaggaggaacagggguggacguccgcgagcgaagccguuaacgauucucgcuucugggagcuggucgauaaggagcgggcccugcaccaggaggggaagugcgagagcugcguguacaacaugauggguaagcgcgagaagaagcugggggaguucggccgcgccaaggguucacgcgccaucugguauauguggcuaggugcccgcuuccucgaguuugaagcgcuagguuuccuaaacgaggaccacugguucggccgggagaacagcugguccggcgucgagggugagggauugcaucgccugggguacauccuggaagauaucgacaaaaaggacggcgacuugauauaugcagacgauacugccggcugggacacacgcaucaccgaggaugaccugcugaacgaggagcucaucacggagcagauggcgccacaccacaagauccuagcgaaggccaucuucaagcugacguaccagaacaagguggugaagguccuccgcccgacucccaagggggccguuauggauauuaucagccggaaggaccagcgcggcucgggacaggugggaaccuauggguuaaacaccuucacgaacauggagguccagcugauccggcagauggaggcagaaggcgugauuacccgugacgauaugcacaaccccaagggccucaaagagcggguggaaaaguggcugaaggagugcggugucgaccgccucaagcggauggcgauaucaggugacgacugcguggugaagccccucgacgagcgcuuuaguacuagcuugcuguuccucaacgacauggggaagguacggaaggacauaccgcagugggagccuuccaagggcuggaagaacuggcaggaggugcccuucugcagccaccacuuucacaagauauucaugaaggacgguaggucgcugguugucccaugccggaaccaggacgaguuaaucggcagagcucggaucagucagggcgcaggguggucccuucgcgagaccgccugccugggcaaggcuuacgcgcagauguggagucugauguauuuccauagacgagaccuccgccuggcgagcauggcuaucugcucugcagugcccacggaaugguuuccaacaagccggaccacaugguccauccaugcacaccaccaguggaugacaacagaggacaugcugaagguguggaaccgcgucuggaucgaagauaacccaaacaugauagauaaaacccccgugcacagcugggaggacaucccguaucucgggaagcgugaagaccuguggugcggcagcuuaaucgggcucuccucgcgcgcgaccugggccaagaauauccacacggccaucacacaggugcggaaccugauaggcaaagaggaguacgucgacuacaugccagucaugaaacgcuacagugcccacuucgaguccgagggcgugcucuga

SEQ ID NO: 26238 - RNA, 9867 nt, Artificial Sequence
  derived and/or modified CDS sequence (opt11) from DENV-4__GQ868594__SS-prME
agcaccaugacccugcucugcuuaauccccacggucauggcguuucaccugucaacccgcgacggcgagccccucaugaucguggccaagcacgaacgcgggcgccccuugcucuucaaaaccaccgagggcaucaacaagugcacgcucaucgccauggaccugggggagaugugcgaggacaccguuaccuacgagugcccacugcucgugaacaccgagccugaggacaucgacugcuggugcaaccugaccagcgccugggugauguacgggacaugcacgcagagcggggagcggcgccgagaaaagcgcagcguggcccugacgccccacuccggcaugggccucgagacccgggccgagacuuggaugagcuccgagggggccuggaagcacgcgcagcgcguggagaguuggauccugcggaaccccggcuucgcucugcucgccggguucauggcguacaugaucggccaaaccgguauucagcgcacuguauuuuucgugcugaugaugcugguggcucccaguuacggcaugcggugcgugggggucgguaaccgugacuucgucgaaggcgugucagggggggccuggguggaccuggugcuggaacacggcgggugugucacgaccauggcucaaggcaagcccacccuggauuucgagcucaucaagaccacagccaaggaaguggcccuguugcggaccuacugcaucgaggcauccaucagcaacaucacgacagccacgcgcugcccgacccagggagagcccuaccuaaaggaggagcaggaccagcaguacaucugccggcgcgacguggucgacagaggcuggggcaacggcugcggccuguucgggaaaggggggguggugaccugcgccaaauucuccugcagcggcaagaucacaggaaaccugguccaaauugagaaccucgaguauacggugguggucacugugcacaacggcgacacccacgccgucggcaacgacauccccaaccacggggugacggccacgaucacgccucggucccccagcgucgaggucaagcugcccgacuacggggagcugaccuuagauugcgaaccccgcuccgggaucgacuucaacgagaugauccugaugaaaaugaaaaaaaagaccuggcugguccacaaacaaugguuccucgaucugccccugccgugggcggccggcgccgacacgagugaagugcacuggaacuacaaggaacgcaugguuaccuucaaggugccacacgccaagcggcaggacgugaucguccucgggucccaagagggcgccaugcacagugcguugaccggcgcgaccgagguggacaguggugauggcaaccacauguucgccgggcauuuaaaaugcaaagugcgcauggagaagcuccgcauuaaggguauguccuacaccaugugcagcggcaaguuuuccaucgacaaggagauggccgagacgcagcacgggacgacggucgucaaggugaaguacgagggcgcuggggcuccuugcaaggucccaaucgagauccgggaugugaacaaggagaagguggucggccgcaucaucagcuccacgccguucgcggaguacacgaacagcguaaccaacauugagcuggagccgccuuuuggggacuccuacauugugaucggcgucggcgacagcgcccugaccuugcacugguuucggaagggguccagcauuggcaagaugcuggaguccaccuaccgcggggcaaagcggauggcgaucuuaggcgagacggcgugggacuucgggagcgugggcggccuccugacaucccuggggaaggcggugcaccagguauucgggagcgucuauaccaccauguucgggggcguuuccuggaugguccgcauccucauaggguuccuggugcuguggaucggaacgaacucucgaaauaccuccauggccaugaccuguaucgccgugggggggaucacgcuguuccucggauuuacgguccacgcugacacugggugcgccguuagcugguccggaaaggaacugaagugcgguucgggcaucuucguuaucgacaacguccacaccuggaccgagcaguacaaguuccagcccgaaaguccggccagacuggccucagccauacucaacgcgcacaaggacggugugugcgggauccggagcacgacacgccuggagaacauaauguggaaacagaucaccaacgagcugaacuacgugcucugggagggcgggcacgaccugaccgucguggcaggcgacgugaaaggcguccuguccaaggggaagcgagcccucgcuccgcccgugaaugaccugaaguacagcuggaaaacguggggcaaagccaagaucuuuacccccgaggcgaagaacuccacuuuccucaucgacgggccggacacgagcgagugcccgaaugagcgccgggcguggaacuucuuagagguggaggacuacggcuucgggauguucacuaccaauauuuggaugaaguuccgcgagggcuccagcgaggucugugaccacagauuaauguccgccgcuauaaaggaucagaaagcuguacaugccgacaugggguacuggaucgagagcuccaaaaaccagacguggcagauagagaaggccagccugaucgaggugaagaccugcuuguggcccaagacgcacacccuaugguccaacgggguucuggagagccagauguuaauuccgaaggccuaugccggcccuuucucacagcacaacuaucgccagggguacgcgacucaaaccgugggccccuggcaccuggggaaacuggagaucgauuucggugagugccccggcacgaccgugacuauccaggaggacugcgaucaccggggcccgagccuccgcaccaccacggccuccgggaagcuggucacucaguggugcugccggagcugcaccaugccgccacuucgcuuucucggggaggacggcugcugguacgggauggagauccgcccccugagcgagaaggaggagaacauggugaagucccaggugagcgccggccaaggcaccuccgagacguucucgauggggcugcucugucucacccuguucguugaggagugucuccggcgccgggugacccgcaagcacaugauccugguaguugugaccacgcugugugccauuauacucggcgggcugaccuggauggaucugcuccgggcuuuaaucaugcugggcgacacgauguccggccgcaugggcgggcagauacaucucgcgaucauggccgucuucaagaugagcccgggguacgugcugggcaucuuccuacggaaguugaccucccgcgagacggcccugauggugaucgggauggcuaugaccaccguccuaagcaucccccacgaccucauggaguucaucgacggcaucucacuuggccuaauccuccugaaaauggucacccacuucgacaacacacaggucgggacccuggcccuaagccugaccuucauccgcuccaccaugccccuggucauggcguggcgcacaaucauggccguccucuucgugguaacccugaucccccucugucggaccaguugccuccagaaacagucccacuggguggagaucaccgcccugauccugggcgcccaagcgcucccgguguauuugaugacgcugaugaagggcgccagcaagcgcuccuggccccuuaacgagggcauaauggccguugggcuggugagccugcugggcuccgcacugcugaagaacgaugugccccuggccgggccaauggucgcgggcgggcuguugcucgcagccuaugugaugucaggguccagcgccgacuuaagccuggagaaggcagcgaacgugcagugggacgagauggccgacaucaccgggucgaguccgaucaucgaagucaagcaggacgaggacggguccuucagcauccgggacaucgaggagaccaacaugaucacucuuuuggugaagcuggcccucaucacgguguccggccuguacccccuggccauccccguuacaaugacccugugguacauguggcaggucaaaacccagcgcagcggcgcccugugggaugugcccuccccggcggccgcccagaaggccacgcugaccgagggggucuaccggaucaugcaacgcggccucuucgggaagacacaggugggcgugggaauccacauggagggcgucuuccauaccauguggcacguaacgcggggcagcguaaucugccacgagacagggcgacuggagcccaguugggccgacguacgaaacgacaugaucagcuacggcgggggcuggcgccugggcgacaagugggauaaggaggaagacgugcagguccucgcgauagaacccggaaagaaccccaagcacguccagaccaagccuggccuguuuaagacacugacuggggaaaucggcgccgugacgcucgacuucaagcccggaaccuccggcagucccaucaucaaccggaagggcaaggucaucgggcuguacgggaacggggucgugaccaagucuggcgacuacguaagcgcaaucacccaagccgagcgcacgggagagccggacuacgaggucgacgaggacaucuuccgcaagaagcggcugaccaucauggaccuccauccuggagcggguaaaaccaagcgaauccuaccguccauagugagagaagcccugaagcgccgucuaagaacacuaaucuuagcacccacgcguguggucgccgccgagauggaggaggcgcugcgcgggcuaccgauccgguaccagacccccgccgucaagagcgagcacaccgggcgggaaaucguggaccuuaugugccacgccaccuucacgacgcggcugcucuccucuacccgcgugcccaacuacaaucugaucgugauggaugaggcccacuucacugaucccuccagcguggccgcgcggggguacauuagcacgcgcguggaaaugggcgaggcugccgcaaucuucaugaccgccaccccgcccggggcgaccgaucccuucccccaauccaacucgccgaucgaggauauugagcgggagauccccgagcgaagcuggaauacuggcuucgauuggaucaccgacuaucagggcaagacagugugguucgugcccagcaucaaggccggcaacgauaucgccaacugccugcggaagucgggcaaaaaggucauccagcuaucgcgcaagaccuucgacacggaguacccuaagacaaagcuuaccgacugggacuucguggucacaacggacaucagugagaugggggcuaacuuccgggcgggccgcgugaucgacccgcgcagaugccugaagcccgucauuagcaccgacgggcccgagcgggucauucucgccggcccgaucccgguuacccccgccuccgccgcccagcggcggggccggaucgggcgaaaccccgcacaggaggacgaccaguacguuuucagcggcgauccccugaagaacgacgaggaccacgcccacuggaccgaagccaagaugcugcucgacaacaucuacacaccggagggaauaaucccaacccuauucggcccggagcgggagaagaaccaggccaucgauggcgaguuccgccugcgcggagagcagcgcaagaccuucgucgagcucaugcgaaggggcgaccugccuguauggcuguccuauaagguggccagcgcggggaucuccuauaaagaccgggaguggugcuucacgggcgagcgcaacaaccagauccucgaagagaacauggaggucgagauauggacgcgggagggggaaaaaaagaaacugcgcccgaagugguuggacgcccgggucuacgccgaccccauggcccugaaggacuuuaaagaguucgcuaguggccgcaaguccaucacccuggacauccugacagagaucgcgagucucccgaccuaccuguccagccgggccaagcuggcccuagacaauauugugauguuacacacaaccgaacgcggcggcaaggccuaccagcacgcgcugaacgagcucccggagucccuggagacccugaugcucguagcccugcugggcgcuaugaccgccggaaucuuccucuuuuucaugcaggguaaggggaucggcaaguugagcaugggccugaucgccaucgcgguggcuagcgggcuccuuuggguggccgagauccagccacaguggaucgccgccuccaucauauuggaguucuuccucaugguccugcucauucccgagcccgagaagcaaaggaccccgcaggacaaccagcucauauacguuauuuuaacgauucugaccaucaucggucucaucgcggccaacgagauggggcugaucgaaaagaccaagaccgacuucggcuucuaccaagugaagacggagaccaccauuuuggacgucgaucuccgccccgcaagcgccuggaccuuauacgccguugcgacaaccauccucaccccaaugcuccgccacaccauagagaacacguccgccaaccugucacuggcggccauagccaaccaggcggccgugcucaugggguugggcaagggauggcccuugcaccggauggaccucggggucccccugcuggccaugggcugcuacagccaggucaaccccaccaccuuaaucgcuagccuggugauguugcucguccacuacgcgaucauuggacccggccuucaagcuaaggccacaagagaagcccagaaacggacagccgcgggcauaaugaagaaccccaccguggacgggauaaccgugauugaucucgagccgaucuccuaugaucccaaguucgagaagcagcucggccaggucaugcuguuagugcugugcgccgggcagcuuuugcuuaugcgcaccaccugggcauucugcgagguguuaacccuagccaccggccccguccucacccucugggaggguaaccccggacgguucuggaauacgaccauagccgugagcaccgcgaacaucuuccgcggcagcuacuuagccggggccggccucgccuucagccugaucaagaaugcucagaccccgcggcgcgggacgggcacaaccggugagaccuuaggagagaaguggaaacggcagcucaacucccucgaccgcaaggaguucgaggaguacaagcggagcggcauccuggagguggaccgcaccgaggccaaauccgcccucaaggacggcucuaagaucaaacacgcuguuucccgggggagcuccaagauccguuggaucgucgagcggggaaugguaaaacccaagggaaagguaguggaccuggguugcggccgcggcggcuggagcuacuacauggccacccugaagaacgugaccgaagucaagggcuacaccaaagggggccccggucaugaggagcccauccccauggcgacauacgguuggaaccucguuaaacugcacaguggcguggacguuuucuacaagcccaccgaacagguagauacccuccucugcgacaucggggagagcagcucaaaccccaccaucgaagagggccggacacugcgcgugcugaagauggucgagccguggcucagcaguaagccggaguucugcauaaagguacugaaucccuacaugcccacgguuaucgaggagcuggagaaacuccagcggaaacacgggggcagccuaguccgcuguccucugucgcgaaacagcacgcacgaaauguacugggugucaggcguaagugggaacaucguuuccagcguaaacaccacguccaagaugcugcugaaccgguucacgacacgccaccggaagcccaccuacgagaaggacguagaccuuggcgccgggacccgauccgugucuacggagacugagaagcccgauaugaccaucauuggccggcgccugcagcggcuucaggaggagcacaaggagaccuggcacuacgaccaggagaacccuuaccgcacgugggcuuaccacggguccuaugaggcgccguccaccggcagcgcguccagcauggugaauggagucguuaagcuacugacgaagccaugggacgugauccccauggucacgcaacucgcgaugacagacacuacuccuuucggacagcagcggguguucaaggagaagguggacacaaggacgccgcagcccaagcccgguaccaggauggugaugacuaccaccgccaacuggcugugggccuugcucgggaagaagaaaaacccccgccugugcacucgggaggaguucaucuccaaggugcguucuaacgccgccaucggugcgguguuucaggaggaacagggguggaccuccgccuccgaggccgucaacgauagucgguucugggaguugguggacaaggagagagcucuccaccaggaaggcaaaugcgaguccugcguguacaacaugaugggcaagagggagaagaaguugggugaauucggcagagccaaggggagccgcgcuaucugguacauguggcucggcgcccgcuucuuggaguucgaggcacugggguuccugaacgaggaucacugguucggccgggagaauucauggucgggcguggagggggagggccuucacagacugggguacauccuggaggacauugacaaaaaggauggcgauuugaucuacgccgacgacaccgcgggcugggacacacgcaucaccgaggacgaccugcugaacgaggaacugauuaccgagcagauggccccgcaccauaagauccuggcuaaggccaucuuuaagcugaccuaccagaacaagguggugaaggucuugcggcccacgcccaagggggccgugauggacaucaucucccgcaaggaccagaggggcagcggccaagucggcaccuacgggcugaacaccuucaccaacauggagguccagcugauccggcagauggaggccgagggcguuauaacccaggacgauaugcacaaccccaagggccucaaggagcgaguggagaaguggcugaaggagugcggggucgaccgccugaagcggauggccaucuccggcgaugacugcguagucaagccgcucgacgagcgcuuuagcaccucacugcuguuccucaaugacauggggaagguucggaaggacaucccccagugggagccgagcaagggcuggaagaacuggcaggagguccccuucuguucccaccacuuccacaagauuuucaugaaggaugggcgcagccugguggucccgugccggaaccaggacgagcugaucggccgcgccaggaucucccaaggcgcaggguggucucuccgcgagaccgccugucugggcaaggcguacgcucaaauguggucuuuaauguacuuccacaggcgcgaucuccggcuggccagcauggccauuugcagcgccgucccaacugaaugguucccuacgucccgcacgacauggagcauccacgcccaccaccaguggaugacaacggaggauaugcugaagguguggaaccgggucuggaucgaggacaaccccaacaugacggauaagacaccggugcacuccugggaggacauucccuaucucgggaagcgggaggaccuuuggugcgggucacugauagggcugagcagccgcgccaccugggccaagaacauccacacggcuaucacgcagguccggaaucugaucggcaaggaggaguacguugacuacaugccggugaugaagcgcuacuccgcccccuuugaguccgagggcguguuguga

SEQ ID NO: 26239 - RNA, 9867 nt, Artificial Sequence
  derived and/or modified CDS sequence (opt11) from DENV-4__FJ024424__SS-prME
agcaccauuacccugcucugccugauuccuacggugauggccuuccaccuguccacccgcgacggcgagccgcucaugauaguagccaagcaugaacgggggcgcccccuacucuucaagacuaccgaggguauuaacaaguguacucucaucgcgauggaccugggggaaaugugcgaggacaccgugaccuacaagugcccucugcucgugaacaccgagcccgaagacaucgauugcuggugcaaccugacuucgacgugggucauguacggcaccuguacucaguccggggaacgucgccgcgaaaaacguuccguagcacugacgccccacuccggcaugggccuagagacccgggcggaaaccuggaugagcucggagggugccuggaagcaugcccagcgcguggagucguggauccugcggaaccccggcuucgcgcugcuggcaggguucauggccuacaugaucggccagaccgggauccagcgcaccgucuucuucguccugaugaugcugguagcacccuccuacgguaugcggugcgucggcgugggcaaccgagacuucguggagggcgucagcggcggcgccuggguggaccucgugcuggagcacggcggguguguaaccaccauggcccaggggaagcccacccuggacuucgagcucaccaaaaccaccgcuaaggagguggcccugcuacggaccuacugcaucgaggccuccaucagcaacauuacaaccgcgacccgcuguccgacccagggggaacccuaccuaaaggaagaacaggaccagcaguacaucugccggcgcgacguggucgaccggggcugggggaauggcugcgggcuguucgggaagggcgggguggugaccugcgccaaguucuccugcagcgggaagauaacagggaaccucguccagaucgagaaccucgaguacaccguggugguuaccgugcacaacggcgacacgcaugccgucggcaacgauaccaguaaucacggggugacaacuacgaucacaccccggagccccuccguggaggucaagcugccggauuacggcgagcugaccuuggacugcgagccucgcucagguaucgacuucaacgagaugauucugaugaagaugaagaagaagaccuggcuggugcauaagcagugguuccucgaccugccccugcccuggaccgccggggcagauacguccgaggugcauuggaauuacaaggagaggauggugaccuucaaagucccgcacgcgaagcggcaggacguaaccguccuagggagccaggagggcgccaugcacagcgcacuggccggggccaccgagguugacucuggggacggcaaccacauguucgcagggcaccugaagugcaaagugcgaauggaaaaacuccgcaucaaggguaugaguuacacgaugugcuccgguaaguucucaauagacaaagaaauggccgagacccagcacgggacaacugucgugaaggugaaguacgaaggcgccggggcccccuguaaggucccgaucgagauccgagacguuaauaaggagaagguggucgggcgcgugauaucgagcacgccccuggccgaaaacacuaacagugugaccaacaucgagcuggagccacccuucggggacagcuacaucguaaucggcgugggcaacucggcccucacacuacacugguuccggaaggggagcuccaucggcaagauguucgagucgacguaccgcggugccaagcggauggccauccugggcgagaccgccugggacuucgggucagugggcggccucuucaccagcuuggggaaagcaguacaccagguguucggguccguguauaccacaauguuuggaggcguguccuggaugauccgcauacugaucggguuccucgugcuguggaucggcacgaacucccgcaacaccagcauggccaugaccugcauagccguaggcgggauaacgcucuuuuuaggcuucaccguccaggccgacauggggugcgugguguccuggagcggcaaggaacucaaaugcgggagcggaaucuucguuguggacaaugugcauacauggaccgagcaguauaaauuccagcccgagucccccgcgcgccuggcaucugcgauacugaacgcccacaaggauggcgugugugggauccgcuccacgacccgccuugagaacgugauguggaagcagaucaccaacgagcucaacuacguguuaugggaaggcgggcacgaccucaccgucguggccggcgacgugaagggcgucuugaccaaggggaagcgugccuuaacaccgcccgugagcgaucugaaguauucuuggaagacauggggcaaggcgaagaucuucacccccgaggcaaggaacucaacuuuucugaucgaugggcccgauacauccgaaugcccgaacgaacggcgcgccuggaacagccuggagguggaagauuacggcuuugggauguucacgaccaacauauggaugaaguuccgggagggcuccagcgagguaugcgaccaccgcuuaauguccgccgccaucaaagaccagaaggcgguacaugccgacaugggguacuggaucgagucuuccaagaaccagacguggcagaucgagaaggccagccugaucgaggugaagacgugucuuuggcccaagacccacaccuugugguccaacggaguccuggagagccagaugcugauacccaaguccuacgcagggccguucagccagcacaacuaccggcagggguaugcgacgcagacgguggggcccuggcacuuggggaagcuggagauugauuucggugagugccccggcaccacgguaaccauccaggaggacugugaccaccgcgggccuagccugcggacgacgacggccuccggcaaacucgucacucaguggugcugccggucuugcacuaugccgccccugcguuuccugggggaggacgguugcugguacgggauggagaucaggccccucuccgagaaggaggagaacauggugaaaucacaggucgccgcaggucagggcaccuccgagaccuucagcauggggcugcugugucucacccuguucguggaagagugucuccgccggcgcgugacgcggaagcacaugauucucgcggucguaauuacgcucugugcgaucauuuugggcggucucaccuggauggaccuccugcgggccuuaaucaugcugggagauaccauguccggccggaucggagggcagacgcaccuggccaucauggcaguguuuaagaugagccccggguacguacucggcguauuccugcgcaaacugaccucccgggagaccgcucucaugguuaucgggauggcgaugaccacuacccugagcauuccgcacgaucucauggagcucauagacggaaucucccugggucuaauucuccugaagaucguaacccaguucgacaauacacaggucggaacacuggcccucagccugaccuucauccgguccaccaugucguuggugauggccuggcggaccaucauggccguccucuucgugguaacgcugaucccccugugccgcaccucaugucuccaaaagcagagccacugggucgagaucacggccuuaauccugggcgcgcaggcccucccuguguaccugaugacccugaugaagggcgcgucccgccgaagcuggccccucaacgagggcaucauggccguggggcuggucucccugcucggcagcgcgcugcugaagaacgacgugccacucgcugguccaaugguggccggagggcuccugcucgccgccuacguaaugagcggcuccagcgcagacuugucgcuggagaaagcugccaacgugcagugggacgagauggccgauaucacgggcagcucccccaucaucgaggugaagcaggacgaggaugggucauucuccauccgggauguggaagagacgaacaugauaacccuccucguuaaacuggcgcucaucaccgugucaggacuguacccccuggcgaucccagucacgaugacgcucugguacauguggcaagugaagacccagaggaguggcgcacugugggacgugcccaguccggccgccacccagaaggccgcguuguccgagggagucuaucggaucaugcagcgcggccucuucgggaagacccaggucggcguggggauccauauggagggcguuuuccacacaauguggcacgugaccagaggcucagugauuugccacgagacugggcgccuggaacccuccugggccgacgucagaaacgacaugaucagcuacggcgggggcuggcgccugggggacaaaugggauaaggaggaggacguacagguguuagccaucgagccggggaaaaaucccaaacacgugcagacaaagcccggacuguucaagacgcugaccggggagaucggcgcagugacccucgacuucaagcccgggaccuccggaagcccuaucaucaaccgcaagggcaaggugaucgggcuguacggcaacggagucgugacaaaguccggcgacuacguaucagccaucacccaggccgagcggaucggggagccugacuacgaggucgacgaggacaucuuuaggaagaagcgccugacgaucauggaccuccacccuggugccggcaaaaccaagcgcauccugccguccauagugcgggaggcccugaagcggcgguugcgcacccuuauccuggcccccacaaggguggucgcggcagagauggaggaggcccuaagaggccugccuauccgguaccaaacgcccgcagugaaaucggagcacaccggccgcgagaucguggaccugaugugccacgcaacguucacuacucggcuguugaguuccacccgcgucccgaauuacaaccugauagugauggacgaggcgcacuucacggacccuucuuccgucgccgcccgggguuauauuagcacucgcguggaaaugggcgaagccgccgcgaucuucaugaccgccacaccacccggggccacggacccguucccucaguccaauagccccaucgaggauaucgagcgggagauccccgagcgcuccuggaacaccggcuucgacuggauaaccgauuaccagggcaagaccgugugguuugucccgucaaucaaagccgggaacgacaucgccaacugcuugcguaaaucugggaagaagguaauccaacucagccguaagacguucgauaccgaauacccaaagaccaaacuuaccgauugggauuucguggucaccacagauaucuccgagaugggggcuaacuuccgugccggccgggugaucgauccacgccggugccugaagccggugauccucaccgacgggccggagcgagucauccuggccggacccaucccagugacaccggcuagcgcagcccagcgccgaggacggauugggcguaauccgacacaagaagacgaccaauacguguucuccggcgacccacugaaaaacgacgaggaccacgcccacuggaccgaggcgaagaugcuccuggauaacaucuacacucccgaggggaucauccccacccuguucggcccagagagggagaagacgcaggccaucgacggagaauuucgccucagaggggaacagagaaagaccuucgucgaguuaaugcggcgcggagaccugccuguguggcucagcuauaagguggcgucagccgguauauccuacaaggaccgggaguggugcuucaccggcgagcgcaacaaucagauacuggaggagaacauggaggucgagaucuggacacgagaaggggaaaagaagaaauugcgcccccgguggcucgacgcccguguguacgccgaccccauggcccuuaaggacuucaaggaguucgcuuccggcagaaagagcaucacccuggacauccucacagagauugccucacugccgaccuaccugagcagcagagcuaagcucgcacuggacaacaucgugaugcuacacacgaccgagcgcggcgggcgugccuaccagcacgccuugaacgaacugccggagucccuggagacgcucauguugguggcauugcucggcgccaugaccgccgggaucuuucuguuuuucaugcaagguaaggggaucggaaaacugaguaugggauuaaucaccaucgccguggccuccggacugcuguggguggccgagauccagccccaguggaucgcagccagcauaauccucgaguucuuccugaugguccugcucaucccggagcccgagaagcaaaggacgccccaggacaaccaacugauuuacgugauccugacgauccugaccaucaucggccugaucgcggcuaacgagaugggcuugaucgagaagaccaagacugacuucggcuucuaucaagugaagacggagaccaccauccucgacgucgaucugcggcccgccuccgcauggacuuuguacgcgguggcgacgaccauccucaccccgaugcugagacacaccaucgaaaacacgucagccaauuuaagccuggccgccauagccaaccaggcggcggugcugauggggcugggcaagggcuggccccuccaccguauggacuuggggguuccccuccucgccauggggugcuacagccaggugaaucccaccacucuaacagcguccuugguaaugcugcugguccauuacgcaaucaucgggccggguuugcaggcgaaggcgacacgcgaggcccagaaacggacggccgcgggcaucaugaagaaucccacaguugacgguaucaccgucaucgaccucgagcccauauccuacgaucccaaguucgagaagcagcugggccaggucaugcugcuugugcugugcgccgggcaacugcuccugaugcgcacuacuugggccuucugcgaaguguuaacccucgcuaccggcccgauucugacucugugggagggcaaccccggccgguucuggaauaccaccaucgccgucucaaccgcgaacaucuuccgcggaaguuaccuugcaggggcuggccuggccuucuccuugauuaagaacgcacaaacgcccagaagggguaccggcacuaccggggagacucucggggagaaauggaagcggcagcuaaauucgcuagaccguaaagaauuugaggaguacaagcgguccggcauucucgaaguagaccgcacggaagcaaagagcgcccugaaggauggguccaagaucaagcacgcagugagccggggcuccagcaagaucagauggaucgucgaacgggggauggugaagcccaagggcaagguggucgaccugggguguggccgcggugguuggagcuacuacauggccacacugaagaacgucacggaggugaagggcuauacaaaagggggcccggggcaugaggagccaauacccauggccacguaugguuggaaccuggucaagcugcacagcggcguagacguguucuacaagcccacugagcaggucgacacucuccugugcgauauaggagagagcuccagcaacccgaccaucgaggagggacggacgcuacgagugcuuaaaaugguggagccauggcucucgagcaaacccgaguucugcaucaagguccuaaaccccuacaugcccaccguuauugaggaacuugagaagcugcagcguaaacacgggggcaacuuaguccgcugcccccuguccagaaacucaacccacgagauguauugggucucgggagcgagcggaaacaucguuuccucggucaacaccacguccaagaugcuccugaaccgauuuaccacccgccaccguaagcccacauacgagaaggacguggaucugggcgccgggacgaggagcguguccaccgagacggagaagccagauaugaccaucaucggccggaggcuccagcggcugcaggaagaacauaaggagacguggcacuacgaccaagagaauccguauagaaccugggccuaccaugggagcuacgaggccccauccacuggcucggcguccuccauggucaauggcguggugaagcugcucaccaagcccugggacaugauacccauggucacgcagcuggccaugaccgacaccacccccuucgggcagcagcgcguguucaaggagaagguggacacgcgcacuccccagcccaaaccaggcacccggauggucaugaccacgacggccaacuggcugugggcccuccugggaaagaagaagaacccgcgccugugcacccgggaggaguucaucagcaagguucggucaaacgccgccauaggcgcuguguuccaggaggaacaaggcuggaccagcgccuccgaggccguaaacgacagccgguucugggaguuagucgacaaggagcgcgcccugcaucaggagggcaagugugaauccugcguauauaacaugaugggcaagcgagagaagaagcugggagaguucggccgcgcgaagggcagccgcgccaucugguacaugugguugggcgcgcgguuuuuagaguucgaggcccugggguuccucaacgaggaccauugguucggccgcgaaaacuccuggucuggugucgagggagagggccugcaccggcugggauauauacucgaggagaucgauaagaaagacggcgauuugauguacgccgacgauacggcaggcugggauaccagaaucacugaggacgaucugcagaacgaggagcucaucaccgaacagauggccccucaccacaagauccucgcaaaggccaucuucaaguuaaccuaccagaacaaaguggugaagguucuuagacccacaccucgcggggcgguaauggacaucaucucgaggaaggaccagcgcggcuccgggcaggucggcaccuacgggcucaacacuuuuaccaacauggaaguccagcugaucagacagauggaggcagagggcgugaucacgcaagaugacaugcaaaaccccaagggcuuaaaggaaaggguugagaaauggcugagggagugcggcgucgaccgccugaagcggauggccaucaguggggacgauugcgugguuaaaccccucgacgagagauucggcaccagccugcuguuccucaacgacaugggcaagguacggaaggacaucccccaaugggagccgucuaagggguggaaaaauuggcaggaggugccuuucugcagccaucacuuccacaagaucuuuaugaaggacggccgcagucugguggucccuugccggaaccaggacgagcugaucggccgagcccggaucagccagggcgccggcuggucccucagagagaccgcgugccuggguaaggccuacgcccaaauguggagccucauguacuuccaccgacgggaccuccgccuggccagcauggccaucugcagugcggugcccacagagugguuccccacgagucgcaccacuugguccauccacgcccaccaccaguggaugaccacggaggacaugcuuaagguguggaacaggguguggaucgaggacaacccuaacaugaucgacaagacccccguucacagcugggaggacauccccuaccugggaaagcgggaggaccuguggugcggcucguugaucgggcucagcucccgcgccaccugggccaagaacauccacacagccaucacacaagugcggaaccugaucgggaaggaggaauacgucgacuacaugccugugaugaagcgcuacagcgcgcccuccgaaagcgaagggguacuguag

SEQ ID NO: 26240 - RNA, 9867 nt, Artificial Sequence
  derived and/or modified CDS sequence (opt11) from DENV-4__EU854295__SS-prME
agcaccaucacguugcucugucugaucccuacgguuauggccuuccaccuauccacccgcgacggcgagccgcuaaugaucgucgcuaagcacgaacgggggcgccccuuacucuucaagaccaccgagggcaucaacaagugcacgcucauugcgauggaccugggggaaaugugugaggacaccgugaccuacaaguguccucuguuagucaacacggagcccgaagacaucgacugcuggugcaaccugacgagcaccugggucauguacgggaccuguacccagucaggggagcggcgucgugaaaaacgcagcguggcccugacgccccacuccggcaugggccucgaaacccgggccgaaacuuggaugagcuccgagggggccuggaaacacgcccaacgcgucgaaucuuggauccugagaaaccccggcuuugcgcuguuagccggcuucauggccuacaugauaggccagaccgggauccagcgcacggucuuuuucgugcuuaugaugcugguggccccuuccuacggcaugcggugcgucgggguggggaaccgugacuucguggagggcgugagcggaggggcguggguggaccucgugcuggaacacggcgggugugugaccaccauggcucagggaaagcccacccuugacuuugagcucacgaagaccaccgcgaaggagguggcccugcugcggaccuacugcaucgaggccaguaucucuaacaucaccacggcgacccguugccccacccaaggggagcccuaucugaaggaggagcaggaccagcaguacaucugccggcgcgacgucguggaccggggcugggggaacgguugcggccucuucgggaaaggcggggugguaacuugugccaaguucuccugcagcggcaagauaaccgggaaccugguccagauugagaaccucgaguacaccguuguugucaccgugcauaauggugacacgcacgccgucggcaacgacaccuccaaccacggggugaccgccacgaucacgccccgcagccccuccguggaggucaaacuaccggacuacggcgaguuaacccucgacugugaaccucggagugggaucgauuucaaugagaugaucuugaugaagaugaagaagaagaccuggcuggugcacaaacagugguuucucgaucugccgcugcccuggaccgccggcgcagacaccucagaagugcacuggaacuacaaggagcgcauggucacguuuaaggugccacacgcuaagagacaggacgugaccgugcucgggucacaagagggcgccaugcauucggcccuggcgggcgcgacggagguggacaguggggacggcaaccauauguucgcaggacaccugaaauguaaggugcgcauggagaagcuccggaucaagggcaugagcuacaccaugugcuccgguaaauucucaaucgauaaggagauggccgagacucagcacgggaccaccgucguaaaggugaaguacgagggcgccggggcgcccuguaagguccccaucgagauccgggacgugaauaaggaaaaggugguugggcgcguaaucagcucuacaccccuggcggagaacacgaacuccgugaccaacaucgagcuggagccgccguucggagacagcuacaucgugaucggcgugggcaacuccgcucucacgcuccacugguuucgcaaggguucuuccaucgguaagauguucgaaucuaccuaccguggugcgaagcggauggccaucuugggcgagacggcaugggacuucggaucagugggcggccuauucaccucucuggggaaggccguccaccagguuuucggcuccguguacacgaccauguucgggggcgucagcuggaugauccgaauacuuauuggguuccuugugcuguggaucggcacaaauucccggaauaccagcauggccaugaccugcaucgcggucggagguauaacccuguuccugggcuucacgguccaagcugacauggggugcgugguguccuggagcggccgcgaacuuaagugugguagcggcaucuuugucguggacaacguacacaccuggaccgagcaguacaaguuccagcccgaguccccagcgcgguuggcgagcgccauccuaaacgcccauaaggacggcgucugcggcauccgcuccaccaccagacucgagaacgugauguggaagcagauuaccaacgagcugaauuauguucugugggaaggagggcacgaccucacugugguggccggcgacgugaagggcguccugaccaaggggaagcgcgcccugacgccgcccgugagcgaccucaaguacuccuggaagaccuggggcaaggccaagaucuucaccccagaggcgagaaacagcaccuuucucaucgauggacccgacacguccgaguguccgaacgagcgccgggcauggaacagccuggagguggaggauuauggcuuugggauguucaccaccaacauauggaugaaguuccgugagggcuccagcgaggucugcgaucaucgccucauguccgccgcgauaaaggaccagaaggccgugcacgcggacaugggguacuggaucgagagcuccaagaaucagacguggcagaucgagaaggccagccugaucgaggugaagacgugccucuggcccaagacgcacacucucuggucuaacggcguccuggagagccagauguuaauccccaaauccuacgcaggcccguucucccaacacaauuaucggcagggguacgccacacagacugugggccccuggcaccucggaaagcuggagaucgacuucggagagugccccggcacgacaguaaccauucaggaggauugcgaccaccgcgggcccagccugcgcaccacgaccgccucgggcaagcucgucacccaguggugcugccggagcuguaccaugccgccccugcgguucuuaggggaggacggcuguugguacgggauggagauccgcccccuguccgagaaggaggagaacauggugaaaagccaggucgccgccggccccggcaccuccgagaccuucucuauggggcuguuaugcuuaacucuguuuguagaggagugucugcggcgccggguuacccggaagcacaugaucuuagcugucgugauaacgcuuugugccaucaucuugggcgggcucacauggauggaccuguuaagagccuugaucaugcugggcgacaccauguccggccggauugggggccagacccaccuggccaucauggccguguuuaagauguccccgggguacguccuaggcguguuccuucggaagcugacgucccgagagaccgcgcucaugguuaucgggauggcgaugaccaccacacugagcaucccccacgaccucauggagcucaucgacggcaucucccuagggcugauccuucugaagauugucacucaguucgacaacacccagguggggacccuggcccucucgcuuaccuucauacgguccaccaugagccuggugauggccuggcgcacuaucauggccguccucuucguugugacucugaucccccugugccguacguccugccugcaaaagcaaagccacugggucgagaucaccgcgcugauccugggcgcccaagcccuccccguuuaucugaugacucugaugaagggggcgucccggcggucauggccccucaacgagggcaucauggccgugggccuggucucucugcucggcucggccuuacugaagaacgacgugccccucgcgggccccaugguggccgggggccuacucuuggcggcguacgucaugagcggguccagcgccgaccugucucuggagaaagccgccaacguccagugggaugagauggccgacauaaccggcagcucccccaucaucgaggugaagcaggacgaagacgggagcuuuaguauacgcgacgucgaagagacgaacaugaucacccuccuggugaaacuggcgcucauaacugugagcggccuguacccgcucgcaauccccgucaccaugacgcuuugguacauguggcagguuaagacccagagaaguggcgcuuugugggacgucccgagcccggccgccacccagaaggcggcccuuuccgaggguguguacaggaucaugcagcggggacucuucgggaagacccaggugggaguggguauccacauggagggcgucuuccacaccauguggcacgugacgcgcggcagcgugaucugccaugagaccgggaggcuggaaccguccugggccgacguccguaacgacaugauaagcuacggcgggggcuggcgccugggcgacaaaugggacaaggaggaagacguacagguguuggccaucgagcccgggaagaaccccaagcauguccagaccaagccuggccuguucaagacccugacgggggagaucggcgccgugacccucgacuucaagcccgggaccuccgggucucccaucaucaaccggaagggaaaagugaucgggcuauacggcaacggcguagugacuaaguccggcgacuacgugagcgccaucacgcaggccgaacggaucggggagcccgacuaugaggucgacgaggacauuuuccgaaagaaaagacugacuauuauggaccuccacccgggcgccggcaagacuaagcggaucuugccauccauuguucgcgaggcuuugaagaggcgauuacggacccucauccuggcaccgacucgggucgucgcugccgagauggaggaggcccuuagagggcugcccauccgcuaucaaaccccggccgugaagucggagcacacuggccgggagauaguugaccugaugugccacgccaccuucacgacacgcuuacucagcuccacccgcguccccaacuacaaccugaucgugauggacgaagcccacuucaccgaucccucauccgucgcugcccgcgguuacaucagcacgcgcguggagaugggcgaggcagcggccaucuucaugacagccacacccccgggcgccaccgaccccuuuccccagaguaacucacccaucgaggauauagaacgcgagaucccggagcggucuuggaacacgggcuucgacuggaucacugacuaucaagguaagaccgugugguucguccccagcauuaaagcagguaacgacaucgcgaacugccuucgcaaguccggcaagaaggugauccaguuaagccgcaagaccuucgacacggaguacccuaagacaaagcugaccgacugggacuuuguggugaccaccgauaucuccgagaugggggccaacuuccgggcaggccgcgugaucgacccccggcgcugccugaagccgguuauccucaccgacgguccggagcggguaaucuuggccggcccgaucccaguuaccccggcaagcgccgcccagcgccgugggcgcaucgggcguaaccccgcgcaggaggaugaccaguacguguucucaggcgacccccugaagaacgaugaggaccaugcccacuggaccgaggcaaagaugcuccuggacaacaucuacacccccgaggggaucaucccgacccucuucggccccgagcgagagaagacccaggccaucgauggugaguuucggcuccgcggggagcagcggaagaccuucgucgagcugaugcgacggggcgaucugcccguguggcucuccuauaagguggcaucugccgggaucagcuauaaggaccgcgagugguguuucacgggugaaagaaacaaccaaauccuggaggagaacauggaggucgaaauuuggacccgcgagggggaaaagaagaagcugcggccccguuggcuagaugcccggguguacgcugacccaauggcccuuaaggauuucaaggaguucgccaguggccgcaagagcaucacgcuggacauccuaaccgagaucgccucccugcccaccuaccugaguagccgcgccaagcuagcgcuagacaauaucgugauguugcauacaacggagcguggcggccgcgcguaccagcacgcgcucaacgagcugcccgagucucuugagacccucaugcuggucgccuugcucggugcgaugacggcagggaucuuucuguucuucaugcagggcaaggggauuggcaagcugagcaugggccucaucacgaucgccguggcguccggccugcuguggguggcagagauccagccgcaguggaucgcggccagcaucauccucgaguucuuccugaugguccugcucauccccgagcccgagaagcagcgaacaccccaggauaaccaguugaucuacguuauccugaccauccucaccaucaucggucugauugcugccaacgagauggggcugaucgagaagacgaagaccgacuucggcuucuaccaagugaaaaccgagaccacgauccucgacguagaccugcgcccugccucggcguggacccuuuacgccgucgcuaccaccauccucacgcccaugcugcggcauaccaucgagaacaccucagccaaucugucccuagccgcuauugccaaccaagcugccgugcugaugggacuaggcaaaggcuggccccuccacagaauggaccuggguguaccccugcucgccaugggcuguuacagccaaguuaauccaaccacguuaacagcgucccuggugaugcuacuuguucauuacgccauuauugggcccggccugcaggccaaggccacccgggaggcgcaaaagcgaacagcggccgguauuaugaaaaaccccacggucgacgggaucaccgugaucgaccuggagcccaucuccuaugacccgaaguuugagaagcagcuggggcaggucaugcuacucgugcugugcgcuggucaacugcuucugaugcgcaccaccugggcuuucugugagguacuuacccuagcgaccgggcccaucuugacccugugggaaggaaaccccggccgcuucuggaacaccaccaucgccguguccaccgccaacaucuuccggggaucguaucucgcuggcgccggucuggcguucuccuuaaucaagaacgcccagacaccccgacgcgggaccggcacgaccggggagacccucggcgaaaaguggaaacggcaauugaacucccuggacaggaaggaguucgaggaauacaagagauccggcauucucgagguggaccggaccgaggccaaaucagcccugaaggacggguccaagaucaagcaugccgugaguaggggcuccagcaagauacgguggaucgucgagcgcgggaugguuaaaccaaagggcaagguggucgaucugggaugcggccggggaggguggagcuauuauauggcuacccucaagaacgugacggaggugaaggguuauacaaaagggggccccggucaugaggagcccauccccauggccacuuacggauggaaccuggucaagcugcacagcggcguggacguguucuacaaaccgaccgagcaggucgacacgcuccugugcgacauaggggagagcuccagcaaccccaccaucgaggaagggcggacuuugcgcguacugaagaugguugagcccuggcuguccagcaaacccgaguucugcauaaagguccuaaacccguacaugcccaccgugaucgaggagcuugaaaagcuccagcggaagcacgggggcaaccugguccgcuguccacugucccggaacagcacucacgaaauguacuggguauccggcgccagcgggaacauugugucgagcgugaacaccaccuccaaaauguugcugaaucgcuuuacgacccgccaccgcaaaccaaccuacgagaaggauguggaccugggagccgggacccguagcguguccaccgagaccgaaaagccugacaugaccauaaucgggcgccgccuccaacggcugcaggaagaacacaaggagacauggcauuacgaccaggagaaccccuaccgaacaugggcauaccacgggagcuacgaggcccccucgacgggcagcgcguccucaauggucaacggcguggucaaacuucuaaccaaacccugggacgucauuccaauggugacccaacuugccaugaccgacacgaccccguuugggcagcagagaguguucaaagaaaaaguugacaccaggacaccccagccgaaacccggaacacgcguggugaugacaaccaccgccaacuggcucugggcucucuuagggaagaagaagaacccccggcugugcacgcgcgaggaguucauaagcaagguccgguccaacgccgcaaucggugccguguuccaggaagaacagggguggaccagcgcuuccgaggcagugaacgacagccgcuucugggaacucgucgacaaggagagagcccuucaccaggagggcaagugcgaguccugcguauauaacaugauggggaaacgcgagaaaaagcugggggaguucggccgcgccaaagggagccgggcuaucugguauauguggcucggcgcacgcuuccuggaguucgaggcccugggguuucuuaacgaggaccacugguucggccgggaaaacucguggaguggcguugagggcgagggccugcaccgccugggguauauccucgaggagauagauaaaaaggauggggaccuaauguacgcagacgacaccgcggguugggacacccggaucacagaagacgaccugcagaacgaggagcucauaaccgagcagauggcaccccaccacaagauccuggcaaaggccaucuucaaacuuaccuaccagaacaaggugguaaaggugcuccgcccgacacccagaggggccguuauggacauaauaucgcgaaaggaccagagaggcagcgggcagguuggaaccuacgggcugaacacguucacgaacauggaggugcagcucauccgccagauggaggccgaaggaguuauaacccaagacgauaugcagaaccccaaagggcucaaggagcggguagagaaguggcuucgcgagugcgguguagaccgucugaaacgcauggccaucucgggcgacgacugcgucgugaaaccccuugacgagcgguucgggaccagcuuacuguuccugaacgacaugggcaaggugcgcaaggacauuccgcagugggagcccuccaagggcuggaaaaacuggcaggagguccccuucugcagccaccacuuccacaagauuuucaugaaggacggccggucccuuguggugccgugccgcaaucaggacgagcugauaggccgggcgcgcauaagccaaggggccggcuggucccuccgcgagacggccugccuagggaaagccuacgcucagauguggucccugauguacuuccacagacgcgacuuacggcuggcaagcauggccaucugcuccgccgucccgaccgagugguuccccacuagccgcaccacgugguccauccacgcccaccaccaguggaugaccaccgaggacaugcugaagguuuggaaucgaguuuggaucgaagacaacccgaacaugaucgacaaaaccccgguccauagcugggaggacaucccguaucucggcaagcgcgaagaccucuggugcggguccuugaucggccucagcucccgggccacgugggcaaagaacauccacaccgcuauaacccaggugcggaaccugaucggcaaggaggaguacguggacuacaugcccgucaugaagcgguacucagcccccagugagucggaggggguucuguga

SEQ ID NO: 26241 - RNA, 9867 nt, Artificial Sequence
  derived and/or modified CDS sequence (opt11) from DENV-4__EU854296__SS-prME
agcaccaucacccugcucuguuugauccccacugugauggccuuccaccuguccaccagagacggcgagccgcugaugaucgucgccaagcaugagcggggccgcccccugcuguucaagacuacugagggcaucaacaaguguacgcucaucgcgauggaucugggggaaaugugcgaggacaccgugaccuacaaguguccccugcucgugaacaccgagccagaggauaucgacugcuggugcaaccugacgagcaccugggucauguacggcaccuguacacaguccggggagcggcgccgggagaagcgcagcguggccuuaacgccgcacucagguaugggccucgaaacgcgugcugagaccuggaugaguuccgagggggccuggaagcacgcccaacgcguggagagcuggauacuacggaacccaggcuuugcgcuguuggccggguucauggcuuacaugaucggccagaccgguauccagcgcacggucuucuucgugcugaugaugcugguggcccccuccuacggcaugaggugcguuggcguggggaaccgcgacuucgucgaaggcgugagcgggggcgcguggguggaccucgugcuggagcacggcgggugcguaaccaccauggcccaggggaagcccacucuggauuucgagcucacgaagaccaccgcaaaggaggucgcacugcugcggaccuacugcauagaggccuccauuagcaacauuacgaccgccacccgcugccccacucaaggggagcccuaccucaaggaggagcaggaucaacaguacaucugccggagggacguagucgaccggggcugggggaacggcugcggccuguucgggaaaggcgggguggugacgugugcaaaauuuuccugcaguggcaagaucacggggaaucugguccagaucgagaaccuggaguauaccgugguggucaccgugcacaacggagacacgcacgccguuggcaacgacaccuccaaccauggggugaccgccaccaucaccccgcgcagccccuccguggaggucaagcugccggacuauggggagcugacccucgacugugaaccccguagcggcaucgauuucaacgagaugaucuugaugaagaugaagaaaaagaccuggcuggugcacaagcagugguuccuggaccugccuuugccuuggacagccggugcggacaccuccgaggugcacuggaacuacaaggagagaauggucacuuucaaggugccgcacgcuaaacggcaggacgugacaguccugggaagucaggagggugccaugcauagcgcccuggccggcgccaccgagguggacucgggagacgggaaccauauguucgccggucaucugaagugcaaggugcgcauggagaagcuccggaucaaaggcaugagcuacaccaugugcuccggcaaguucagcauagacaaggagauggccgagacucagcacgguaccaccgucgugaagguuaaguacgagggugcuggggcucccugcaaggugcccauugagauaagagaugugaacaaggagaaaguggucgggcgcgugaucuccagcaccccccuggcugagaacacgaacuccgugacuaacaucgagcuggaaccgcccuucggagacagcuacaucgucaucggcgugggcaacuccgcccucacccuccacugguuccggaaggggagcuccauaggcaagauguucgagagcacauacagaggcgccaagcggauggccauccugggcgagacggcgugggacuucggauccgugggcggccucuucaccagccuggggaaagcuguccaccagguguucggcucgguguauaccaccauguucgggggcgucagcuggaugauccgcauccugaucgguuuuuuagugcuguggaucggcaccaacucacggaacaccagcauggccaugaccugcaucgcugugggcgggaucacccuuuuccugggcuucacgguccaggccgauauggggugcgugguguccuggagcggccgcgagcucaagugcgggucuggcaucuucgucguggacaaugugcacaccuggaccgaacaguacaaauuccagccagagucccccgcgcggcuagccucggccauccuaaacgcccacaaggacggcgucugcgggauaagauccaccacgcgguuggagaacgugauguggaagcagaucacaaacgagcugaacuaugugcugugggagggcgggcacgaucucaccgucguggccggcgaugcgaagggcgugcugaccaaagguaaacgagcccugacgccgccugucagcgaccucaaguacuccuggaagaccuggggcaaggccaaaaucuucacccccgaggcccggaacagcaccuuccugaucgacggacccgacacguccgagugcccgaacgagaggcgggccuggaauucccuggaaguggaggacuacggcuucgggauguucaccaccaacaucuggaugaaguuccgcgagggcuccagcgagguaugcgaucaccggcucauguccgcggcuaucaaggaccagaaggccgugcacgccgacaugggcuauuggaucgaaaguuccaagaaccagaccuggcagaucgagaaggcgagcuuaauugagguuaaaacgugucucuggcccaagacccacacccucugguccaacggggugcuggagagccagaugcugauccccaaguccuacgccggcccauucagccagcacaacuaccgccagggguaugcgacccagaccgucggcccguggcaccucggcaagcuggagaucgacuucggcgagugccccggcacgacggugaccauccaggaggauugugaccaccgagggcccagccugcgcaccacgaccgcuucuggcaaacuugugacccaguggugcugccgaagcugcaccaugccgccccugcgguucuuaggcgaggacgggugcugguacggcauggaaauaaggccacucuccgagaaggaggaaaacauggucaaaagucaggucaccgccggccagggcaccuccgagaccuucucgaugggccugcugugccuuacccuguucgucgaggagugccugaggagacgaguuacgcgcaagcacaugauucucgcgguugucaucacccugugugccaucauacugggcggacucaccuggauggaccugcugcgggcccuuaucaugcugggcgacacgauguccggccgcauagggggccaaacgcacuuggccauaauggccguguucaagaugagccccggauacguguuaggcgucuuccuccggaagcugaccuccagagagaccgcgcuuauggugaucgggauggccaugaccacuacucuuagcaucccgcacgaccugauggagcucauugacggcaucucccugggauuaaucuugcugaagaucgugacccaauucgacaacacccaggucggcacgcuggcccucagccuuaccuucauccgguccaccaugagccuggugauggccuggcgaaccauaauggccgugcucuucgucgugacgcuaaucccccugugccgcaccuccugucuccagaagcagagccauuggguagagaucaccgcccugauccuaggcgcucaggcccucccugucuaccugaugacccugaugaagggggccucccgccgaagcuggccccuaaacgagggcaucauggccguggggcucgucucccugcucggcagcgcccugcugaagaaugacgucccgcucgcaggccccauggucgccgggggccugcugcucgccgcguacguuaugagcggguccagcgccgaucugucccuggagaaggccgccaacguccagugggacgagauggccgauaucacgggcagcucccccaucauagaggugaagcaggacgaggacggguccuucucgauccgggauguggaggagacaaacaugaucacacuccugguaaagcuggcgcucaucaccguaagcggcuuguacccccuggccaucccggucacgaugacccucugguauauguggcaggucaaaacccaacggagcggcgcacugugggacgugcccagccccgcagccacccagaaggcggcgcugagugaggggguauaccgcaucaugcagcggggccucuucgggaagacucagguaggcguggggauccacauggaaggcgucuuccacacaauguggcacgucacccgcggcagcgugaucugccacgaaaccgggcgguuggagcccuccugggcugacgugcgcaacgacaugaucagcuacggcggcggcuggcgccugggcgacaagugggacaaggaggaggacguccaaguguuagccaucgagccggggaagaaccccaagcacgugcagaccaagcccggacuguucaagacgcuaaccggggagauuggcgccguuacgcucgacuucaagcccggaaccuccggcucaccgaucaucaaccgaaaggguaaggugauugggcuguacggcaacggggucgucacgaaguccggcgacuacgugagcgcgauuacccaagccgagcgcaucggggagccagacuacgagguggaugaggacaucuuccggaagaagcgucugaccaucauggacuugcacccuggcgccggcaaaaccaaacggauccugccguccaucguccgcgaggcccugaagcggcgccugcggacgcucauauuggcgcccaccagagugguggccgcggagauggaggaagcccugcggggauugcccauccgcuaucagacccccgcggucaaaagcgagcacaccggccgggagaucguggaccugaugugucacgcgacguucaccacgcgccugcucagcuccacccgggucccaaauuacaaccugaucgucauggacgaggcccauuucacugaucccagcuccgucgccgcccgcggauacaucagcacccgggucgagaugggcgaggcggcggccaucuucaugaccgccaccccccccggugccacggacccguucccccagucgaacagcccuaucgaggacaucgagcgcgagauccccgagcggucuuggaacaccggcuucgacuggaucaccgacuaccagggcaagacugugugguucgugccgucgaucaaggccggaaaugacaucgcgaacugccugcgcaaguccgguaagaaggucauccagcucagcagaaagaccuucgacacggaguaccccaaaaccaagcugacggacugggacuucguggugacgacagacaucuccgaaaugggggccaacuuccgggccggccgcguuauugacccgcgccgcugucuuaagccagugauacucacagacgguccggagcgggucauacuggccggcccuaucccgguaacucccgcgagugcggcccagcgccggggccgcauagggcggaaccccgcccaagaggacgaccaguacguauucuccggcgaccccuugaagaacgaugaggaucacgcccacuggacggaggcgaagaugcuccucgacaacaucuacacccccgaggggaucauccccacccuguucgguccagaacgcgagaagacgcaggccaucgauggugaguuccggcuuaggggggagcagcggaagacuuucguugagcugaugcgccggggcgaccugcccgucuggcuaucguacaagguggccuccgccgggauaagcuacaaggaccgcgagugguguuucacaggcgagcggaacaaccagauuuuagaggagaauauggagguggagaucuggacccgcgagggggagaagaagaaguugaggcccagguggcucgaugcacggguauacgcggaccccauggccuugaaggacuuuaaggaguucgccuccggccgcaagagcaucacgcuggacauccuaaccgagauugccucccugccgacguaccuaagcagcagggccaagcucgcgcuggacaauauugugaugcuccacaccaccgagcgggguggccgcgccuaccagcacgcccuaaacgagcugcccgagucccucgagaccuugaugcugguggcccugcucggcgcgaugacggcggggaucuuccuguucuuuaugcagggcaaggggaucggcaaauugagcaugggcuugaucaccaucgccgucgccuccgggcugcuguggguggccgaaauacaaccccaguggaucgcagcaagcauuauccucgaauuuuuccugaugguucugcucaucccggaaccagagaagcagcguaccccucaggacaaccagcugaucuacgucauccugacaauccucacuaucaucggccugaucgccgccaacgaaauggggcugaucgagaagaccaagacggacuuuggguuuuaccaggccaaaaccgagacgaccauccucgacgucgauuuacgccccgcuuccgcuuggacccuguacgccguggccaccacaauccucacgccgaugcuacgccacaccaucgagaauaccuccgccaaccucucccuagcggcgaucgcaaaccaggccgccguccugauggggcuaggcaaaggguggccgcuccaccgcauggaccuaggggugccucugcucgcgaugggcugcuacagccaagugaaccccacgacccucaccgccucgcucgucaugcuccuggugcacuaugcgaucaucgggccgggccugcaggccaaagccacucgggaagcucagaagagaacugccgccggcaucaugaagaaucccaccguggacggcaucaccgucauagacuuggagcccaucagcuacgaucccaaguucgagaagcaauugggccaggugaugcuccucguacugugugccgggcagcuacuccugaugcggaccacgugggcuuucugcgagguacugacccucgccaccggcccuaucuuaacccugugggaggggaaccccggccgcuucuggaacacuaccaucgccgugucuaccgccaacaucuuccggggcagcuaccucgccggggccggccuggcauucucccuaaucaagaacgcccagacgccacgccgggggacgggcaccauuggggagacacucggcgagaaguggaagagacagcugaauagccuggaucgcaaagaauucgaggaauacaagcgcuccgguaucuuagagguggaccggaccgaggcgaagagcgcccugaaggacggguccaagaucaagcacgcggucagucgcggauccagcaagauccgguggaucgucgaacgcgggaugguaaagcccaagggcaaaguuguagaccuaggcugcggccgcgggggcuggucauacuacauggccacucucaagaacguaacggaggugaagggcuacacgaagggggguccuggacaugaggagcccauccccauggccaccuacggcuggaaccuggugaagcugcacucaggcguggacgucuucuaccggcccaccgagcagguggacacgcuccugugcgacaucggggaaagcuccaguaacccaaccaucgaggagggccgcacccugcgggugcucaagaugguggagcccuggcugucuagcaagccggaguucugcaucaaggugcugaaccccuauaugccgaccgugaucgaggagcuggaaaagcuccagcggaagcacgggggcaaccugguacggugcccacuguccaggaacagcacgcacgaaauguacugggugagcggcgccagcgggaacauugucuccucagugaacacaaccuccaagaugcuccugaaucgguucaccacuagacaccggaagcccaccuaugagaaggauguggaccugggcgcaggaacccgcucugucuccaccgagaccgagaagccggacaugaccauaaucggccguagacuccagagguuacaggaggagcacaaggagaccuggcacuacgaccaggagaacccguaccgcacaugggccuaucacgggagcuaugaggcccccucgacgggcagcgccuccagcauggugaacgguguggucaaguugcucaccaagccgugggacgugaucccaaugguuacccagcucgcgaugaccgacacgacccccuucggccagcaacgggucuucaaggagaaggucgacacucgaacgccgcagcccaagccgggcacgcggauggugaugaccaccacagcgaacuggcugugggcccuccuggggaagaagaagaacccccgcuuaugcacgcgggaggaguucaucagcaagguccgcuccaacgccgcuaucggcgccguguuccaggaggagcaaggguggaccagugcauccgaagccgugaaugacagccgguucugggagcuugucgacaaggagagagcucugcaccaggaggguaagugcgaauccugcguguacaacaugaugggcaagcgcgagaagaagcuaggggaauucggccgggccaagggaucgcgggccaucugguacauguggcucggggcucgguuccuggaguucgaggcccugggguuccucaacgaggaccacugguucgggcgcgagaacuccuggagcggcguggagggggagggccugcacagacugggguacauucucgaggagaucgacaagaaggacggugaccuuauguacgccgacgacaccgcaggaugggacacgcgcaucacugaggacgaccugcagaacgaagagcucaucacugagcagauggcgccccaccacaagaucuuagccaaggccaucuucaagcugaccuaccagaacaaggucgucaaggugcuccggccgaccccgcgcggcgcagucauggacaucaucucccggaaggaccagcguggguccgggcagguaggcacuuacgggcugaacacguucaccaacauggagguacagcuaaucaggcagauggaggccgagggcgucaucacacaagacgacaugcagaaccccaaaggucucaaagagcgcguggagaagugguugcgggagugcggaguggaccgccugaagaggauggcgauauccggcgacgacugcgucgugaagccacuagacgagcgcuucgggaccagccugcuguucuuaaacgacaugggcaagguacggaaagacaucccccagugggaaccguccaagggguggaagaacuggcaggagguccccuucugcagccaccauuuccacaagauuuucaugaaagacggccgcagucuggugguccccugccggaaccaggaugagcugaucgggcgcgccaggaucucucagggggcgggcuggucccucagggagaccgccugccuggggaaggccuacgcccagauguggagccugauguacuuucauagaagggaucuccgcuuggccaguauggcuaucugcagugccgucccgaccgagugguuuccgaccagccguacuacaugguccauccacgcucaucaccaguggaugaccaccgaagacaugcugaagguguggaaccgcguguggaucgaggacaaccccaacaugaucgacaagacccccguccacagcugggaggacaucccauaccucgggaagcgggaagacuuauggugcgggagucugaucggucucagcagucgcgccacgugggccaagaacauccacacugccaucacccaggugcggaaccugaucggcaaggaggaguacguggacuauaugcccgucaugaagcgcuacagugcccccucggagagcgagggggugcuguaa

SEQ ID NO: 26242 - RNA, 9867 nt, Artificial Sequence
  derived and/or modified CDS sequence (opt11) from DENV-4__GQ199878__SS-prME
agcaccaucacucugcucugccugaucccuacggugauggcauuccaccuguccacccgcgacggcgaaccccucaugauaguggccaagcaugagaggggucguccccugcuguucaagaccaccgagggcaucaacaagugcacgcugaucgcgauggaccugggggagaugugcgaggauaccguaaccuacaaaugcccucugcucguaaauaccgagcccgaggacaucgacugcuggugcaaucugacuagcaccugggucauguacggcaccugcacgcagaguggggagcggcgccgagagaagcgauccguggcccugacgccgcacagcgggaugggccucgaaacgcgggccgagaccuggaugagcuccgagggggccuggaagcaugcccagcgcguggagaguuggauccuccggaacccgggcuucgcgcugcucgccggguuuauggccuacaugaucggccagaccgggauacagcgcacggucuucuuugugcugaugaugcugguggcccccuccuacggcaugcgguguguaggggugggcaaccgagauuucguagagggcgucucgggcggggcguggguggaucucgugcuggagcacggcgggugugucaccacgauggcccaaggcaaaccuacauuagacuucgagcucacaaagacuaccgccaaggaaguugcccugcugcggacuuauugcaucgaggcuuccaucagcaacauaaccaccgccaccaggugcccgacucagggggagcccuaccucaaggaggagcaggaccagcaguacaucugucggcgcgacguggucgaccggggcuggggcaacggcugcggccuguuugggaagggcgggguagugacgugcgccaaguucucgugcagcggcaaaaucacagggaaccugguccagaucgagaaccucgaguauaccgugguagucaccgugcauaacggggacacgcacgccgucggcaacgacaccuccaaccaugggguuacugccaccaucacgccccgcagccccuccguggaggucaaguuaccugacuacggcgagcugacccucgacugcgagccgagaagcgguaucgauuucaacgaaaugauccugaugaagaugaagaagaaaacgugguuagugcacaagcagugguuccuagaccugccccugcccuggaccgccggcgcagacacuuccgagguucacuggaacuacaaggagcgcauggucacguucaaagugccucacgccaagcggcaggacguuaccguccucgggagccaagagggcgccaugcacucugcgcuggccggcgcgaccgagguggauuccggggauggcaaucacauguucgcagggcaccugaagugcaaggugcgcauggagaagcuccgcaucaagggcaugagcuacaccaugugcucaggcaaguuuagcaucgacaaggagauggcggagacacagcacgggaccaccgucgucaagguuaaguacgagggcgcaggggcacccuguaaggucccaauugagauccgggacguaaauaaggagaaggugguagggcgcguaaucucaagcaccccccuggcggagaacacgaacuccgugaccaacaucgagcuugagccgccuuucggugacagcuacaucgucaucggcgugggcaacuccgcuuugacgcugcauugguuccggaaaggaucguccaucggcaagauguucgaguccacuuaccgcggcgccaagcggauggccauccugggcgagacagccugggacuucgggucugugggcggccucuucacgagccuggggaaggccguccaccaaguguuuggcuccguguauaccaccauguucggaggcguuucguggaugauccgcauccugaucggcuuucucgugcuguggaucggcacgaacucccggaacacaagcauggccaugaccugcaucgcugucggcgggaucacccuguuccugggcuucacgguccaggccgauauggggugcguggugagcuggagcggccgcgaacuuaagugcgggagcggcaucuuugucguggacaacgugcacacguggaccgagcaguacaaguuccagcccgagagucccgcgcggcuggccagcgccauccugaaugcccacaaggacggcgucugcgggauucgcuccaccacacggcucgaaaacgugauguggaagcaaaucaccaacgagcugaacuaugugcugugggagggcggccacgaccucaccgugguggccggcgacgugaagggcguccugaccaagggaaagagagcccuaacgccgcccgucagcgacuuaaaguacuccuggaaaacauggggcaaggccaagaucuucacgccggaggcucggaacaguaccuuccugaucgacgggcccgacacauccgagugcccgaacgagcgccgggcauggaauagccuggagguggaggacuacggcuucgggauguucaccacaaacaucuggaugaaguuccgcgagggcuccagcgaggucugcgaccaucgacucaugagugccgcaaucaaggaccaaaaagccgugcacgccgacaugggcuacuggauagaaagcuccaagaaccagaccuggcagauagagaaggccagccugauagaggugaagacgugccuguggcccaagacucacacccucugguccaacggggucuuggagagccagaugcugauucccaaguccuacgcgggcccguucagucagcacaauuaccgccagggguaugccacccagaccguaggccccuggcaccuagggaagcucgaaaucgacuucggcgagugccccgguacgacagucaccauccaggaggacugcgaccauagggggcccagccugcgcaccacgaccgccuccggaaagcuagucacccaguggugcugccgcagcugcaccaugccgcccuugcguuuccugggagaggacggcuguugguacggaauggagauccgcccccuuuccgagaaggaggaaaacauggugaagagccagguugccgcuggacaaggcacguccgagacuuucagcauggggcuucugugccucacccuguucguggaggagugccuacggcggcggguaacccgcaagcacaugauccucgcggucgugaucacgcugugcgccaucaucuuaggaggguugaccuggauggacuuacugcgggcccucaucaugcugggcgacaccauguccggccgcaucgggggucagacccaucucgccaucauggccguguucaaaaugagcccagguuacguccucggcguguuccugcggaaguuaaccucccgcgagaccgcgcucauggugaucgggauggccaugacuaccacgcugucuaucccgcacgacuugauggagcucauagacggcaucagucugggccuaaucuuacucaagaucguaacccaguucgauaacacgcagguggggacccuggcccucagccugacuuucauacgguccaccaugagccuggugauggccuggcgcacgaucauggccgugcucuucguagugacccuuauccccuuaugccggacaagcugucuccagaagcagucccacugggucgagaucacagcgcugauccuaggugcccaggcccuccccguguaccugaugacccugaugaagggcgccucccgccggagcuggccccucaacgagggcauaauggcggugggucugguuucccugcucgggagugcccugcugaagaaugacgugccgcucgccggucccaugguagccgggggcuugcugcucgccgcguacguaaugagcgguaguagcgcugaucugucccuggagaaggccgccaacguccagugggacgagauggccgacauaaccggcucgucucccaucauugaggugaagcaggacgaggacgggagcuucuccauccgcgacgucgaggagacgaacaugaucacccuccugguaaagcuggcgcucauaaccguuagcggacuguacccccuggccaucccagucaccaugacgcucugguacauguggcagguaaagacgcagcgguccggcgcccugugggacguccccagccccgccgcuacccagaaagcggcacuguccgagggggucuauagaaucaugcagcggggacucuucgguaagacucaggugggcguugggauccauauggagggcgucuuccacaccauguggcacgugacccguggaagcgucaucugccacgagacggggcggcuugagcccuccugggcagacguccgcaacgacaugaucagcuacggcgggggcuggcgccuuggagacaagugggacaaggaggaggauguacaggugcucgccaucgagcccgggaagaaccccaagcacguccagaccaagcccggccuguucaagaccuugaccggggagaucggcgccguuacccuugacuuuaagcccgggaccucaggaagcccgaucaucaaccggaaaggcaaggugaucgggcuguacggcaacggcgucgugaccaagaguggcgauuacgugagcgccaucacucaggccgaacgcauaggggagcccgacuacgagguagacgaggacaucuuccggaagaaacgccugaccaucauggaccuccacccgggcgccggcaaaaccaaaaggauucugcccuccauugugcgcgaggcccugaagcgacgccuucggacccucauacuggcgcccacgcgcgucgucgccgccgagauggaggaggcccugcgggggcuccccauccgauaucagacccccgcagugaagagcgagcauaccggccgugagaucguggaucugaugugccaugcgacauucacuacccgccugcucagcuccacccggguccccaacuacaaccugaucgugauggacgaggcccauuucaccgaucccagcuccgucgccgcgcgcggguacaucagcacucggguggaaaugggcgaggcugcggccauauuuaugaccgccaccccccccggggccaccgauccguuuccccaguccaacagcccuaucgaggacaucgagcgugagauccccgagcgguccuggaacacgggauucgacuggaucaccgacuaccagggcaaaaccgucugguucguccccagcaucaaggccgguaaugacaucgcgaacugccugcgcaaguccggcaagaaggugauccagcucagccgcaaaaccuucgacacggaauaccccaaaaccaagcugaccgauugggacuuuguggugaccaccgacaucuccgagaugggggccaacuuccgggcgggccgagugaucgacccccggaggugccuaaagcccgugauccucaccgacgggccggagcgggucauccuggccggcccuauccccgucaccccugcgagcgcggcccagcgccggggccguaucgggcggaauccggcccaggaggacgaccaguacguguuuuccggcgaccccuugaagaacgacgaggaccaugcacacuggaccgaagcgaagaugcuacuggacaauaucuacacgcccgaggggaucauccccacccuuuucggcccggaaagggagaagacccaagcgauugacggcgaauuccggcuccgcggggaacagcgaaagaccuucgucgagcugaugcgccggggcgaccugccgguuuggcucucauacaagguggccuccgccgggaucagcuacaaggauagagaguggugcuucacgggcgagcgcaacaaccagauacucgaggagaacauggaggucgagaucuggacccgcgagggcgaaaaaaagaagcugcggccccgcuggcucgacgcccggguauacgcggaccccauggcgcugaaggacuucaaagaguuugccucgggacgcaaaagcauuacccuugacauccucacagagaucgccucccugccuacuuaccuuagcagccgcgccaagcuugcccuggacaacaucgugaugcugcauaccacagagcggggcgggcgggcguaccagcaugcccucaacgagcugcccgagucccuggagacccucaugcuuguugcccugcucggcgcgaugacugccgggaucuuccuguucuucaugcaaggcaagggaaucgguaaguugagcaugggccucaucaccaucgccguggccuccgggcugcuguggguggccgagauucagccccaguggaucgcggccagcauuauccucgaguuuuuccugauggucuuacucaucccggaacccgagaagcagcggacgccccaggacaaccagcugaucuaugugauccugaccauccucaccaucaucggccugaucgccgccaacgagaugggcuugaucgagaagacuaagaccgacuucggcuucuaccaggugaagacggagaccacgauccucgacgucgacuuaagacccgcguccgcguggacacuguacgccguggccacgacaauccucacgccgaugcugcggcauacuauagagaauaccagcgcgaaucugucccucgccgcgaucgcgaaucaggccgccguguuaauggggcugggcaagggcuggccccuccaccgcauggaucugggggucccccugcuagccaugggcuguuacagccaagugaaccccaccacgcugaccgcguccuuggugaugcuacucgugcacuacgccaucauuggcccggggcugcaggccaaggccacccgggaggcgcagaagcgcaccgccgccggcaucaugaagaacccaacgguggacgggaucacagugaucgacuuagagcccaucagcuacgaccccaaguucgagaagcagcuggggcaggucauguuacucguccugugcgccggccaguuauugcugaugcggaccaccugggccuucugcgaggugcugacguuggcgaccggcccgauccugacgcuuugggagggaaaccccggccgcuuuuggaacaccacgaucgcagucuccaccgcuaacauauuccggggcagcuaccuagccggggccggccuggcguucucccugaucaagaacgcucagaccccucguaggggaaccggcacgaccggagagacccucggcgagaaguggaagcgccaguuaaacagccuggaccgcaaggaguucgaggaguauaagcgauccggcauacuugaaguggaccgcaccgaagcgaagagcgcccugaaggacggguccaagaucaaacacgcggugucacguggcuccagcaagauccgguggaucgucgagcgcgggauggugaagccaaagggcaagguggucgaccucgggugcgguaggggcggguggagcuacuacauggcgacacucaagaaugugacggaggugaagggcuacaccaaggggggcccagggcaugaggagcccauccccauggccacuuacggcuggaaccucgucaagcugcacucagguguggacguguucuacaagcccaccgagcaggucgacacgcucuuaugcgacaucggagagagcucaagcaacccgaccaucgaagagggccggacccugcggguacucaagaugguggagcccuggcuguccucgaagcccgaguucugcaucaagguccugaaccccuacaugccgaccgugaucgaggagcuggaaaaguugcaaaggaagcaugggggcaaccugguccgcugucccuuaucccggaacagcacgcacgagauguacuggguguccggcgccuccgggaacaucguaucuucagucaacacuaccuccaaaaugcuacugaaucgcuucacgacgcggcaucggaagccgaccuacgagaaggacguggaccugggcgccgggacccggagcgucagcaccgaaacggagaaacccgacaugaccaucauaggcagacgguugcagaggcugcaggaggagcacaaggagacauggcacuacgaccaagagaaccccuaccgcaccugggcguaccacgggagcuacgaggcccccuccacgggcagcgccuccagcauggucaacggcgucgugaagcugcucaccaagccaugggacgucauaccgauggugacccagcuggcaaugaccgauacgacgccauuugggcagcagcgcguguucaaagagaaggucgacaccagaacuccccagcccaagccgggcacgcggauggugaugaccacaaccgccaacuggcuaugggcguugcuggguaagaagaaaaaccccagguuaugcacgcgcgaagaguucaucucgaaggugcgguccaaugccgcuaucggcgccgucuuccaggaggagcagggguggaccucugccuccgaggcgguaaacgacagccgcuucugggagcugguggauaaggagcgggcccugcaccaagaaggcaagugcgaguccugcgucuacaacaugauggggaagcgcgagaaaaagcugggcgaguucggccgcgccaaggguucacgggccaucugguauauguggcugggcgcccgcuuccuggaguucgaggcgcugggguuccucaacgaagaccacugguucggucgggagaauuccuggagcggaguggagggcgaaggccugcaccgccuuggauacauccucgaggagaucgacaagaaggacggcgaccugauguacgcagacgacaccgccggcugggacacgcggaucacggaggacgaccugcagaacgaggagcucaucaccgagcagauggcuccccaccacaagauccuggcgaaggccaucuucaaguuaaccuaccagaacaagguggucaaaguucuccgccccacgccgcggggugccgugauggacauaaucucccgcaaggaccagcgcggcagugggcaggucgggacuuacgggcugaacacguucaccaacauggaggugcaacuuauccgccagauggaggccgagggcgugaucacccaggacgacaugcagaaccccaagggccucaaagaacgggucgagaagugguuacgcgaaugcgggguggaucggcugaagcggauggccaucuccggcgacgacugcgugguaaagccccucgacgaacgguucggaacaucguugcuguuccucaacgauaugggaaaggugcgcaaggacaucccgcagugggagccguccaaaggguggaagaauuggcaggaagugccauuuugcucccaccauuuccacaagauuuucaugaaagacggccggucccugguggugcccugucgcaaccaggacgaacugaucggccgggcgcgcaucagccagggggccggcuggucccuccgcgagaccgcaugucuggggaaagccuaugcccagauguggagccugauguacuuucaccggagggaccuccggcuggcgagcauggcaaucuguuccgccgugcccaccgagugguuucccaccagucgcaccacgugguccauccacgcccaccaucaguggaugaccaccgaggacaugcugaaagucuggaaccgggucuggaucgaggacaacccuaacaugaucgauaagacccccgugcacucuugggaggauauccccuaccucggcaagcgagaggaucugugguguggaagucugaucggccucagcucccgggcgacgugggcaaagaacauccacaccgccaucacccagguccgcaaccugaucggcaaggaggaguacguggauuacaugccggugaugaaacgguacagcgcccccuccgagagcgaagggguccuguga

SEQ ID NO: 26243 - RNA, 9867 nt, Artificial Sequence
  derived and/or modified CDS sequence (opt11) from DENV-4__GQ199879__SS-prME
ucaaccaucacucugcucugccugauccccaccgucauggcauuccaccuaucgacgcgggacggugaaccgcuuaugaucguggccaagcacgaacgggggcgucccuuacuuuuuaagacgaccgaaggcauaaacaagugcacccucaucgcgauggaccugggcgagaugugugaggacaccgugaccuacaagugcccauuguugguaaacacugagcccgaagacaucgauuguuggugcaacuuaacgucgacuugggugauguacggaaccugcacucaguccggugaacggcgacgggagaagcgcagcguugcccugacgccccauucagguaugggcuuagaaaccagagcagagaccuggaugagcuccgagggggcguggaagcacgcucagaggguggaaagcuggaucuugcggaacccgggcuucgcccugcucgccggguucauggcauacaugauuggccagacagggauccagcgaacggucuucuuuguccuaaugaugcugguggcccccagcuacggcaugcgaugcgucgggguggggaaccgcgauuucguugagggcgucaguggcggggcguggguggacuugguacuggagcacggagggugcgucaccaccauggcccagggcaagccuacccuggacuuugaacuaacgaagaccaccgccaaggagguggcccuguugcggaccuacugcaucgaggccuccaucucgaacaucacgacggcgacccgcugccccacacagggggagcccuaccucaaggaggagcaggaccaacaguauaucugccggcgcgacguugucgaccggggcugggggaauggcugcggucucuucgggaagggcggcguugugaccugcgcaaaguucuccugcagcggcaaaaucaccggcaaccugguacagaucgagaaccucgaguacacgguagucgucaccguccacaacggcgacacgcacgccguuggcaacgacaccucuaaucacggggugacggcaaccaucacgcccagaagccccucgguugaggugaagcugccggacuacggggagcuuacccucgauugcgagccccgaagcgguauugacuucaacgagaugauccugaugaagaugaagaagaagacauggcugguccacaagcaaugguuccucgaccugccccugccuuggacagccggggcagacaccuccgaggugcacuggaacuauaaagagcgcaugguuacuuucaaggugccgcacgccaagcgccaggacgugaccguauuagggucgcaggagggcgcaaugcacucagcccuggccggugcgaccgagguggacuccggcgacggcaaccacauguucgccgggcaccugaagugcaagguacgaauggagaagcuccgcaucaaaggcaugaguuacaccaugugcuccggcaaguucagcaucgacaaggagauggcagagacgcagcacgggacaacggucguaaaggugaaguacgagggcgccggggccccuugcaaaguuccuaucgagauacgggacgugaacaaggagaaggucgugggccgugugauuuccagcacaccccuugcggaaaauaccaacuccgugaccaacauagagcucgaaccuccauuuggagacuccuacaucgucauaggcguggguaauucugcccuuacccugcacugguuccggaagggguccuccaucggcaagauguucgagagcaccuaucgaggagccaagagaauggccaucuuaggugaaacggccugggauuuugggagugucggaggacucuucaccucacuggggaaggccguccaccagguguucggcuccguuuacacaacgauguucggaggcgucaguuggaugguucgcauccugaucggguuuuugguacuguggaucggcacgaacucucgaaauaccagcauggccaugaccugcaucgcaguaggcgggaucacccuguuccugggauucaccguccaggcugacauggguugcguugucucauggucgggccgcgagcucaaauguggaagcgggaucuucgugguggacaacguccacaccuggacagagcaguacaaguuccagccagaguccccagcccggcuggccagcgcaauacugaaugcccacaaggauggcgugugcggcauccgcucgaccacccgucuagaaaaugugauguggaagcagaucacuaacgaacugaacuauguccugugggagggaggucacgaccucaccguuguggcgggggacgucaagggcguacuuacuaaggggaagcgcgcgcugaccccgccggugagcgaccugaaguacuccuggaaaaccuggggcaaggccaagaucuucacccccgaagcccgcaacagcaccuuccucauagauggaccugacacauccgaguguccgaacgaacgccgagccuggaacucgcuggaggucgaagacuacggcuucgggauguucaccacaaacaucuggaugaaguucagggaaggauccucagaagugugcgaucauagacucauguccgccgcgaucaaggaucagaaagccgugcacgcggacaugggcuacuggaucgaauccucaaagaaccagacguggcaaaucgagaaggcgagccugaucgaggugaagacaugccuguggcccaagacccacacccucuggucuaacgggguccucgagagccaaauguuaauccccaaauccuaugcaggucccuucagccagcacaacuaccgccaggguuacgccacgcagaccgugggccccuggcaucuugggaagcuggagaucgacuucggcgagugccccggcaccacggucaccauccaagaggacugcgaccaccgggggccuagccugcggaccacgacugccuccgggaagcucgugacucaauggugcugccgcaguugcacgaugccaccccuacgguuucucggggaggauggcugcugguacgguauggagauccgaccccucaaugagaaggaggagaacauggucaagagccaggugacggccggacagggcacuagcgagaccuucuccauggggcugcugugccucacccuguucguagaggaaugccugcgacgccgugugacgcgcaagcauaugauccucgugguggucaucacccugugcgccauuauccugggcggccucacguggauggaccuacugcgggcguugaucaugcugggcgacaccauguccggucgcaucgggggccagauacaccuggccaucauggcaguguucaagaugagucccggguacguccuaggcgucuuccugcggaagcugacgagucgcgagacugcccucauggugaucgggauggcaaugacuacagugcugagcauuccgcaugaccuaauggagcucaucgacgguaucagccugggccuuauccucuugaaaaucguuacgcaguuugacaacacccagguggggacccuggccuugucccugaccuucauccggagcacgaugccccuggugauggccuggcgcaccaucauggccguccucuucguggugacucugaucccccugugccgaaccucaugccuccaaaagcaaagccauugggucgagauuacggcccugauccugggcgcccaggcuuugcccguguaccuaaugacccugaugaagggagccucccgcagaaguuggccgcucaaugaaggcauaauggcagugggccuggucucccuacucggcagcgcccugcuaaagaacgacgugccccucgcgggucccaugguggccgggggccugcugcuugcggccuacgucauguccgguagcuccgccgaccuuucccuggaaaaggcugccaacgugcagugggacgagauggccgauauaaccggcucaucccccauaaucgaggugaagcaggacgaggacgggagcuucuccaucagagacguagaagagaccaauaugaucacacuucuugugaaguuggcgcucauaaccgugagcggccuguacccgcuggccauccccgucaccaugacccucugguauauguggcaagugaagacacagcguuccggcgcccugugggacgugcccagccccgccgccacccagaaggccgcccuuuccgaagggguguaccggaucaugcaacggggucucuucggaaagacgcagguuggaguggggauucauauggagggcgucuuccacaccauguggcacgugacccguggaagcgugaucugccacgagacagggcgguuagagccuuccugggcugacgucagaaaugacaugaucagcuacggagggggcuggcgccucggugauaagugggauaaggaggaggacguacaggugcuugccaucgagccgggcaaaaacccaaaacacguccagacuaagcccggccuuuuuaagacccugacuggggagaucggagcagugacccuugauuucaagccggggaccuccggcagccccauuaucaacaggaagggcaaggugaucgggcuguacggcaauggugucguaaccaagucgggggauuacguuagcgccaucacccaggccgagcgcaucggcgagcccgacuacgagguugacgaggacaucuuccgcaagaagcgcuuaacgauuauggaccuccacccgggcgcgggcaagaccaagcggauccugcccucuaucgugcgagaagcguuaaagcgccggcugcggacccuaauucuggccccgacccgcguagucgccgccgagauggaggaggcccuccgggggcuccccauccgcuaccagacgccggccgugaaaagcgagcacaccggccgggagaucgucgaccuaaugugucacgccaccuucacuacgagacugcuaucuagcacacguguccccaauuacaaccugaucguuauggacgaggcccacuucaccgaucccucguccgucgcggcccgcggauacauuagcacacggguggagaugggagaggccgccgccaucuucaugacggcgaccccgccuggggcaaccgaccccuucccccaaucaaacagcccgauugaggauauagagcgggagaucccggagcggucauggaacaccggauucgauuggaucacggauuaucaggggaagacagugugguucguccccucuaucaaagccggaaacgacauagccaacugcuuacggaagaguggcaagaaggugauccaacucucgcguaaaaccuucgacaccgaguaccccaagacgaaacugacggacugggacuuuguggucaccaccgacauaagugaaaugggggcuaauuuccgggcgggccgagucaucgacccccgacguugcuugaaaccagugauccucacugaugguccagaacggguaauucuggccggaccuauucccgugaccccugccagcgccgcgcagcgccggggacgcaucgggcggaacccggcacaggaggacgaccaguacguguucucgggcgauccccugaagaaugacgaggaccacgcccauuggacagaggccaagaugcuccuggacaacaucuauacgcccgagggaaucauaccgacgcuguucgguccggagcgcgagaaaacgcaggccaucgacggcgaguuccggcugcgcggggagcaacgcaaaacguuuguugagcuaaugcgccguggagaccuucccguguggcucucuuacaagguggccuccgccggaaucucguacaaggacagggagugguguuucaccggcgagcggaacaaccagauucuugaggagaacauggagguugaaaucuggacucgcgaaggggagaagaagaagcugcggccgcgcuggcuugacgcacggguauaugccgacccgauggcccugaaggacuuuaaggaauuugcguccggcagaaagagcaucacccuggauauccuaaccgaaauugcaucccugcccaccuaccugagcucccgugccaaacuugcccuggacaacauagugaugcugcacaccacggagcguggagggcgcgcuuaccagcacgcgcucaaugagcugcccgaaagccuggagacacucaugcuggucgcacugcuuggcgcgaugacagccggcaucuuuuuauuuuucaugcagggcaaggggauaggcaaacugucuaugggccucauagccauagccguggccuccgggcuguuauggguagccgagauccagccccaguggauagcggcuagcauaauacucgaguucuuccucauggugcugcuuaucccagagcccgagaagcagcggacgccacaggacaaccagcugaucuaugucaucuuaacgauccugaccaucaucggccugaucgcagccaaugagauggggcugaucgaaaagaccaagaccgacuucgguuucuaccaggugaagacggagaccaccauccucgacgucgaccugcgcccggcuucugcguggacccuauaugcggucgccacgaccauccucacccccaugcugcggcacacaaucgagaacacaucugccaaucugucucucgccgccaucgcgaaucaagccgccgugcuuauggggcuggguaagggcuggccgcuccaccgcauggacuuaggagugccccugcuugccaugggcugcuauucccagguuaacccgacgacucuaaccgccagccuagugaugcugcugguccacuacgcuaucaucgggcccggcuugcaggccaaggcgacgcgggaggcccagaagcgcacugccgccgggaucaugaaaaacccaaccguggaugggaucaccguuaucgacuuagagccaaucaguuacgaccccaaguucgagaagcagcugggccaggucaugcugcucguguugugugccggacagcuccuccugaugaggacaaccugggccuuuugcgagguucugacgcucgccacuggccccauccugacgcugugggaggggaacccuggucgcuuuuggaacaccaccaucgcggugucuaccgccaacauauuccguggcagcuaccucgcaggagccggccucgccuucucccugauaaagaacgcgcagacgccgcgccgggggacggguacaaccggagaaacgcucggcgagaaauggaaacgccaacugaacucgcuagaucggaaggaguucgaggaguacaagagauccgggauccucgagguggaucggaccgaggccaagagcgcccugaaggacggguccaagacgaaacaugcagugagucgagguuccagcaaaauacgcuggauuguugagagagguauggugaagcccaagggcaagguggucgaccuggggugcgggcgcggcgguugguccuacuacauggccacccuuaagaacgugaccgaggugaagggcuacacgaaaggggguccagggcacgaagaacccauccccauggcaacuuauggguggaaucuggucaaguugcacagcgggguggacguguucuacaagccgacugagcaaguugacacccugcugugcgacaucggggagucguccagcaaucccacgauagaggaggggcguaccuuacgcguucucaagauggucgagcccuggcuguccagcaagcccgaguucugcauuaaggugcugaauccuuacaugccgacagugaucgaggagcuggaaaaacuccaacggaagcacgggggcaaccugguccgcuguccacugagcagaaacagcacacaugagauguacuggguguccggugccagcgggaacaucguaagcucggucaauacgaccucaaagaugcuccugaaccgguucaccaccaggcaccgcaagccuacauacgagaaggacguggacuugggcgccgggacccggagcguuuccaccgagaccgagaagccggacaugacgaucaucggacgccggcuacagcgccugcaggaggaacacaaggagaccuggcacuacgaucaggagaacccuuacagaaccugggccuaccacgggucauacgaggcucccucaacagguagcgccuccuccauggucaacggcguggugaagcugcuaacgaagccaugggacguuauccccauggugacccagcuagcuaugaccgacaccacgcccuucgggcagcagcgcguguucaaggaaaaggucgacacccggacuccccaaccgaaacccggcacccgcaugaucaugaccaccacugcaaacugguugugggccuugcuggguaagaagaagaacccgcgccuaugcaccagggaggaauuuaucucaaaagugcggagcaacgcggcuaucggugccguguuucaggaggagcagggauggacgagcgcguccgaggccgucaacgacagccgcuucugggaacucguggacaaggagcgggcgcugcaccaggaggggaagugcgaaucaugcgucuauaauaugauggguaagcgcgagaagaagcugggggaguuuggccgcgcuaaggggagccgcgcgauuugguauauguggcucggcgcccgcuuccuagaguucgaggcccuaggguucuugaacgaggaucacugguucggccgggagaacuccugguccgggguggagggugagggccugcaccgccugggguauauccucgaggagauagacaagaaggacggcgaccuaauguacgcagacgacaccgcuggcugggauacgcggaucaccgaagacgaccugcagaacgaggaacucaucacugagcaaauggcaccccaccacaagauccuugccaaggcgaucuucaagcuaacuuaccagaacaagguggucaagguccucagacccaccccgagaggggcugugauggacaucaucagucggaaggaccagcggggcuccggacaggugggcaccuacggguuaaacaccuucacaaacauggaaguacagcuaauccgucagauggaggcagagggcgugaucacccaggacgacaugcagaacccgaagggccucaaggaacgcguggaaaaguggcuucgggaguguggggucgaucggcuaaagcgcauggccauuuccggcgacgauugcguggugaagccacucgacgagcgguucgguacgagucugcuauuccuaaacgauaugggcaagguccgcaaggacauaccgcagugggaacccaguaagggguggaaaaacuggcaggagguacccuuuugcagccaucauuuccacaagaucuucaugaaggacggccggucccuggugguccccugccgcaaucaggacgagcugaucggccgggccaggauuucgcaaggggcgggcuggagucuuagggagaccgcaugucucgggaaggcuuacgcccaaauguggagucuuauguacuuucauagacgugaccuacgguuggcauccauggcaaucugcagcgccguaccgacagagugguucccuaccagccgcaccacuugguccauccaugcccaucaccaauggaugacgaccgaggacauguugaagguguggaaccgggucuggaucgaagacaaccccaacaugaccgacaaaacccccauccacagcugggaggacauccccuaccucgggaagcgcgaagaccuguggugcgggagucugaucggccuuucaucccgggccacuugggccaagaacauccacaccgcgaucacacaggugcgcaaccugaucggcaaggaggaguacguggacuacaugcccguaaugaaacgauauagcgcgcccuccgagucggaggggguacucuag

SEQ ID NO: 26244 - RNA, 9867 nt, Artificial Sequence
  derived and/or modified CDS sequence (opt11) from DENV-4__GQ199880__SS-prME
agcaccaucaccuugcucugcuugauucccaccguaauggccuuucaccugagcacacgggacggcgagccccucaugaucgucgccaaacacgagcgggggcguccauuauuauucaaaaccacugagggcauuaauaaguguacccucaucgcuauggaccuuggggagaugugcgaggacacuguaacauacaagugcccccugcucgugaacaccgagccagaggauaucgacugcugguguaaccugacgucgaccugggucauguacgggaccugcacccaguccggggagcggcggcgggagaagcggagcguggcccuuacgccgcauuccgggaugggccucgaaacccgugccgagaccuggaugaguuccgagggggccuggaagcacgcucagcgcguggaaagcuggauccuccggaaccccggcuucgcgcugcucgccggguuuauggccuacaugaucggucagaccgggauucagcggacggucuucuucgugcugaugaugcuggucgcccccuccuacggcaugaggugcguaggugugggcaaucgugauuucgucgagggcguuagcgggggugccuggguugaucucgugcuggagcacggcgguugcguaaccaccauggcccaaggcaaaccuaccuuggauuuugagcuuaccaaaaccacggccaaggagguggcccuucugcggaccuacugcaucgaagccuccaucagcaacaucacuaccgcgaccaggugcccgacccagggggagccguaucucaaggaggaacaggaccagcaguacauuugucggcgcgacguggucgaccggggcugggggaauggcugcggccuuuucgggaaagggggcguggugacaugugcaaaguuuagcugcagcgggaagaucaccgggaacuuaguccagaucgaaaaccucgaguauaccgugguggucaccguacauaacggugacacucacgcuguagguaacgacaccaguaaccacggcgugaccgccaccauaacgccccgcuccccuagcguggagguaaagcugccugacuauggcgagcugacacucgauugcgaaccacgcagcgggauugacuucaacgagaugauccugaugaagaugaagaagaaaacuuggcugguacacaagcagugguuccucgaccugccgcugcccuggacggccggcgcggacaccuccgagguccacuggaacuacaaagagcgaaugguaacguucaaggugccgcacgccaagcggcaggacguuaccguccucgguagccaggaaggcgccaugcacucagcccuggcaggcgcgaccgagguggacuccggggacgguaaccacauguucgcggggcaccuuaagugcaaaguccgcauggagaagcuccgcauaaagggcaugagcuacaccaugugcuccgggaaguucagcaucgacaaggagauggcugaaacgcaacaugggaccaccgucgugaaagugaaauacgagggggccggggccccaugcaaaguccccauugagauacgugacgugaacaaggaaaagguggucgguagggucauauccagcaccccuuuggccgagaacacaaacuccgugaccaacaucgaguuggagccgccguucggcgacuccuacaucgucauuggcguuggaaacuccgcccucacccugcacugguuccggaagggauccuccaucgguaagauguuugagucuacguaccgcggggccaagcggauggcgauccugggagagacggcuugggacuucgggaguguaggcggcuuguucaccagucuggggaaagccguucaccagguguucgguaguguuuacacuaccauguucgggggaguuucauggaugauucgcauccugauaggguucuugguguuauggauuggaacuaacucccggaacaccaguauggccaugaccugcauagccgugggcgggaucacccuguuccuggguuucacaguacaggccgacauggggugcguggugucguggagcggccgugagcucaagugcgggucaggcauauucgucguugacaaugugcacaccuggaccgaacaguacaaguuccagcccgaauccccagcccggcuggcaucagccauccugaacgcccacaaggacggcguuugcgggauccgcucuaccacccgguuagagaacgugauguggaagcaaaucaccaacgaacugaacuauguguuaugggaaggagggcacgaccucaccgucguggccggcgaugugaaggguguacucacuaagggaaagcgcgcgcugacgccacccguuagcgaucucaaguacuccuggaagaccugggguaaggcuaagaucuuuacccccgaggcccggaauagcacauuccugaucgaugggcccgacacgagcgaguguccgaacgaacgccgggcauggaacagucuggagguggaggauuacggcuucgggauguuuaccaccaauauauggaugaaguuccgugagggguccagcgaggucugcgaucaucggcuaauguccgccgcgaucaaggaucagaaggccgugcaugccgacaugggcuacuggaucgagaguuccaagaaccaaaccuggcagaucgaaaaggccagucugauagaagugaaaacuugucuguggcccaagacccacaccuuaugguccaacggggugcuggaaagccagaugcugauccccaaguccuacgcgggccccuucagucagcacaacuaccgucagggguacgccacccagacugugggccccuggcaccucgggaagcuggagauagauuucggcgaaugucccggcacgaccgugaccauucaggaggacugugaucaccggggaccuucccugcgcaccacuacugccagcggcaaacuugucacacaguggugcugccgaagcugcaccaugccgccccuucgguuccugggggaggacggcugcugguaugguauggagauccgcccccuaaacgagaaagaggagaacauggugaaaucucaggugacggcgggccagggcaccagcgaaacuuuuaguaugggccugcucugccucacucuguuuguggaagagugcuugcggcgccgggugacgcgcaaacacaugauacucgucgugguuaucacccuaugcgccaucauccucggaggguugaccuggauggaccuucugcgggcucuuaucauguuaggcgacaccaugagcggccgcaucgggggccagauacaccuggcaauaauggccgucuucaagaugucacccggguacgugcucggaguguucuuacgaaaacugacgagccgggagaccgcccugauggucaucgggauggccaugaccaccguucugucuaucccgcacgaccuuauggagcucauugacggcaucucucugggccugaucuugcugaaaaucgugacucaguucgauaauacccaggucgggacgcuagcgcucagucucacuuucauccgaagcacgaugccgcuggucauggccuggcgcaccaucauggccguccuuuucguggugaccuugaucccacuaugccggacgagcugccuccagaagcagagccacuggguggagauaacagccuuaaucuugggcgcucaggcucuccccgucuaccugaugaccuugaugaagggggcaucccgacggagcuggccgcucaacgaggggaucauggccguggggcuggugagccugcucggcagcgcacugcucaaaaaugacgucccccucgcgggccccaugguggccggaggccugcuucucgcagccuacgugauguccgggagcagugccgaccuuucguuggagaaagcggccaauguccagugggaugaaauggcggacaucaccggaucaucccccaucaucgaagugaaacaagacgaagacgguagcuucuccauccgcgacgucgaggaaacuaacaugauaacccuccuggucaagcucgcccucauuacggucucgggccuuuacccacuggccaucccugugaccaugacccugugguacauguggcagguuaagacgcagcgguccggcgcauugugggacguacccagccccgcagccacacagaaggccgcgcuuucggaggggguguaucgaauuaugcagcggggccuauucggaaagacccaggugggaguggggauccacauggagggaguguuccacacgauguggcacguuacucgcggcagcgugauaugccacgagacugggcgguuagaaccgucaugggcggacguucgcaaugacaugaucuccuacggcgguggcuggcgccugggcgacaaaugggauaaagaggaggauguccaggugcucgccaucgagcccgggaagaaccccaagcacgugcagaccaagcccggcuuauucaagacacugaccggggaaaucggcgcggucacgcucgacuucaagccggggaccuccggaagcccuauaaucaaucggaaaggcaagguaauaggacuuuacggaaacggcgugguaaccaaauccggcgacuacgugagcgccaucacucaggccgaacguauuggugagcccgauuacgagguugacgaggacaucuuccggaagaagcggcuaacgaucauggaccuccacccuggcgcggguaaaacgaagcggauucuacccagcauuguaagagaggcucugaaaaggcgacuccgcacccucauccuugcgcccacccgagucguggcggcggagauggaagaagcccuccgaggguuacccauccgcuaccaaacgcccgccguaaagucugagcauaccggccgcgaaaucguggaccucaugugccacgccaccuucaccacgcgauuauuaucgagcacacgugugccuaacuacaaccugaucgucauggacgaggcccacuucaccgaccccagcuccguggcggcccgcgguuacauaagcacgagagucgaaaugggcgaagccgccgcaauuuucaugacugcgaccccgccaggggccaccgaccccuucccccaguccaacucacccaucgaggacauagagcgugaaaucccggagcgguccuggaacaccggauucgacuggauuaccgacuaccagggcaagaccgugugguucguucccagcaucaaggccggcaacgacaucgcaaacugccugagaaagucuggcaagaaagucauccagcucagcaggaagaccuucgacacggaguacccgaaaacgaagcuaaccgacugggauuuugucgugaccaccgacaucagcgaaaugggggcgaacuuucgggcgggacguguuauagacccccgcagaugccugaagccggugauuuuaacggacggcccggagcgggugauccuggcugguccaaucccugucacgccggcuagcgcagcgcagagaaggggacgcauugggagaaaccccgcucaggaggacgaccaguacguguuuucuggcgauccccugaaaaacgacgaagaccacgcccacuggaccgaggccaagaugcuacuggacaacaucuacacccccgagggaauaaucccgacacuguucggacccgagcgcgagaagacccaggccaucgacggagaguuccggcuacgaggggaacagcgaaagacauucguggaguugaugcgccgcggcgacuuacccgucuggcugucuuacaagguggcguccgccggcauaagcuacaaagacagagaauggugcuucacaggcgagcguaacaaccagauucuggaagaaaacauggagguggagauuuggacgcgcgagggggagaaaaagaaacugcggccccguuggcuugacgcaagagucuaugccgacccaauggcccuaaaggacuucaaggaguucgcguccggccggaaaagcauuacgcuugacauccuuaccgagauagccucgcuccccaccuaccugagcucccgcgccaaguuggcccuugacaacaucgugaugcuccacaccacggagagaggcgggcgggccuaccaacacgcguugaaugaacugcccgagagcuuggaaacacugaugcuggucgcacugcucggcgcaaugacagccggcauauucuuguucuucaugcagggcaaggggaucggcaaguuaagcaugggacucauagcgaucgcgguugcuucagggcugcuguggguugccgagauccaaccgcaguggauagccgcgucgaucauccucgaguuuuuccucauggugcugcucauacccgagccagagaaacagcggaccccacaagacaaccagcugaucuacgucauccugacaauccucaccaucauuggccugauagcagcgaacgagauggggcucaucgagaagacaaagacggacuucggcuuuuaccagguaaagacggagaccaccauauuggacguugaccuacgcccggcuuccgccuggacccuuuacgcggucgcaacaacgauccuuacacccaugcugcggcauacuauagaaaacacuagcgccaaccugucgcucgcugccaucgcgaaccaggccgcggucuugaugggguugggcaaggguuggcccuuacaccgcauggacuuaggggucccucugcuggccauggguugcuacagccaaguuaacccgaccacccugaccgccagccuaguuauguuauuggugcacuaugcgaucaucgguccagggcugcaggcuaaggccacgcgggaggcccaaaagcgcacagcagccggaaucaugaagaacccgaccguggauggaaucaccgugauagaccuagaacccaucucuuacgacccaaaguucgagaagcaacugggucaagugaugcuguuaguccugugcgcaggacagcugcugcugaugcggacaaccugggccuucugugaaguuuuaacccucgcgacgggccccauucugacgcugugggaggggaacccgggucguuuuuggaacaccaccaucgcggugucgaccgccaauaucuuucggggcagcuaccucgccggggcuggucuggcuuuuuccuugauaaagaacgcgcagaccccgcgccgggggaccgggacuacgggggagacauuaggggagaaguggaagcgccagcugaacucucuggaccgaaaggaguucgaggaguacaaaaggucaggcauccuagaagucgaccggaccgaagcaaagagcgcccugaaggacggcucgaagaccaagcaugcggugagccgcgguaguucuaagauccgguggaucguggaaaggggaauggucaaacccaaaggcaaggugguggaccuuggguguggacgcggcggguggucuuacuacauggcaacacuaaagaacgucacugagguaaaggguuacacgaaagggggccccggucacgaggagcccauucccauggccacauauggauggaaccuggugaaguugcacagcggcguugauguuuucuacaagccaaccgaacagguggacaccuugcugugcgacaucggugaaagcuccagcaaccccacgaucgaggaggggcggacccugcgcguccugaagaugguggagcccuggcugagcagcaagcccgaguucugcauuaagguccuuaacccguacaugcccaccguuaucgaggaacuggagaaacuccagcggaagcauggugggaaucucguacgcugcccccugucccggaacagcacccacgagauguacuggguuuccggcgcaagcggaaauauuguuagcuccguuaauacaaccucgaagaugcuacugaaccgguucacuacacggcaccgcaagcccacguacgaaaaggacgucgaccugggcgccgggacccggagcguuaguaccgagacggagaagccggacaugacgaucauugggcgccggcuccagcgccugcaagaggagcacaaggaaacguggcacuacgaucaggagaaccccuaccggacaugggccuaccacggaagcuacgaggcccccuccacaggcagcgccucgagcaugguuaacggugucguaaagcuguuaacgaagccgugggacgugauccccauggucacccagcuagccaugacagacaccacgccguucgggcagcagcgcguguuuaaggagaagguagauaccagaaccccucagccgaagccaggaacaaggaugaucaugacaacaaccgccaacuggcugugggcccuucuggguaagaagaaaaaccccaggcugugcacccgagaggaguuuaucuccaaaguucgguccaacgcggccaucggcgcaguguuccaggaggagcaagguuggacgagugcuuccgaggccgucaacgacagccgguucugggagcuuguugacaaggagcgggcgcugcaccaggagggaaagugugaguccugcguuuauaauaugauggggaaacgcgagaagaagcugggggaguucggcagggccaaggggucacgcgcgaucugguacauguggcuaggcgcccgauuccuggaguucgaagcccugggguuccugaacgaagaccauugguucggcagagagaacuccuggagcggcguggagggagagggcuuacacagacuuggauauauuuuagaagaaaucgacaagaaggacggggaccucauguacgcugaugacacagccggcugggauacccggaucaccgaggacgaccugcagaaugaagaacucaucacggagcaaauggcuccccaucacaagauccucgccaaagccaucuucaagcugaccuaccagaacaagguagugaaaguccuucgcccgacucccagaggggccguaauggacaucaucucgcguaaggaccagcgggggagcgggcagguaggcaccuacggucugaauacuuucacaaacauggagguccagcugaucaggcaaauggaggccgaaggugucaucacccaggaugacaugcagaaccccaaaggccugaaggaacgaguggagaaguggcucagagagugcggcguggaucggcuaaagcgcauggccauuucuggcgacgacugcguugugaagcccuuagacgagcguuuugggaccucacugcuuuuccucaacgacauggguaaagugcgaaaggauaucccgcagugggagccauccaagggguggaaaaacuggcaagaggucccauuuugcagccaucacuuccauaaaaucuucaugaaagacggacggucgcuaguggugccaugccgcaaucaagacgaguugaucggacgggcccgcaucagccagggggccggcuggucucuucgcgagaccgccuguuuggggaaagcauacgcccagauguggagccugauguacuuccaccggcgcgaccucagacucgccuccauggccauuugcuccgccgucccgacugagugguuccccaccucuagaaccaccugguccauacacgcccaucaccaguggaugacgaccgaggauaugcugaagguauggaaccgcguguggaucgaagacaauccgaacaugaccgacaaaaccccuauccacucaugggaagacauuccguaccucgggaagcgugaggaccuguggugugggucccugaucggccucuccucacgggcgacgugggccaagaauauucacaccgcgaucacacagguccgcaaccucaucggcaaggaagaguacguugacuacaugccugugaugaagcgcuacagcgcgccuagugagucggagggggugcuguga

SEQ ID NO: 26245 - RNA, 9867 nt, Artificial Sequence
  derived and/or modified CDS sequence (opt11) from DENV-4__GQ252675__SS-prME
agcaccaucacccugcucugccugauacccaccgugauggcauuccaccuauccacccgggacggcgagccccucaugauaguggccaagcacgagcgcgggagaccccugcuguucaagacgaccgaaggcaucaacaagugcacccuaaucgccauggaucucggagagaugugcgaggauaccgugaccuacaaguguccccugcucguuaauacagagcccgaggauaucgacugcugguguaaccugaccucgaccuggguaauguaugguaccugcacccaguccggggagcggcgccgggagaagcguagcguggcccugaccccacacuccggcaugggccuugagacccgggccgagaccuggaugagcucugagggggccuggaaacacgcccagcgcguggagagcuggauccugcggaacccgggauucgcacugcucgccggguuuauggccuacaugauaggccagacggggauccagcgcaccguguucuuugugcugaugaugcugguggcccccucauaugguaugcggugcgugggcguagggaaccgcgacuucguugaaggcgucagcgggggcgcguggguugaccucgugcuggaacacggcgggugcgucaccaccauggcucagggcaaacccacccuggauuucgagcucacgaagaccacagccaaggagguggcacugcugcggaccuacugcaucgaggcuagcaucagcaauaucacgacagcgacccgcugcccgacccagggggagccauaccugaaggaggagcaggaccaacaguacaucugccggcgcgacguggucgaccggggcugggggaacggcugcggccuguucgguaagggcggcguggugacgugugccaaguucuccugcagcggcaagauaaccgggaaccugguccagaucgagaaucucgaauacaccgugguggucaccguccauaacggcgacacccacgccguugggaacgauaccuccaaccauggggugaccgcgaccaucacgcccagaaguccguccguggaggucaagcucccggacuacggcgagcugacccucgacugcgagccccgcagcgggauugacuucaacgagaugauccugaugaagaugaagaagaaaaccugguuagugcacaagcagugguuucucgaccugccccugcccuggaccgccggcgcggacaccuccgagguucacuggaauuacaaggaaaggauggucacuuucaaggugccgcacgccaagcggcaagacgugaccguccucgggagccaagagggagccaugcacagcgcccuggccggcgcgaccgagguggacuccggcgacggcaaccacauguucgccgggcaccugaaguguaagauccgcauggaaaagcuucgcaucaagggcaugagcuauaccaugugcucuggcaaguucagcaucgacaaggagauggccgaaacgcaacacgggaccacaguuguuaaggucaaguaugagggugccggggcccccugcaaggugcccauugaaauccgugacgucaauaaggagaagguggugggacgcgucaucagcagcacuccucuggcggagaacacgaacagcgugacgaacaucgagcuggagccgcccuucggggacagcuacaucgugaucggcgucggcaauuccgcccucaccuuacauugguuccggaaggggagcaguauagggaagauguucgagagcaccuaccgcggagccaagcggauggccauccugggcgagacggccugggauuucggguccgugggcggccuauucaccagccuggggaaggcagugcaucaagucuucggcuccguguacacuaccauguucgggggcguaucuuggaugauccguauccucauaggauuccugguucuguggauuggcacgaacucccggaacaccagcauggccaugaccugcauugccgugggaggcaucacccuguuccucggcuucacggugcaggccgauauggggugcguaguguccuggagcgggcgcgaacucaaaugcgggagcggcauuuucguugucgacaacguacacaccuggacggagcaguacaaguuccaacccgagucccccgcgcgccuggccagcgccauccuuaacgcacacaaggacggagugugcgggauccgcucgaccacccggcucgagaacgucauguggaagcagauuaccaacgagcugaacuacgugcugugggagggcgggcacgaucucaccguggucgccggcgacgugaagggagugcugaccaaagggaagcgcgcgcugacgccacccgucagcgaccucaaguacuccuggaagacuuggggcaaggccaagaucuucacccccgaggcccggaacagcacauucuuaaucgacgggcccgacacguccgagugcccgaacgagaggcgagcuuggaacagccuggagguggaagacuauggguucgggauguucaccaccaacaucuggaugaaguuccgcgaaggcuccucggaggugugcgaucaccggcucauguccgccgcgaucaaggaccaaaaggccgugcacgccgacaugggcuacuggaucgagucaucuaagaaccagaccuggcagauagagaaagccucucugaucgaggugaagacgugccuguggcccaaaacccacacccucugguccaacggggugcuggagagccagaugcugauccccaaauccuacgcgggcccguucagccagcacaacuaccgccagggguaugccacucaaaccgucgggcccuggcaccucgggaagcucgagaucgauuucggcgaaugucccggcacgacugugaccauucaggaggacugcgaccaccgggggcccagccugcgcaccaccaccgcguccggcaagcuggugacccaguggugcugccgcagcugcaccaugccgccuuugcgguuccugggggaggacggcugcugguacgguauggagauucgcccgcucaacgagaaagaggagaauauggucaagucccaggugaccgccggccagggcaccagugagaccuuuuccauggggcugcugugccuuacccuguucgucgaggagugccugcgacgccgggugacgcgcaagcacaugaugcucgugguagugaucacccugugcgcgaucauucugggcgggcucacauggauggaucugcuucgugcucugaucaugcugggugacacaaugucaggccgcaucggggggcagauccaccuggccauaauggccguguucaagaugucacccggguacguccucggcguguuccugcggaagcugacgagccgcgaaaccgcccucauggugaucgggauggccaugaccaccgucuuaagcaucccgcacgaccuuauggaacucaucgacggcauuagccuaggccugauucuccugaaaacggugacccaguucgacaacacccagguggggaccuuggcacucucccuuaccuucauccgguccaccaugccccuuguaauggccuggcgaaccaucauggccgugcucuucguugucacccugaucccccuuugccggacuucgugccuccagaaacagagccacugggucgagaucacggcccugauacugggugcccaggcgcuccccguguaccuuaugacccugaugaagggggcuucccggcggagcuggccgcucaacgaagguaucauggccgucgggcuggugucccuccucggaagcgcccugcugaagaacgacgugccccucgcgggacccauggucgcagggggccugcugcucgccgccuacgucaugagcgguagcagugccgaccugucccuggagaaggcggcuaacgugcagugggacgagauggccgacaucacgggcagcucccccaucaucgaggucaagcaggaugaggacgggagcuucuccauccgcgacguggaagagacgaacaugaucacccuccugguuaagcuggcccucaucaccgucagcggcuuauacccgcuggccauacccgucaccaugacgcucugguacauguggcaagucaaaacucagcgguccggcgcgcugugggacguccccucacccgcggcaacccagaaggccgcccuguccgaggggguauaccgcaucaugcagcggggcuuauucgggaagacccagguaggaguaggcauccacauggaggguguguuccacaccauguggcacguaacgcgcggcagcgucauuugccacgaaaccggccggcuagagccgucaugggcggacgugcgcaacgacaugaucuccuacggcgggggcuggcgcuuaggcgacaagugggacaaggaggaggacgugcagguccucgccaucgagcccggcaagaaccccaagcacgugcagacgaagcccggccuguucaagacgcugacgggugagaucggcgcagugacacucgacuucaagccggggaccuccggcucccccaucaucaacaaaaagggcaaggucaucgggcucuacgggaacgggguggugaccaagucuggcgacuacguauccgccaucacgcaggcagagcggauaggcgagcccgacuacgagguggaugaagacaucuuucgcaagaaacggcugaccaucauggaccugcacccgggcgcgggcaagaccaagcgcauccugcccucaaucguucgagaggcccugaagcgcaggcugcgcacgcugauccuugcccccacgcgagucgucgccgcggagauggaagaagcucugcgaggccucccgauccgguaccaaacuccggccgucaaaagcgagcacaccggccgcgagauuguagaccugaugugccacgccacuuucacgacccggcuacucuccagcacccgcgugccuaacuauaaccugaucgugauggacgaagcccauuucacggaccccagcucgguagcggcccgggguuacaucucaacgcgcguggagaugggcgaggccgccgccaucuucaugaccgcgacgccaccuggggccaccgaccccuucccacagagcaauagccccaucgaggacaucgagcgggagaucccggagcgcuccuggaacacgggcuucgacuggaucaccgacuaccaggguaagaccgucugguucgugcccagcaucaaggccgguaacgacauagccaacugccugcggaaguccggcaagaaggugauccagcucagccgcaaaaccuucgauacggaauaucccaagaccaagcugacagacugggacuuugucguaaccacggauaucuccgagaugggcgccaacuuccgcgcgggccgggugauugacccccgcagaugccugaagccgguuaucuuaaccgaugggcccgagcgcgucauacuagccggcccgauccccgugaccccggcaagcgcggcgcagcggcgcggccgcauugggcguaaccccgcccaggaggacgaccaguacguguucaguggagacccccuaaaaaacgacgaggaccacgcccauuggaccgaggccaagaugcuccuagacaacaucuacacgccggaagguaucauaccgacccuguucggccccgagcgggagaagacccaggccauugacggcgaguuccgccuccgcggggaacaacgcaagaccuucguggagcugaugcggcgcggcgaccugcccguguggcuuagcuacaagguggcguccgccgguaucagcuacaaagaccgggaguggugcuucacgggcgaacgcaacaaccagauauuagaggagaacauggagguugagauuuggacacgggagggggagaagaagaagcugcgcccacgguggcucgacgcacgcguguaugccgauccgauggcccuaaaggacuuuaaggaguucgcguccggccgcaagagcaucacccuggacauccugacggagaucgccucccuuccuaccuaccugucgucacgcgcgaagcuggcucuggacaacauuguaaugcugcacacgaccgagcgcggcgggcgggccuaccagcacgcucucaacgagcugccagagagccuagagacccucaugcugguagcccugcucggcgccaugaccgccgggauuuuccuuuucuuuaugcagggcaaggggaucggcaagcugagcaugggccucaucgcgaucgccgucgccucggggcugcugugggucgccgagauccagccgcaauggaucgcagcgagcaucauacucgaguuuuucuuaauggugcugcucauccccgagcccgagaagcagcgcacgccccaggauaaccaacugaucuacgugaucuuaacgaucuugacgauuauuggccugaucgcagccaacgagauggggcucaucgagaagaccaagacggacuucggcuucuaccaggucaagaccgagaccacuauucucgauguggaccugagaccugccuccgcauggacgcuguaugcgguggccaccaccauccucacacccaugcugcgacacacuaucgagaacaccagcgcuaaccugucccucgccgccaucgcuaaccaggccgccguccugauggggcugggcaaaggcuggccccuccaucggauggaccuggggguuccccugcucgcgauggggugcuacagccaagugaacccgaccacccugacagccucccuggucaugcuacucgugcacuacgcgaucauagggcccggacugcaggccaaggcaacacgagaggcacagaaacggaccgcggccgggaucaugaagaaccccaccguggacgggaucacggucaucgaccucgagccgaucagcuacgacccgaaguucgagaagcagcugggacaagugaugcugcucguauugugcgccgggcagcugcuccugaugcgcaccaccugggccuucugcgagguccugacccucgccacagggccuauccugacccugugggaggggaaccccggucgguucuggaacacaacaauugcgguguccacggccaacauuuuccgcggcagcuaccucgccggggcaggccuggcuuucucacuaaucaagaacgcgcagacgccccgucgagggaccgggacgacgggggagacacucggcgagaaguggaaacggcaguuaaacagccuggaucgcaaggaguuugaggaguauaagcgguccgguaucuuagagguggaccgcaccgaggccaagagcgcgcucaaagacggauccaaaaccaagcacgccgucagccggggcuccagcaaaauccgcuggaucguggagcgggggauggucaagcccaagggcaaggucguggaccugggaugcgggcguggcgggugguccuacuacauggccacucucaaaaacgugacggaggucaagggcuacaccaagggcggccccgggcaugaggagcccaucccuauggcuaccuacggcuggaaccuggugaagcugcacagcggcguggaugucuucuacaaaccgacagagcaggucgacacgcuacugugcgacaucggggagagcaguuccaaccccaccaucgaggagggucgcacacugcgggugcucaagaugguagagcccuggcuguccucaaagccugaguucugcaucaaggugcugaacccauacaugcccaccguaaucgaggaacuggagaaguuacagcgcaagcacggggguaaccugguccggugcccucugagucgcaauagcacgcacgagauguacuggguguccggcgcgagcggaaacauugucuccagcgugaacaccacuuccaagaugcuccugaaccgguuuaccacgcgccaccggaagccaacguacgagaaggacguggaccugggcgccgggacccgcagcgucuccacagagacggaaaaaccggacaugacgauuauaggccgacgccuccagcggcugcaggaggagcauaaggagaccuggcauuacgaccaagaaaacccuuaccgcaccugggccuaccacgguagcuacgaggcacccuccacggguagcgccuccagcaugguaaacggcguagucaaacugcucaccaagccgugggacguuauccccauggugacucagcuggcgaugacagacacgacccccuucggacaacagcgggucuucaaagagaagguggacacgcgcacgccccagccgaagcccggcacucggaugauaaugaccaccaccgccaauuggcugugggcccuucuggggaagaagaagaacccacgccugugcacgagggaggaguucaucuccaagguucgcucaaacgcggcaaucggcgcggucuuucaagaggagcaagguuggacuagcgccuccgaggccgugaacgacagccgguucugggagcuaguggacaaagagcgggcgcugcaucaggaggguaaaugcgaguccugcgucuacaauaugaugggcaagcgggagaagaagcugggggaguuugggagagccaaggggucucgcgccauaugguacauguggcuuggcgcgcgguuccuggaguucgaggcucugggguuccucaacgaggaccacugguucggccgcgagaacuccuggagcggcguggagggggagggccugcaucggcugggguauauacucgaggagauagacaagaaggacggcgaccugauguacgcggaugauaccgccggcugggacacgcgcaucacggaggacgaccugcagaacgaagagcucaucaccgagcagauggcgccccaucacaaaauucuggccaaggcgaucuuuaaacuuacuuaccagaacaagguggucaaggugcuccggccgacgccccgcggagcugugauggacaucaucucccggaaggaccagcguggcagcgggcaggucgggaccuacgggcugaacacguucaccaacauggaggugcagcugauucgucagauggaggccgagggcguaaucacccaggacgacaugcagaaccccaagggccucaaagagcggguggagaaguggcugcgggagugugggguggaccgccuuaagcggauggccaucucaggcgaugacugcguggugaaaccuuuagacgaacgcuucgggacuagccugcuauuccucaacgacaugggcaaggugcggaaggacauaccgcaaugggagcccuccaaggguuggaagaacuggcaggagguccccuucugcagccaccacuuccacaagaucuucaugaaggauggccguuccuuggucgugccaugccggaaccaggacgagcugaucggccgggcccggaucagccagggggcgggcuggucccuccgcgagacggccugccuggguaaagccuacgcccagauguggagccugauguacuuccaccgccgggaccuccgccuggccucgauggcaaucugcagcgccgucccgacagaaugguucccuacgucccggaccacguggucuauccacgcccaccaccaguggaugaccacugaggauaugcuaaagguauggaaucgcguuuggaucgaggacaacccaaacaugaccgacaagacgcccauacacagcugggaggauaucccguaccucggcaagcgggaggaccuguggugcgggucccugaucggccucagcucccgcgccaccugggccaagaacauucacacagcgaucacccaggugcguaaccugaucgguaaggaggaguacguagacuacaugcccgugaugaagcgcuacagcgcccccuccgagagcgagggggugcucuga

SEQ ID NO: 26246 - RNA, 9867 nt, Artificial Sequence
  derived and/or modified CDS sequence (opt11) from DENV-4__FJ810417__SS-prME
ucuaccauaacccugcuaugccugauccccacggugauggccuuccaccuguccacccgugacggcgagccacucaugaucgucgccaagcacgagcgggggcgcccccugcuauucaagacuacugagggcaucaacaagugcacgcucauagcgauggaucugggggaaaugugcgaggacacaguuaccuacaagugcccccugcucguuaacaccgagccagaagacaucgacugcuggugcaacuugacgucuaccugggucauguauggcaccugcacccaguccggugagcggcgccgggagaagcgcuccguagcgcugacgccacacuccgggaugggccucgaaacucgggccgagaccuggaugaguuccgagggggccuggaagcacgcccagcgcguggagagcuggauccugaggaaccccggcuucgcucugcucgcggguuucauggccuacaugaucgggcagaccgggauccagcgcacggucuucuucgugcugaugaugcugguggcccccaguuaugggaugcgcugcgucggcguggggaauagagacuucguggagggcgugagcgggggcgcguggguugaucucgugcuggagcacggcgggugcgucaccaccauggcccaggggaagccaacacuggauuucgagcucacgaagacaacggccaaggagguggcccugcugcggaccuacugcauugaggccucuaucucgaacaucaccacagcgaccagaugcccgacccaaggggaacccuaccucaaggaggaacaggaccagcaauacaucugucggcgcgacguaguggacaggggcugggggaacggcugcggacuguucgggaagggcgggguggugacgugcgccaaguucuccugcagcggcaagaucaccgguaaucuagugcagaucgagaaccucgaauacaccguaguggucaccguacacaacggcgacacgcacgcuguaggcaaugacacuuccaaccacgggguaacugccaccaucacuccccgcucccccuccguugagguuaagcugccggacuacggcgagcugacccucgacugugagccccggagcggaaucgacuucaacgagaugauccugaugaagaugaagaagaagacaugguuggugcauaagcagugguuccucgacuuacccuuacccuggaccgccggcgcagacaccagugaggugcacuggaacuauaaggagcgcaugguaacguucaaggugccgcacgcgaaacggcaagacgugaccguccucgggagccaggagggcgccaugcacagcgcccuggccggcgcgaccgagguggacuccggggacggcaaccacauguucgccgggcaccugaagugcaagguacgcauggagaagcuccgcaucaagggcaugagcuauacuauguguuccgguaaguucucgaucgacaaggagauggccgagacucagcaugggaccacaguugugaaggugaaguacgagggcgcaggggcucccugcaagguccccaucgagauccgggacgugaacaaggagaagguggucggccgcgugauuaguucuaucccccuggcggagaacaccaauuccgugacgaacaucgaauuggagccccccuucggggauagcuauaucgucaucggcgugggcaacucugcacuuacccuucacugguuccggaaggggagcuccaucggcaagauguuugagagcaccuaccgcggggccaagcggauggccauccugggugagaccgcgugggacuucggguccgugggcggcuuguucacgagccuggggaaggccguccaucaaguuuuuggcuccguguacacgaccauguucggcggcgucuccuggaugauccgcauccugaucggguuccucgugcuguggaucggaaccaacucccggaacacgucaauggccaugacauguaucgccgugggcgggaucaccuuauuccugggcuucaccgugcaagccgacauggggugcgugguguccuggagcggccgcgagcucaagugcggaagcggcaucuucgucguagacaacgugcacacuuggacggagcaguacaaguuccagcccgagucccccgcgcggcuggcuagugcuauccugaacgcccacaaggacggcgucugcgggauccgcuccacgacccggcucgaaaacguaauguggaagcagaucacgaacgagcugaauuacgugcugugggagggcgggcacgaccuaaccgucgucgccggcgacgugaagggcguccugaccaaagggaagcgcgccuugaccccgcccgugucugaccucaaguacuccuggaagacguggggcaaggccaagaucuuuacccccgaggcccgcaacagcaccuuucuaaucgacggucccgacaccuccgagugcccgaacgagaggcgggccuggaacagccuggaggucgaggacuacggcuuuggaauguucacgaccaacaucuggaugaaauucagggaggguuccagcgaggucugcgaccaucggcucauguccgccgcgaucaaggaccagaaggcggugcacgcggacauggguuacuggaucgagucguccaagaaccagaccuggcagaucgaaaaagccagccugauagagguuaagaccugccuguggcccaagacgcacacccucugguccaacggggugcuugagucucagaugcugauacccaaguccuacgcaggaccuuucagccagcacaacuacagacaaggguacgccacgcagaccgugggcccguggcaccucgggaagcuggagaucgacuucggcgagugccccggaaccacgguaaccauccaggaggacugcgaucaccgggggcccagcuuacgcaccaccacggccuccggcaagcucgugacacaguggugcugccgcagcugcaccaugccgccccugcgcuuccucggcgaggacggcugcugguacgggauggagauccgcccccucaacgagaaggaggagaauauggugaagucccaggucaccgccggucagggaaccagcgagaccuucucaauggggcuccugugccucacccuguucguggaagagugccuccgcaggagagugacccggaagcacaugaucuuaguagucgugaucacucugugcgccaucauccuaggcgggcucaccuggauggaccugcuacgcgcgcucaucaugcugggcgacaccaugagcggccgcaucggcggccaaauccaccuggccauuauggcggucuuuaaaaugucccccggguacguccucggaguguuccugcggaaacuaaccagccgcgaaacugcccuuauggucaucggaauggccaugaccaccguacuguccauaccgcacgaccugauggagcucaucgacggcaucagccugggccucauccuucugaagaucgugacccaguucgacaacacgcaggucggcacccuggcgcucagccugaccuucauccggaguaccaugccccugguuauggcauggcgcacgaucauggccgugcucuucgucgugacauuaaucccccugugccgaacauccuguuuacagaagcaaucccacuggguugaaaucaccgcccucauccugggcgcccaggcguugcccgucuaccugaugacguuaaugaagggggccucccgucggucauggccgcucaacgagggaaucauggccguaggguuagugucccuguuaggcagcgcccugcugaaaaacgacgucccgcucgcgggccccaugguggccggcggacugcugcucgccgccuacgugauguccggcagcuccgccgaucugucccuggagaaggcggccaacguccagugggacgagauggccgauaucaccggcuccucccccaucauagaggucaagcaggaugaggacggguccuucuccauucgcgacguugaggagaccaacaugaucaccuuauuggucaagcuggcccucaucacggugagcggccuguacccgcuggccauccccgucaccaugacccugugguacauguggcaggucaagacccagcgguccggcgcgcugugggacgugcccagccccgccgccacgcagaaggccgcccuguccgaggggguguaccgcaucaugcagcgaggcuuguucgggaagacccaggucggcguggguauucacauggagggcguguuccacaccauguggcacguaacucgcggcagcgugaucugccacgagaccgggcggcuggagccguccugggcggacgugcgcaacgacaugauuagcuacggcgggggcuggcgccugggcgacaaaugggacaaagaggaggacguccagguacucgccauagagcccgggaagaaccccaagcacguacagacgaagcccggccuguucaagaccuuaacaggagagaucggggccgucacgcucgauuucaaaccggggacguccggcucccccauaaucaaccggaagggcaaggugaucgggcuauauggcaacggcgugguuaccaaauccggggacuacgugagcgccaucacccaggcggagcgcauuggggaaccugacuacgagguggacgaggacauuuuccggaagaagcgccugacgaucauggacuugcauccgggcgccggcaagacgaaacggauccugcccucgaucguccgcgaagcccugaagcggcggcuacgcacgcucauccuggcccccacccgcguuguggccgcggagauggaggaggcccuccgggggcuccccauccguuaccagaccccggccgucaaaagcgagcacacuggccgagagauuguggaccugaugugccaugccacauuuaccacccgccuccuuuccagcacgagaguccccaacuacaauuugaucgucauggaugaggcccacuucaccgaccccagcuccguggccgcacgcggcuauaucuccacgagagucgagaugggcgaggccgccgccauauuuaugaccgcgacgcccccgggagccaccgaccccuucccccaguccaacagccccaucgaggacaucgaaagagaaaucccggagcgguccuggaauaccggcuucgacuggauuaccgauuaccaaggcaaaacugugugguucgugcccagcaucaaggccggcaacgacaucgccaacugccugcgcaaguccgggaaaaaggucauccagcucagucgcaagaccuuugauaccgaguaccccaagacgaaacugacggacugggacuucguggugaccacugacaucuccgagaugggggccaacuuucgagcgggccgcgucaucgauccccggcgcugccugaagccggugauacucacggacgggcccgagagggugauccuggccggccccauccccgucacgccagccagcgccgcgcagcgcaggggccgcauagggcggaaccccgcccaggaggacgaccaguacguguucuccggugacccccuuaagaacgacgaggaucacgcccacuggaccgaggccaagaugcucuuagacaacaucuacacccccgaggggaucaucccuacccuguuuggccccgagcgcgagaaaacucaggccaucgauggcgaguuccggcucaggggggagcagaggaagaccuucguggagcuaaugcgccggggcgaccugcccgucuggcuaagcuacaagguggcgucggccgguaucucuuacaaggaccgcgaauggugcuucacaggagagcggaacaaccagauccuggaggaaaacauggaggucgagaucuggacccgggagggggaaaagaagaagcuccggccccgcuggcuugacgcccguguguacgcugacccgauggccuugaaggacuuuaaggaguucgcuuccggccguaagagcauuacgcuggacauuuuaaccgagaucgcaucccuccccaccuaccugagcagccgcgccaaacucgcucuggacaacauuguaaugcuacacacgaccgaacggggggggcgcgccuaccagcacgcgcucaacgaacugcccgagagccuggagacucucaugcugguggcgcugcucggcgccaugaccgcagggaucuuccuguuuuucaugcagggcaaggggaucggcaaauuaagcaugggccucaucgcgaucgcggucgcauccggccuucuauggguggccgagauccagccgcaguggaucgccgcgagcauuaucuuagaguucuuccugauggugcugcucauccccgagcccgagaagcagcggaccccccaagacaaccagcugaucuacgugauccugaccauccugacgaucaucggccugaucgccgccaacgaaaugggccugaucgagaagaccaagaccgacuucggcuuuuaccaagugaagaccgagacgaccauccucgauguggacuuacgcccggccuccgccuggacgcuguacgcggucgccaccacgauacuuacccccaugcugcggcacaccauagaaaacaccagugcgaacuugucacuagccgccaucgcgaaccaggcugcgguguuaauggggcugggcaagggcuggccccuccaccgcauggaccucggggugccccugcucgccaugggcugcuacagccaggucaaccccacgacccugacugccucccuggugaugcuccuugugcacuacgcgaucauagggcccggccuccaggccaaggcgacacgggaagcccagaagcggacggcggccgggaucaugaagaaccccaccgucgacggaaucaccgugaucgaccucgagcccaucagcuacgauccgaaguucgagaagcagcugggacaggugaugcugcucgugcugugcgccggucagcuucuccugaugaggacgacaugggccuuuugugagguucugacauuggccacaggcccgauccugacccugugggaggggaaccccggcagauucuggaacacgaccaucgcggugucaaccgccaacaucuucagaggcagcuaccucgcgggggcuggccuggccuucucccuaaucaagaacgcucagacccccagacgggggaccggcacgacuggggagacccucggcgagaaguggaagcgccagcugaacucucuggaccgcaaggaguucgaggaguacaagcgcuccgggauucucgaggucgacagaacggaggccaagucggccuugaaagacggguccaagaccaagcacgccgugagccgcggcuccagcaaaauccgguggaucguagagcgcggaauggucaagccgaagggcaagguggucgaccuugggugcggccgcggcgggugguccuacuacauggccacccugaagaacgucaccgaggugaaggguuacaccaaagggggcccggggcacgaagagcccauccccauggcgacguacggcuggaaccugguaaaguuacacagcggcgucgacguauucuacaagccuaccgagcagguggacacacuccuuugcgacaucggggagucauccagcaacccaaccaucgaggagggccggacucugcgcguccucaaaauggucgagcccuggcuguccuccaagcccgaguucugcaucaaaguccucaacccuuacaugcccacagugaucgaggagcuggagaagcuccagagaaagcacgggggcaaccuggugcguugcccacugucccggaacagcacccaugagauguacugggucuccggcgcaagcggaaacaucguguccagcguaaacaccacuuccaagauguugcugaaccgcuucaccacccggcaccgcaagcccacauacgagaaggacgucgaccugggagcugggacacggagcgugagcaccgagaccgagaagccggacaugaccauaaucggccgccggcuccaacgccugcaggaagagcacaaagaaacauggcauuacgaccaggagaacccguaccggaccugggcauaccacgggagcuacgaggcgcccuccacaggcagugccuccagcauggugaacggcgucgugaagcugcucaccaagccgugggaugugaucccaauggucacgcagcuggccaugacugacaccacccccuucgggcagcagcgcguguucaaagagaagguggacacgcgcaccccccagccgaagcccggcacccgaaugaucaugaccacgaccgccaacuggcugugggcccuccuagggaagaagaagaacccccgguuaugcacccgcgaggaguucaucagcaaaguacggagcaacgcggccaucggcgccguuuuccaggaggagcagggguggaccagcgcuucggaagccgugaacgacagccgcuucugggaguuaguugacaaggaacgggcucugcaccaagagggcaagugcgaauccuguguguacaacaugaugggcaaacgcgagaagaagcugggggaguucggccgggccaaggggagccgggcgauaugguauauguggcucggggccagguucuuagaguucgaggcccuaggcuuucucaacgaggaccacugguuuggccgagagaacuccuggagcggcguggagggggagggccugcaccgccuuggguauauucuugaggagaucgacaagaaggacggcgaccugauguaugcagaugacaccgcaggcugggacacucggauaaccgaggaugaccugcagaacgaggaguugauuaccgaacagauggccccccaccacaaaauccuggcgaaggcgaucuucaagcugacguaccaaaacaagguuguaaaggugcuccggccgacuccccggggcgccgucauggacaucaucagccgcaaggaccagcggggcagcgggcaggugggcacauacgggcugaauaccuucaccaacauggaggugcaguugauccgccagauggaggccgagggcgugaucacgcaggacgacaugcagaaccccaagggccuaaaggagagaguagaaaaaugguugagagagugcggugucgaccggcugaagaggauggcaaucuccggcgacgacugcgucgugaagccccucgaugagcgguucgguaccagcuuauuauuccucaacgacaugggcaaggugcguaaggacauuccacaaugggagccuucgaagggcuggaagaacuggcaggagguaccauucugcucacaccacuuccacaagaucuucaugaaggacggccgaucccuggugguuccgugucgcaaccaggacgagcugaucggccgggcccgcaucucucagggagcgggauggucgcuccgcgagaccgccugccuuggaaaggccuacgcccagauguggucucugauguacuuccaccggcgcgaccuccggcuggccuccauggcgaucuguagcgcggucccgaccgagugguucccgacaagccgcaccaccuggucgauccacgcccaccaucaguggaugaccacggaggauaugcugaaggucuggaaucggguguggauugaggacaaccccaauaugaccgacaagacccccauucauagcugggaagauaucccguaccucggcaagcgcgaggaccuguggugcgggucccugaucggccucagcuccagggccaccugggccaagaacauccacacggcgaucacccagguuaggaacuuaaucggcaaggaggaguacguugacuacaugccuguaaugaagagguacucugccccuuccgagagcgaggguguccuauga

SEQ ID NO: 26247 - RNA, 9867 nt, Artificial Sequence
  derived and/or modified CDS sequence (opt11) from DENV-4__FJ850057__SS-prME
agcaccaucacgcugcucugucugauccccacugcgauggccuuccaccuguccacucgcgacggugagccccucaugauuguggcgaagcacgagcgaggucgaccccugcuguucaagacgacugagggcaucaacaagugcacgcucauagccauggaccuuggugagaugugcgaggacaccgugaccuacaaaugcccccugcuuguaaacacggagccugaggacauagacuguuggugcaaccuaacguccaccugggucauguacgguaccugcacccagucuggcgagcgccggcgcgagaagcgcagcguugcccugacgccacacuccgggaugggccuagagacccgggccgagacuuggaugucgagcgaaggggcauggaaacacgcacagcgcguggagaguuggaucuuacggaauccaggcuucgcccugcucgccggguucauggccuacaugauaggccagaccggcauccagagaacgguguucuucguccugaugaugcugguggcaccuuccuacggcaugcgcuguguaggcgucgggaaccgcgauuucguggagggcgugagcggcggagccugggucgaucucgugcuggagcacggagggugcgugaccacuauggcacagggcaagcccacccucgacuucgagcucacgaagaccaccgcgaaggaggucgcccuguuacggaccuacugcaucgaagcguccaucagcaacaucacgaccgccacucgcugcccgacccagggugagcccuaccucaaggaggagcaggaccagcaguacaucugccggagggauguaguggaccggggcugggggaacggcugcggccucuucggcaaggguggggucgugacgugcgccaaguucucuugcagcggcaaaaucaccgguaaccuggugcagauagagaaccucgaguacaccgucguggugaccgugcacaacggcgacacacacgcagugggcaacgacacgaguaaccacggggugaccgccacuauuacgccgaggagccccucuguggaaguaaagcucccggacuacggugaacugacccucgacugcgagccgcggucggggauugacuucaacgagaugauccugaugaagaugaagaagaagaccugguuggugcauaagcagugguucuuagaccugccccugccauggaccgccggagcggauaccuccgagguucacuggaacuauaaggagagaauggucacguuuaaagucccgcaugccaaaagacaggacgugaccgugcucgggagccaagagggcgccaugcauagcgcacuggcgggagcuacagaggucgacuccggagacggcaaccacauguuugccggccaccugaagugcaaggugcgcauggagaagcuccgcaucaagggcauguccuauaccaugugcuccggcaaguucagcaucgauaaggagauggcagagacgcagcauggcacuaccguggugaaggucaaguacgagggagcaggagcgcccugcaaggugcccauagaaauccgugacgucaauaaggagaaaguggugggccgugucaucuccaguacccccuuggccgagaauacgaacuccguuaccaacaucgaacuagagccgcccuucggggacagcuacaucgugaucggcgucggaaacucugcuuugacccugcacugguuccgcaaggguagcuccaucggcaagauguucgagagcaccuaccgcggagccaagcggauggcuauucugggcgagacggcuugggacuucgggaguguggguggauuguucacaaguuugggaaaggcugugcaccagguuuuuggauccguguacacaaccauguucgguggcgugagcuggaugauccgcauucuuaucggguuccuuguucuguggaucggcacgaacucccgcaacacgagcauggccaugaccugcaucgccguuggcgggaucacccuguuuuuagguuuuaccgugcaggcggacauggggugcguuguguccuggagcgggcgagaguugaagugcgguuccgggaucuucgugguagauaacgugcacaccuggaccgaacaguacaaguuccaacccgaaucccccgcccguuuggccagugccauccugaacgcccacaaagacggagugugcgggauccgcuccaccacgagauuggaaaacguuauguggaagcagaucacgaacgagcugaauuacguucugugggaagggggccacgaccuaaccguggucgcgggcgacgugaagggcguucuaaccaaagguaagcgcgccuuaaccccgccaguaagcgaccucaaguacuccuggaagaccugggguaaagccaagaucuucacccccgaggcccggaacagcaccuucuugauagacgggcccgacacguccgagugcccgaacgagaggcgugcguggaacagccuggagguugaggauuauggcuucgggauguuuacuaccaacauauggaugaaguucagagagggcuccagcgaagugugcgaccaccgccucaugagcgcggccaucaaggaccagaaggccguucacgccgacaugggcuauuggauagaaagcaguaagaaccagacauggcagaucgagaaggccagccugaucgaagugaagaccugccuguggcccaagacccacaccuuaugguccaauggggugcuggagagccagaugcugaucccgaaauccuacgccgggcccuucagccaacacaacuacagacagggguacgccacucagaccgucgggccguggcaccucgggaaacuggagaucgacuucggcgagugccccgggacaaccgugaccauacaggaggacugcgaccaccggggacccucucugcgcaccacuacagcuuccggcaagcuggugacgcaguggugcugccgcaguugcacaaugccgccccuuagguuucuuggcgaagacggcugcugguacgggauggaaauccgcccccugaacgagaaggaggaaaacauggugaaaucccaggugacggccggccagggaacaagcgaaaccuucaguauggggcugcuuugccuuacgcuguucgucgaggaaugccugcggcgccgggugacucgcaagcacaugauccucguggucgugauaacccugugcgcgaucauccuugguggacucaccuggauggacuuacugcgugcccucaucaugcugggcgacaccaugagcggucggaucgggggccagauacauuuagcaauuauggcuguguucaagaugucccccggcuacguccucggcguguuccugcggaaguugacgagccgagagacugcucuuauggucauagggauggccaugaccacagucuugucaaucccgcacgaccuaauggagcucaucgacggcauaagccugggccugauccuccugaagaucgugacacaguucgacaacacacagguggguacucuggcacucucguuaacguucauccggagcacgaugccacuagucauggccuggcgcacuaucauggccgugcuuuucgucguaacccuuaucccccugugccggaccuccugccuccagaaacagagccacuggguggagaucacggcccucauccugggcgcgcaggcgcugcccguguaccugaugacacucaugaagggggccaguaggagaagcuggccgcucaacgaaggaauuauggccguuggucucgugucucugcucggcagcgcacugcugaagaaugacgugccccucgccggccccaugguggcugggggacugcugcucgccgccuacgugaugagcgggagcagcgccgaccuaucccuggaaaaggccgcuaacgugcagugggacgaaauggccgacaucaccggaagcagccccauaaucgaggucaaacaggacgaggacgggucauucuccaucagagacguggaggagaccaauaugauuacgcuacuggugaaguuagcccugaucaccgucucuggccuuuauccacuugcgaucccugugaccaugacccucugguacauguggcaagugaagacccagcggucgggggccuuaugggacguuccgagcccggccgccacacagaaggcugcccugucagaggguguguaucguaucaugcagcggggccucuucgggaaaacccaggugggcguugggauccacauggagggaguguuccacaccauguggcacgugacgcgcggcagcgucaucugccacgagacgggucggcuggagccgagcugggccgacgugcgcaacgacaugaucagcuacggcgguggguggcgauuaggcgacaagugggacaaagaggaggacguccagguccuagccauugaaccgggcaagaaccccaagcacgugcagacuaagcccggucuguucaagacacugacaggggaaauaggcgccgugacacuggauuuuaagccgggaaccuccggcagccccaucauaaauagaaagggcaaggucaucgggcuguacggaaaugggguggugacaaagucaggcgacuacguaagcgcaauuacccaggcggagagaaucggggagccggacuacgagguggacgaagacauauucagaaagaagcgccuuacuauaauggacuugcacccgggagcuggcaagacaaagcggauccugccuuccauugugcgugaggcucucaagagacgccuccggacgcuuauccucgccccuacucgcgucguggcggcagagauggaagaagcucugcgaggacuacccauucgcuaccagacaccagcagugaagagcgagcacaccggacgggagaucgucgaccugaugugccacgccacauucacgacgcgccuacucuccucgacccggguacccaacuacaaccugaucgucauggacgaggcgcacuucaccgaccccagcuccguggccgcccgaggguacaucucaacccggguggagaugggcgaggccgcugcaaucuucaugacugccacccccccaggggcgacggacccguuuccccaguccaacagcccuauugaggacaucgagcgcgagaucccggagcggaguuggaacacaggcuucgacuggaucacagacuaucagggcaagacgguuugguucgugccaagcaucaaggcggggaacgacauugcgaauuguuuacgcaaauccggcaagaaggugauccaauuaagucgcaagaccuucgacaccgaguaccccaaaacgaagcugacagauugggacuucgucgucacgaccgauaucagcgagaugggggcgaauuuccgggcuggacgcgugaucgacccccgccguuguuuaaagccggucauccucacggacgggcccgagcgggucauccuggccggccccauaccugugacccccgccagcgcggcucagcgccggggccguaucggucguaaccccgcccaggaagaugaccaauaugucuuuucgggcgacccccugaagaacgacgaggaccacgcacacuggaccgaggccaagaugcuauuggacaacaucuacacccccgaggggaucauccccacacuguucgggcccgagcgagagaaaacucaggcgaucgacggcgaguucaggcugcgcggagaacaacggaagaccuucguugagcugaugcguagaggagauuugccgguguggcucucguacaaagucgccuccgccgggaucagcuacaaagaccgggaguggugcuucaccggcgagcgcaacaaccagauacucgaagaaaacauggagguggagaucuggacgcgcgagggggagaagaagaagcugcggccccggugguuagacgcacggguguaugccgacccgauggcgcugaaggacuucaaggaauucgcuuccggcaggaagagcaucacccuggacauccucaccgagaucgccucgcugcccaccuaccugagcucccgcgcaaaguuagcccuggauaacauagucaugcugcauaccacggagcggggcgggcgcgcguaccagcaugccuuaaacgagcugccagagucccuggagaccuugaugcugguggcccucuuaggcgccaugaccgcggguaucuucuuguucuucaugcagggcaaggggauugguaaacugucaaugggccuaauugccaucgccguagccagugggcugcugugggucgccgaaauccagccgcaguggaucgcggccagcaucauccuagaguuuuuccugauggugcugcugauacccgagccggagaagcagcggaccccccaggacaaccagcuuaucuacgugauucugacaauccucacaauaauuggucugaucgccgccaacgagaugggccuuauugagaaaaccaagaccgacuucggcuucuaccaagucaagacugaaaccaccauccucgacguggaccugcgcccagccucagcauggacccuguacgccguggccacgaccauucucacacccauguuacggcacaccaucgagaacacguccgcaaaccugucgcuggccgccauagccaaccaggccgccguccuaauggguuuaggcaagggauggccacuccaccgcauggaucuggggguuccccugcucgcaauggguugcuacucgcaggugaacccgaccacacugacugcgucgcuggucaugcucuugguucacuaugccaucauugggccaggccugcaggccaaggcuacgcgggaagcacagaagaggacggcagccggcauuaugaaaaaucccaccguggaugggaucaccgugaucgaccuagagcccaucagcuacgacccgaaguucgagaagcaacugggccaagugaugcugcuugugcugugcgcggggcaguuacuccucaugcggacgacaugggccuucugcgagguacugaccuuagcgaccggccccacguuaacauugugggaggguaacccaggccgcuucuggaacacaaccaucgcggugucgacggcgaacauuuucagggguucguacuuggccggggcaggccuagcguucucccugaucaagaacgcccagaccccccgccgggggacaggcacuacgggcgagacccuuggcgagaaguggaaaaggcaguuaaacagcuuagaccggaaagaauucgaggaauacaagcgauccggcauccucgagguugaccggaccgaggcaaaaagcgcccugaaggauggguccaagaccaagcaugcugucagccgcggguccagcaagauccgguggaucguggagcgcggaauggugaagccgaaaggcaaggucguggaccuggguugcggccggggcggcuggucguauuacauggcaacccucaagaaugugacggaagucaagggauacaccaaggggggccccggucaugaggagccuauacccauggcgaccuacggcuggaaccugguuaagcuacacagcggcguggacgucuucuacaagccaacagagcagguggacacgcuccugugcgacaucggugaaagcucaagcaaccccaccaucgaggagggccggacuuugcgcgugcucaagauggucgaacccuggcuguccaguaagcccgaguucugcaucaaggugcugaaccccuauaugcccaccgucaucgaagaauuagagaagcuccagcgcaagcacgggggcaaccuggugcgcuguccgcugucccgaaacagcacgcacgagauguauuggguguccggcgccagcgguaacaucguuuccagcgugaacaccaccuccaagaugcuccucaaccguuucaccacccggcaccguaagccuaccuacgagaaggacguggacuugggcgcggguacccggucgguauccaccgagacagagaagccugauaugaccaucaucggacgcaggcuccaacgacugcaggaagagcauaaggagaccuggcacuaugaccaggaaaaccccuaucggaccugggcuuaccacgggucguacgaggccccauccacaggcuccgccuccuccauggucaacggcguugucaagcugcucacgaagccgugggauguuauccccauggugacccaguuagcaaugacugacacgacuccguucgggcagcagcgagucuucaaggaaaagguggacacgcggaccccacagccgaagccaggcacgcgcaugaucaugaccacaaccgccaacuggcuaugggcgcugcuggguaagaagaagaacccccgguugugcacgcgcgaggaguuuaucuccaaggugcggagcaacgcugccaucggggcggucuuccaggaggagcagggguggaccagcgcuuccgaagcuguaaacgacagccgcuucugggagcucguggacaaggagcgggcacugcaccaggagggcaagugcgaaagcugcgucuauaacaugaugggcaaacgcgagaaaaaguuaggggaguucggaagagcaaaaggguccagagcuaucugguacauguggcucggcgcgcgcuuucuggaguucgaggcguuaggguuccucaacgaagaccacugguucgggcgugagaacucuuggagcggcguugaaggggaggguuuacaccggcugggguacauccucgaagagaucgauaagaaggacggggaccuaauguacgccgacgacaccgccggcugggacacacggaucacggaggacgaccuacagaacgaagagcucauuaccgagcagauggcgccccaucacaagauccuggcgaaggccauuuucaaacuuaccuaccaaaauaaagucgucaaagugcucaggccuacccccagaggggcaguuauggauaucaucucccgcaaagaccagaggggcagcgggcaggucggaaccuacgggcuaaauacguucaccaacauggagguccagcugauccgucagauggaggcugagggcgugauaacccaggacgacaugcagaaccccaagggccucaaggagcgggucgagaaauggcugcgcgagugcgggguagaccggcugaaaagaauggccaucucuggcgacgacugcguggugaagccacucgacgagagauucggcaccucauugcuguuccucaacgacaugggcaaagugcgcaaggacaucccacagugggagccuuccaaaggguggaagaacuggcaggaggugcccuucugcucccaucacuuccauaagauauucaugaaggacggccgaucccuggucgugcccugucgcaaccaagaugagcuuaucggacgggcgcgcaucucacagggagccggcuggucccuacgcgaaacggccugccuggguaaggcauacgcccagauguggagccugauguauuuccaccgucgcgaucuccggcuggcguccauggccauuugcagcgcagugcccaccgaaugguuucccacgagccgcaccaccuggucgauccaugcccaccaucaguggaugaccacggaagacaugcugaagguguggaaucggguauggaucgaggacaaccccaacaugaccgacaagacgcccauccacucaugggaggacaucccuuacuuagggaagagagaggaccuguggugugggucccugaucggcuugucuagccgggcuacaugggcaaagaauauacacacggccaucacccaaguccgcaaccugauaggcaaggaggaguauguggauuacaugcccgugaugaagcgguacagcgccccuuccgagucggagggugugcuguga

SEQ ID NO: 26248 - RNA, 9867 nt, Artificial Sequence
  derived and/or modified CDS sequence (opt11) from DENV-4__GQ199881__SS-prME
uccaccauaacccugcucugccugauccccacgguaauggccuuccaccuuuccacccgagacggugaaccgcucaugaucgucgcgaagcaugaaagagguagaccccugcuguucaagacaaccgaggggaucaacaaauguacgcugaucgcgauggauuuaggugagaugugugaggacaccgugaccuacaaaugcccccugcucgugaacaccgaacccgaagacauugacugcuggugcaaccugaccagcacauggguuauguacgguacguguacccaguccggggagcgucgccgcgagaagcgcagcguggcauugacgccacacuccgguaugggccucgagacgcgggcagaaaccuggaugagcuccgagggagccuggaagcacgcccagcgcguggaauccuggauccuaaggaacccaggcuucgcucugcuggcuggguucauggccuacaugauaggccagacccgaauccagaggacggucuucuuugugcugaugauguuagucgcccccuccuauggcaugcgcugugucgggguaggcaaucgggacuucguugaaggggugagcggcggugcguggguggaccucgugcuggagcauggcggcugcguaaccacuauggcccagggaaagccaacccuagacuucgaguugacgaaaacgaccgccaaggagguugcgcuucugcgcaccuacugcauugaagccuccaucucgaauauuacgacugcgacccggugccccacccaaggugagccauaccucaaagaggaacaggaccaacaguacaucugccgcagagacguugucgauaggggcuggggcaacgguugcggucuauucggcaaggggggggucgugacgugcgcaaaguucagcuguucagggaagaucaccggcaaccuaguccagaucgagaaccucgaguacaccguggucgucaccgugcacaacggggacacacacgcggucgguaaugacaccagcaaccacggggugacagcuacaaucacgccacggagccccuccgucgaggugaagcugccugauuacggagagcugacacuggacugcgagccacgcaguggcaucgacuucaacgaaaugauccugaugaagaugaagaagaagacuuggcucgugcauaaacaaugguuccucgaccugccauuaccauggaccgcgggggcggacaccucagaagugcauuggaacuacaaggagcggaugguaaccuucaaagugccgcacgccaagcgccaggacgucaccguccuaggaagccaggaaggcgccaugcacagcgcgcuggccggugcuaccgaaguagacucgggcgacgggaaccacauguucgccggccaccugaaauguaaggugcgcauggagaaguugcggaucaaggguaugagcuacaccaugugcuccgggaaauucucaauugacaaggagauggcggagacgcagcacggcaccaccguaguuaaggugaaguaugagggcgccggcgcucccugcaagguccccaucgaaauucgggacguuaacaaagaaaaggugguggggcgugugaucucuucuaccccccuagccgagaacacgaacuccgugacaaacauagagcuggagccgcccuucggagacagcuauauagucaucgguguuggcaacuccgcccucacccugcacugguuucgcaaaggcagcagcaucgguaagauguucgagucgaccuaccggggcgcgaagcgaauggcuauacugggggagacggcgugggacuucggcucggugggcggccuguucaccagccugggcaaggcaguccaucagguguucggcucgguguacacaaccauguucgguggggucaguuggaugauacggauacugaucggguuucucguguuauggaucggcacgaacucccggaacacuagcauggcaaugacgugcaucgcagucggugguauaacccuauuccugggguucaccguccaggcggacaugggcuguguggugucaugguccgggcgggagcuaaaauguggcagcgggaucuucgucguugauaacgugcacaccuggacggagcaauacaaguuccagcccgaauccccugcgcgcuuagccagcgcgaucuugaacgcccacaaagacggugucugcggcauccgauccaccacgcgacucgagaauguaauguggaaacagaucacaaacgagcugaauuauguuuuaugggaagggggccacgaucucaccgucguggccggagacgugaagggcguguuaaccaagggcaagcgggcccugacgccgcccgugagcgaucucaaguacaguuggaaaacaugggggaaggcgaagauauucacacccgaagcgagaaauuccacauuccugauagacgggccugacacguccgagugcccgaacgagcggcgagcguggaacagucuggaaguggaggacuauggcuucgguauguucaccacuaacaucuggaugaaguuuagagagggauccucggaggucugcgaucaucgccucauguccgcagcgauaaaggaccagaaggcgguccacgcggacaugggcuacuggaucgagagcuccaagaaccagaccuggcaaaucgaaaaggcuucgcuuauagaggugaaaacaugucuuuggccaaagacccauacccugugguccaauggcguccucgagagccaaaugcugauacccaaguccuacgcgggcccuuucagccagcacaacuaucggcaaggcuacgcuacccagacggucgggccauggcaccuggguaaacuggagaucgauuucggcgagugucccggcacuacagugaccauacaggaggauugcgaccaucgagguccgagccugcguacuaccaccgcauccgguaagcuugucacacaguggugcugccguucgugcacgaugcccccccugagauuccucggcgaagacgggugcugguacgggauggagauccggccucucucugagaaggaagagaacaugguaaagucccagguagccgcggggcaggguacauccgagacuuucuuuauggguuuacuuugucuaaccuuauucguggaggagugccuaaggcgacgagugacccggaaacauaugauccucgcggucguuauuacgcugugcgccauaauacuggguggguuaaccuggauggauuugcugcgcgcccucaucaugcugggggacaccaugucagggcgaauagggggccagacccaccuggccaucauggccguguucaagaugagcccuggcuacguacuaggaguguuccugcgcaagcugacgucucgggagacggcgcucauggugauaggcauggcgaugacaaccacgcuguccaucccgcaugacuuaauggaacucaucgacggaaucagccuaggccugauacucuuaaagaucgucacucaguuugacaacacgcaagucggcaccuuggcccucagcuuaacguucauaagaagcaccaugucccugguuauggccuggaggacgaucauggcgguucucuuuguggugacccucauuccacugugucgcacgucuugucuccagaagcagucccauugggucgagauaacugcgcuaauccugggggcccaagccuuacccguauaccugaugacccugaugaaaggcgccagcaggcgaucuuggcccuuaaaugaggggaugauggcaguggggcuggugagccuucucggcuccgcuuuguugaagaacgacgugccccuugcgggcccgaugguggccggaggguuauugcucgcggccuaugugaugagcgggagcuccgcagaccugagccuugagaaagccgcuaauguacagugggaugagauggccgacaucaccgggucguccccaauaaucgaggugaagcaggacgaagacggguccuucucaauucgcgauguugaggagaccaauaugaucacccucuuggugaagcuggcucuaaucaccguuuccggacuguacccccucgcgaucccggucacuaugacgcucugguauauguggcaggugaaaacccaacgcucaggcgcccugugggacguccccucccccgccgcaacccaaaaagccgcucucuccgaggggguauaccgcaucaugcagcgugggcucuuuggcaagacccagguuggugugggcauccacauggagggggucuuucacacgauguggcaugugacgcggggcucgguaaucugccacgagaccggccguuuggaaccuagcugggcggacgugcgaaacgauaugauaucuuacggaggcggguggcggcugggcgacaagugggacaaggaggaagacguacaaguacucgccaucgagcccggaaaaaauccuaagcaugugcagaccaagccaggccucuucaaaacccugacgggcgaaauaggggcugugacccucgacuuuaagcccgggagcuccgggagccccaucauaaauagaaaagggaaagucauugguuuguacgggaacggcgucguuacaaagucgggggacuacgugucagcgaucacgcaggcugagcgaaucggcgagcccgacuacgaggucgacgaggacauuuuccgcaagaaacggcugacgaucauggaccuccaccccggggcuggcaagaccaaacggaucuuaccguccaucguccgggaagcccugaagcgacggcugcgcacccuaauccuggcccccacccgcguuguugccgccgagauggaggaggcauugcgagggcucccaauacgguaccaaacgcccgccgugaagagcgaacacacagguagagaaaucguggaccuaaugugccacgcgacauucaccacaagacugcucagcucaaccagggucccgaacuacaaccugaucguuauggacgaggcgcacuucacugacccaagcuccguugccgcuaggggcuacaucagcacccgcgucgagaugggggaagcagcggccaucuucaugacagccaccccucccggcgccacggacccuuucccgcagaguaacagcccgauugaggacaucgagcgggagauaccagaacgcuccuggaacaccggauucgacuggaucacggauuaucagggcaaaacggugugguucgugccgucgauuaaggcaggcaacgauaucgcgaacugccugcgcaagucugguaaaaagguaauccaauuaagccguaagaccuucgauaccgaauacccuaagacgaaguuaaccgauugggacuuuguugucaccacggacaucucggagaugggcgccaacuuccgcgccgggcgggugauugaccccagacggugucucaagccugugauccucacggacgguccggaacgggucauccuggccgggcccauccccguuaccccagcgagcgccgcgcagcggcgcggacggaucggccgcaacccugcccaagaagacgaccaguacguauuuuccggagaccccuugaagaacgacgaggaccacgcacauuggaccgaagcgaagaugcuccuggacaacauauacacccccgagggcaucauuccgacgcuauucgguccggagcgggaaaagacccaagccauagacggugaauuuagguuacggggcgagcagcgaaaaacguuugucgagcuaaugcgucgcggggaccugcccgucugguugucauacaaaguggccucagccggcaucaguuacaaagaucgcgaguggugcuucaccggugagcgcaauaaucagauccuggaggaaaauauggaggucgagaucuggacgcgugagggcgagaaaaagaaacugcgcccccgguggcucgacgcccgcguguacgcggacccaauggcgcucaaggacuucaaggaguucgccucgggcagaaagucuaucacccucgacauacucacggagaucgcgucacugccuacuuaccugucgucucgggcaaagcucgcguuggacaacauuguuauguuacacacuacggagcgcgguggccgcgcguaccagcacgcccucaacgaacuucccgaaucacuggagacccuuaugcuggucgcgcugcucggggcgaugaccgccggcauauucuuguucuuuaugcaggggaaagguaucgggaaguuaucaaugggccuuaucaccauagccguggcauccgggcuguuguggguggccgaaauucagccucaauggauagcagcuucgauuauuuuagaguucuuccugaugguccugcucaucccggagccggaaaagcagcgaacuccgcaagauaaccagcugauuuacgugauccuggcuauacuaaccauuauuggccugaucgccgccaacgagauggguuugaucgagaagaccaagaccgacuucggcuuuuaccaggugaaaaccgagacuaccauccuugaugucgaucugcguccggcauccgccuggacauuauacgccguagcgacaacaauucucacaccgaugcugcgacacacaauugagaacacaagugcgaacuuaucccucgcugccauugcaaaccaggccgccgugcugauggggcuggggaaaggcuggccccuccaccggauggaccugggagugccccugcuggcaaugggaugcuauagccagguaaaccccaccacauuaacugccucccuggugaugcugcugguccauuaugcgaucauaggcccggggcugcaggccaaggcaacgcgagaggcccagaaacggacagcagccggcauuaugaagaacccuacuguagaugggaucaccgugaucgaccucgagccaauaagcuacgacccgaaguucgagaagcagcugggacaagugaugcuucucguacugugcgcuggccagcuguugcuuaugcgcacgacaugggcguucugcgagguacugacacucgccaccgggccgauccugacgcuaugggagggaaaccccggccgguucuggaauaccacuauagccguauccacugcuaacaucuuccguggcucguaccucgcuggugcgggacuggcguuuucgcuaauuaagaacgcccaaacuccccggcgagguacggggacuaccggcgagacauugggggaaaaauggaagcgucagcugaacucgcuugaccgcaaggaauucgaggaguacaagcggucagguauucucgaggucgaccguacugaggccaaaagcgcucucaaggacggcagcaaaaucaaacacgcugugucaagaggguccucuaagauccgcuggaucguugagcgcgggauggugaagccaaaggggaaggucgucgauuuggggugcgggcgcggcggcuggagcuauuacauggccacucucaagaacgucacugaaguuaagggguacacgaagggcgggcccggacacgaggaacccauucccauggccacguacggauggaaccucgucaagcugcacuccggcguggacguguucuacaagcccacagaacaggucgacacgcuccugugugacauuggggaaucguccucaaauccaaccauagaggagggccgaacucugagaguucugaaaaugguggagcccuggcugaguagcaaacccgaauuuugcaucaagguccuuaaccccuacaugccuaccgugauugaagagcuggagaaacuccaacggaagcauggcgggaaccugguccggugcccccugucucggaacuccacucacgaaauguauuggguauccggggcuagcggaaauaucguuuccagcguuaacacgacuaguaagaugcuuuugaaccguuucaccacccgccaccggaaaccgacuuacgaaaaggauguagaccuuggggcgggaacucgcucugucaguaccgagaccgaaaagcccgacaugaccauaaucgggcggcgccuacagcgcuugcaggaggagcauaaagagaccuggcauuacgaccaagaaaacccauaccguacgugggcauaccacggcagcuacgaggcccccaguacugggagcgcuucaagcauggucaacggcguggugaaauuacucaccaagcccugggacgugaucccgauggucacgcagcuggcuaugaccgauacaacacccuucggucagcaaagaguauucaaggagaaagucgauacgcgcaccccacagccuaaaccgggaacccgaauggucaugaccacgaccgcgaacuggcugugggcccuccugggaaagaagaagaacccccgccugugcaccagagaagaguucauuagcaaaguucgcucuaacgccgccauaggagcgguauuccaggaggagcagggcuggaccagcgccucggaggccgugaaugacagcagguucugggaguuaguggacaaagagcgcgcacuccaucaagaggggaagugcgagucuugcguuuauaauaugaugggcaagcgcgagaaaaagcugggcgaguucggacgggcgaaagggagccgcgccauaugguacauguggcucggugcgcgguuuuuggaauucgaggcgcugggguuccuaaacgaggaccauugguucggccgggagaacuccuggaguggggucgagggcgagggucugcaccgccuuggcuauauacucgaggagaucgacaaaaaggauggugacuugauguaugcugaugacacugcaggaugggauacccgcaucacagaggacgaccuucaaaacgaggagcucauaaccgagcagauggcuccccaucacaagauccuggccaaggcuaucuucaagcugacguaccagaacaagguggucaagguauugcggcccacaccuagaggcgcuguaauggauaucaucucucgaaaggaucagcgcggaagcggccaggucgguaccuacggguugaauaccuuuaccaacauggagguacagcugauccggcaaauggaggcggagggagugaucacucaagaugacaugcagaaccccaagggccucaaagaacgagucgagaaauggcugcgggaaugcggcguggaccgccucaagcggauggccauaucgggcgacgacugcguggucaagccccucgaugagcgauucggaaccaguuugcuguuccucaacgacaugggaaaggugcggaaagacauuccgcaaugggagcccuccaaaggcuggaaaaacuggcaagaaguacccuuuugcagccaccacuuccacaagaucuucaugaaggauggacgaucccugguagugcccugucggaaccaggacgagcuaaucggccgcgcccgcaucagccagggcgcuggguggucacuccgggagaccgccugccugggcaaggcauacgcccagauguggucccugauguacuuucacaggcgagaccuccguuuggcgucgauggccaucuguagugcagugcccaccgagugguucccgaccucccggacgaccugguccauacacgcacaccaccaguggaugaccacggaggacaugcugaaaguuuggaaucgcguuuggaucgaagauaacccgaacaugauagacaagacccccguacacaguugggaggacauccccuaccuuggaaagagggaagaccugugguguggauccuugauuggacucucaucccgcgcgacaugggcgaagaauauucacaccgcaauaacccagguccggaaccucaucggcaaggaggaguacguagacuacaugccggugaugaaaagauacagcgcgccaagcgagagcgagggcguccuuuga

SEQ ID NO: 26249 - RNA, 9867 nt, Artificial Sequence
  derived and/or modified CDS sequence (opt11) from DENV-4__GQ199882__SS-prME
ucaaccaucacuuuacucugucugauccccacgguuauggcuuuccaccuguccacccgcgacggggaaccccucaugauagucgccaaacacgagcgggggcgcccccucuuauucaaaaccaccgaaggcaucaacaaaugcacgcucaucgcgauggaccuuggagagaugugcgaggauaccgugacguauaagugcccgcugcuaguuaacaccgaaccggaggacauugacuguuggugcaaccugacgucaaccugggucauguauggaaccugcacacagucuggggaacggcggcgcgagaagcgcagcguagcccugacgccucauuccggcaugggccucgagaccagggccgagaccuggaugagcuccgaaggggcuuggaagcacgcccagcgcguggagagcuggauccugcggaaucccggcuucgcgcugcucgccggauucauggccuauaugaucggccagaccgggauacagcgcacgguauucuuugugcugaugauguuggucgcgccgagcuacggcaugcggugcgucggcguagggaaccgcgacuuuguggaaggcgucagcgguggugcguggguggaccucgugcuugaacacggcgggugcguaaccaccauggcccaggggaaacccaccuuagacuucgagcucacuaagacgacagccaaagagguagcucugcuucggaccuacugcaucgaggccuccaucagcaacaucacaaccgcaacucgaugcccgacccaaggggagccauauuuaaaggaggaacaggaucaacaauacaucugcaggagagacguagucgaccgggggugggggaacggcugcggccuguuugggaagggcgggguugugacuugugccaaauucucuugcagcggcaagauuacggggaaccugguccagaucgaaaaccucgaguauaccgucguggucaccguccacaacggcgacacgcaugccgucggcaacgacaccuccaaccacggggucacagccaccaucacgccccgaagccccuccguggaagugaagcugccugauuacggcgaguugacccuggacugcgaaccacggagugggauugacuucaacgagaugauucugaugaagaugaagaagaaaaccuggcuggugcacaagcaaugguuucucgacuugccacuucccuggaccgccggcgccgauaccuccgaaguccacuggaacuacaaagagcgcauggucacguucaaagugccgcacgccaagcggcaggaugugacggugcuaggaagccaagagggcgcgaugcauagugcacuggccggggcgaccgaggucgauuccggggacgguaaccacauguucgccggccacuuaaagugcaagguccgcauggagaaacugcgcaucaaggguaugagcuauacgauguguucgggaaaguucagcaucgacaaggagauggcggagacgcagcaugggacaaccguagugaagguuaaguaugaaggcgcaggggcgcccugcaagguuccaauugagauccgggacgugaacaaggaaaaaguggucggccgugugaucuccagcacaccccuggcggagaacacgaacucggugaccaacauugagcuagaaccaccuuuuggggacagcuacauagucaucggcgugggcaacucugcgcucaccuugcauugguuccggaaagggaguucgaucggaaagauguucgaaucuacuuaccggggcgccaagcggauggcuauacugggggaaacggcaugggacuucggguccgugggcggccucuuuaccucgcucgggaaggccgugcaccagguguucggcuccguguacaccaccauguucgggggugucucguggaugauacgcauucugaucggauuucucguguuauggaucggcacuaacucccggaauaccaguauggcaaugacaugcaucgcgguagggggcaucacccucuuccugggcuucaccgugcaggccgauaugggaugcguggucuccuggucuggccgcgaacucaaaugcgggagcggcaucuuuguugucgacaacgugcauaccuggaccgagcaauacaaguuucagcccgagaguccggcgcgguuagccucagccauucugaacgcgcauaaggaugguguuugcggcauccgcuccacgacuaggcucgagaacgugauguggaagcaaaucaccaacgaguugaacuacguucugugggaaggcgggcacgacuugacagucguggccggggacgugaaaggcguccugacgaaggggaagcgggcgcugacuccucccgugucggaccucaaauacuccuggaagacuuggggcaaagcaaagaucuucacuccggaggcacgaaacagcaccuuccugaucgaugggcccgacacguccgagugcccgaacgaacgccgggccuggaacucucuggagguggaagacuacgguuucggaauguucaccaccaacauuuggaugaaguuccgcgagggguccagcgaggucugcgaccaucggcuaauguccgccgcuauaaaggaucagaaggcggugcacgccgacauggguuacuggauugagagcucgaagaaccaaaccuggcagaucgagaaggccagccugaucgagguuaagacaugccuguggccaaagacccacacccuguggucaaacggggugcuggagagccagaugcuuauuccaaaguccuacgcgggcccguucagccaacacaauuaccgccaagguuaugcaacccagacaguuggcccuuggcaccucgguaagcuggagaucgauuucggggagugcccuggcacaaccgucaccauccaggaggacugcgaccaccgggggcccagccuucgcaccacgaccgccagcggcaagcucgucacccaaugguguugcaggaguuguaccaugccgccccuccgguucuugggggaggacggcugcugguacgguauggaaauccgcccccuauccgagaaggaggaaaacauggugaagucccaggucgcggcgggccagggcacguccgagacguucagcaugggucugcugugucucacacuguucguugaggagugccugcggcgcagagugacccgcaagcacaugauccuagcggucgugaucacgcugugcgcgauuauccugggcgggcucaccuggauggacuugcugcgggcccugaucaugcugggggauacuaugucgggccggauagggggccagacacaccuggcuaucauggccgucuuuaaaaugucccccggauacguccucggcguguuucugcggaagcugacgucccgcgagacagcgcucauggugaucgguauggcaaugaccaccaccuuaagcaucccgcacgaccuuauggaacugaucgacgggaucucccuaggccucaucuugcugaagauagucacccaguucgacaauacacagguugggacccuggcccucagccuuacguucauccgguccaccaugucauuagugauggccuggcgaacaaucauggccguccucuucgugguaacauugaucccacuaugccggaccagcugccuccagaaacaaagccacugggucgaaaucaccgcgcuaauacugggcgcacaggcccuuccaguuuacuugaugacgcugaugaagggggccagcagacggucguggccccucaaugaggggauuauggcggugggacugguuucccuccucgguuccgccuuacuuaagaacgacgucccgcuggcaggccccaugguggccgguggccugcuccucgcugccuaugucaugucugggagcagugccgauuugucccuggagaaggcugcuaacguucagugggaugagauggccgacauaaccggaagcucacccauaaucgaaguuaagcaggacgaggacggcagcuucuccauccgcgacgucgaggagacgaacaugaucacgcuccuggucaagcuggcucucauaaccguuucaggccuguauccccucgccaucccagucacaaugacgcucugguacauguggcaagugaagacccagcgguccggcgcccuuugggacguccccagccccgccgcaacacagaaggcggcccuaucugaggggguauaccgaaucaugcagcggggucucuucgggaagacacaggugggcgucggaauacacauggagggcguauuccauaccauguggcacgugacgcgcggcagcgugaucugccaugagacgggcagacuugaaccauccugggcggauguccgcaaugacaugaucagcuauggcgggggcuggaggcuaggcgacaaaugggacaaggaggaggacgugcaaguacucgcgaucgaaccggguaaaaaccccaagcauguccaaaccaagcccggacuguuuaaaacauugacuggggagaucggcgcuguaacgcucgacuucaaacccgguaccucgggcucaccgauuauuaaccggaaggguaaggugaucgggcuguacgguaauggugucgugacaaaguccggggacuaugucucggcgaucacucaggccgagcgcaucggggagcccgacuacgaggucgacgaggacauuuuccggaagaagcgccuuaccaucauggaccuacacccaggcgccggcaagaccaagcgaauccugcccucaaucguucgagaggccuuaaagcggcgccugcgcacccucauccuggcgccaacuaggguagucgccgcugagauggaggaggcccugaggggccucccaauccgcuaccagacuccggccgugaaaagcgagcacacuggccgggagauuguagaccucaugugccacgcgacguucacgacccgucugcucucgucgacccggguaccgaauuacaaucugauugugauggacgaggcgcacuucacagaccccagcucugucgccgcacggggguacauaagcacgcgggucgagaugggcgaggccgccgccaucuucaugaccgccaccccaccuggugccaccgaucccuucccccaguccaacucccccauagaggacaucgagcgugagaucccugagcguuccuggaauacuggcuuugacuggaucacggacuaccagggcaagaccgugugguucgucccgucaaucaaggccgggaaugacaucgcuaacugucuucgcaaaaguggcaagaaagugauccagcucucucgcaaaaccuucgacacggaauauccuaagaccaagcuaaccgacugggauuuuguggucaccaccgacaucuccgaaaugggcgccaacuuccgggccggccggguuauagacccgcgacgcugcuuaaagcccgugauccucaccgacgggagcgagcgggucauacucgcaggcccgauccccgugaccccagcgucggccgcccagcgccggggccgaaucgggcgaaacccugcccaagaagacgaccaauacguauucagcggggacccuuugaagaacgaugaggaccaugcccacuggaccgaggcgaaaaugcuucuggacaacaucuauacgcccgaggggaucauccccacgcuguucggaccggagcgcgagaaaacccaagcuaucgauggugaauuuagacugcgcggagagcaacgaaaaaccuucgucgaacugaugcgcagaggugaccugccgguuuggcucuccuacaaggucgccagcgcggggauuuccuauaaggaccgggagugguguuucacaggcgagcguaauaaucagauauuagaggaaaauauggaaguugagauauggacgcgggaaggggagaagaagaagcuaagaccccguuggcucgacgcucgggucuacgcugaccccauggccuuaaaggacuucaaggaguucgcgaguggccgcaagucuauaacccuggauauuuuaaccgagaucgccucacugcccacuuaccuuagcagccgcgcgaaauuagcguuggacaacaucguaaugcugcacacgaccgagcgcggagggcgcgcguaccagcacgcccugaacgagcucccugaaagccuggagacucucaugcugguagcccugcucggcgcaaugaccgccggcaucuuuuuguucuuuaugcaaggcaaggggaucggcaaacuguccaugggccucaucacgauagccguagccagcggucuguuauggguggccgagauccaaccccaguggaucgcggcgaguauaaucuuagaguucuuucuuaugguccugcucaucccggaaccggaaaagcagcggacuccccaagacaaccagcugaucuacgugaucuugacaauccucaccaucauuggccugauagcugccaacgagauggggcucauagagaagacgaagaccgacuucggcuucuaccaggugaagacugagacaacgauuuuggacgucgaccuucgacccgcgucggcuuggacccuauacgcuguugccacuaccaucuugacgcccaugcugcggcacaccauugagaacaccuccgccaaccuaucgcucgcggcgaucgcgaaccaggccgcugugcuuaugggccuaggcaagggcuggccgcuccaccgcauggaccuggggguucccuugcucgccaugggcugcuauagucaggugaauccgaccacgcugaccgcgagucugguaaugcuucugguccacuacgccaucauugggccgggccugcaggccaaggccacccgggaggcccagaagcggaccgcugcgggcaucaugaagaacccaacuguggacgggaucaccguuauagauuuggagcccaucucguacgaccccaaguucgagaagcaauuaggccaaguuaugcugcucgugcugugcgcagggcaacugcuccugaugcggaccaccugggccuucugugagguccugacguuggcuacaggucccauccugacccuuugggaagggaauccuggccgauucuggaauaccacgauugcagucagcacagccaacaucuuccggggcuccuaccucgccggugcaggcuuggcauucucucugaucaagaaugcacagaccccucgccgggggaccggcacgaccggggagacccucggggagaaauggaaacgacaguuaaacucucuggaccggaaggaguucgaagaguauaagagaagcgggauccucgagguugacaggacugaggccaaguccgcacugaaggacggcagcaagaucaaacacgcugugucccgcggcagcagcaaaauccgguggaucgucgagagggggauggucaagccaaagggaaaggugguggaccuggggugcggccgcggcggauggucauacuacauggcuacccucaagaacgugacggaaguuaagggcuacacuaagggaggcccugggcacgaggaaccaauuccgauggcuacguacggguggaaucugguaaagcugcacagcggcguggacguguucuacaagcccaccgagcaagucgacacacuccucugcgacaucggagaguccagcucuaaccccacgauugaggagggacgcacuuuacgcgugcucaagaugguugagccguggcuuucauccaagcccgaguucugcaucaagguccugaacccguacaugcccacuguuaucgaggagcuggagaagcuccagcggaagcacggagguaaccugguccgcugcccuuugucgaggaacuccacacacgagauguacugggugagcggcgccaguggcaacaucgugucaagcguuaacaccacaagcaagaugcuccugaaucgcuucacaacgcggcaccggaagcccaccuaugagaaggacgucgaccugggcgcugggacccggucugugagcaccgagacggagaagccugacaugaccaucaucgggagacgccuucaaaggcuccaagaggaacacaaggaaaccuggcacuacgaccaggagaacccuuaccggacuugggcguaccacgggagcuacgaagccccaagcacgggcuccgccagcagcaugguaaacggagucgucaagcugcucaccaagcccugggacgugauccccauggugacucaacuggcgaugacagacacgaccccguucgggcagcaacgcguguucaaggagaagguagacacgcggacaccacagccaaagccaggcacccgcauggugaugaccaccaccgccaacugguugugggcccuccuagggaagaagaaaaauccgcgucucugcacgcgcgaggaguuuaucuccaagguaagaucuaacgccgccaucggcgcggucuuccaggaggaacagggauggacgucagccagcgaggcggugaacgacagccgcuuuugggagcucguggacaaagagcgggcccugcaccaggagggaaagugcgagagcugcgucuacaacaugaugggcaagcgcgagaagaaguuaggggaguucggccgcgccaaggggucucgggcgaucugguauauguggcucggcgcccgcuuccuggaauuugaagcgcuuggcuucuugaaugaggaccacugguucggacgagaaaacucauggucgggcguggaaggugagggccugcacagacucggguacauucucgaagagaucgacaagaaggacggcgacuuaauguaugccgaugacaccgccggcugggacacccguaucacggaggaugaccuucaaaacgaggagcucauaacggagcaaauggcaccccaccacaagauucuggcgaaagccauuuucaagcugaccuaucagaacaagguugugaagguguugcgccccaccccgagaggggccgucauggacaucaucagccgcaaagaccagcgggguucggggcaggucggaaccuacggguuaaacaccuuuaccaacauggagguacaacugauccggcagauggaagccgagggugucaucacccaggacgauaugcaaaacccuaagggccuuaaggagcgagucgaaaaauggcugcgcgaaugcgggguagaccggcugaagagaauggccaucagcggcgacgauugcguggucaaaccccucgaugagagauucggcaccagucugcuauuccucaacgacaugggcaagguucggaaagauaucccccagugggagcccucaaaaggguggaagaauuggcaggaagugccguucugcucccaccacuuccacaaaaucuucaugaaggacggacggagcuuagugguacccugcaggaaucaggaugagcuuaucggucgggcgcggaucucccaaggggcuggauggagccuccgcgagacagcuugcuuggguaaggcuuacgcccagauguggagccugauguacuuucaccguagggaccuaagauuggcgaguauggccaucugcagcgccguccccaccgagugguuucccaccaguaggaccacuuggucuauccaugcccaccaccaguggaugaccaccgaggacaugcugaaggucuggaaccgggucuggauagaggacaauccgaacaugaucgacaagaccccaguucacucgugggaggacaucccguacuuggggaaacgcgaggaucuguggugcgguagccuuaucggccucuccucacgcgcuacgugggcgaagaacauccacaccgccaucacccagguacggaaccuaaucggcaaggaggaguacguggacuacaugcccgugaugaagagguauucggccccguccgaaucagaggguguucuguga

SEQ ID NO: 26250 - RNA, 9867 nt, Artificial Sequence
  derived and/or modified CDS sequence (opt11) from DENV-4__GQ199883__SS-prME
agcacuaucacucuucucugccugauccccacgguuauggccuuccaccuguccacgcgcgacggcgagccgcucaugaucgucgccaagcacgagcgggggcgaccccugcuguuuaaaaccacagagggcaucaacaaguguacgcucaucgcgauggaccuuggggagaugugcgaggacaccgugaccuacaagugcccccuucucgucaacaccgagcccgaggacaucgacugcuggugcaaccugacgagcaccuggguaauguacggcaccugcacccagucaggggagcgacgccgggagaagcgcagcguggcccugacgccgcacagcggcaugggccucgagacccgggcggagacguggaugagcuccgaaggggccuggaagcacgcccaacgcguugaaagcuggauccugaggaaccccggcuucgcgcuccuagccggguucauggccuacaugauuggccagaccgggauccagcgcacugucuuuuuugugcugaugaugcucgucgcccccuccuacggcaugcggugcgucgggguggggaaccgggacuucguggagggcguauccgggggcgcguggguggauuuggugcuggagcacggcgggugcguuacuaccauggcccagggcaaacccaccuuagacuucgagcucacgaagaccacagccaaggagguggcccugcuacggaccuacugcaucgaggccuccaucucgaacaucacgaccgcaacucgcugcccaacccagggggagccauaccucaaggaggagcaggaccaacaguauauaugccggcgugacgugguagaccgggguugggggaacggcugcggccuauucgggaagggcggcguugugacgugcgccaaauucuccugcagcggcaaaaucaccgggaacuuagugcagaucgagaacuuggaguacacgguggugguaaccguacacaacggcgauacgcacgcagucggcaacgacaccuccaaccacgggguuaccgccaccaucacgccacgcagccccuccgcugagguaaagcugccggacuacggcgagcugacucucgacugcgagccccggagcgggaucgacuucaaugagaugauauugaugaagaugaagaagaagacgugguugguccacaagcagugguuccucgaccugccucugcccuggaccgcgggcgccgacacuucugaggugcacuggaacuacaaggagcgcauggugacguucaaagucccgcaugcaaagcggcaggacgugaccgugcucgggagccaagagggcgcaaugcacagcgcccuugcaggcgccaccgagguggacucaggggacggcaaccacauguucgccgggcaccugaagugcaagguccgcauggaaaagcuccgcaucaaggguaugagcuacacaauguguuccggcaaguucagcaucgacaaggaaauggcagagacccagcacgggaccaccgucguaaaggucaaguacgaaggugcgggggcgcccugcaagguccccaucgaaauccgggacgugaacaaggagaaaguggugggccgcgucaucuccagcacuccucuggccgagaacacgaacuccguaacuaacaucgagcuggagccgcccuucggagacagcuauaucgugaucggcgucggcaacucagcccucacccugcacugguuccgcaaggggagcuccaucggcaagauguuugagaguacguacagaggggccaagcggauggcgauucucggcgagacggcgugggacuucggguccguuggcggccucuuuaccagcuuggggaaggccgugcaccaggucuucggcucaguuuacacaacuauguucgguggcgugaguuggaugaucaggauccuuaucggguuccucguacuguggauuggcacuaacucccggaacaccaguauggccaugacgugcaucgccgugggggggauuacccucuucuuagguuucacggugcaggcggacauggggugugucguguccuggagcggucgcgagcucaagugcggcagcggcaucuucgugguggauaacguacacaccuggaccgagcaguacaaauuucagcccgagucccccgcgagacuggccucggccauccugaacgcccacaaggacggggugugcgggauccgcuccaccacgcgacucgagaacgucauguggaagcaaaucaccaacgagcugaacuacguguugugggagggggggcacgaccuaaccguggucgccggcgaugugaagggcgugcugacgaaggggaagcgggcccugacgccgcccgucuccgaccucaaguacuccuggaagaccuggggcaaggccaaaaucuucaccccugaggcccgaaacagcaccuuccugauagacggccccgacaccucugagugccccaacgagagacgggccuggaauagccuugagguggaggacuacggcuucgguauguucacgacaaauaucuggaugaaauuccgcgaaggcagcagcgaggugugugaccaccggcucauguccgcggccaucaaggaccagaaggccguccacgcagacaugggcuacuggauugagaguuccaagaaccagaccuggcagaucgagaaggccagccuaaucgaggugaagacgugccuguggccgaagacacacacccucuggucuaacggggugcuggagagucagaugcugauucccaagaguuacgccggcccguucagccagcacaacuaccgccagggguaugccacccagaccgucggcccauggcaccucgggaagcuggagaucgacuucggggagugcccuggcaccaccguaaccauucaggaagacugugaccaucgggggcccagccugagaaccacgaccgccuccggcaagcucgugacccagugguguugccgcuccuguaccaugccgccccuucguuuccucggggaagacggcuguugguacgggauggagaucaggccccucuccgagaaggaggagaacauggucaagucccagguggcugccggccaggguacauccgagaccuucucuauggggcuccucugccucacccuguucgucgaggagugccugagacgccgggugacccggaaacacaugauacucgccgugguaaucacguugugcgccaucaucuuaggcgggcuuaccuggauggaccugcugcgggcccucaucaugcugggcgacaccauguccggacgcaucggggggcagacucaccuggccaucauggcaguauucaaaaugagccccggguacguguuaggggucuuccuucggaagcugacgucccgcgagaccgcccucauggugaucgggauggccaugacgaccacgcugagcaucccccaugaccugauggagcucaucgacggcauuucccugggacuaauacuccugaaaaucgugacucaguucgacaacacccaggucgggacacuggcccucagccugacguucauccgguccaccaugagcuugguaauggccuggcgcacuaucauggcggugcuguucgucgugacccugauaccacugugucggacgucaugccuccagaagcagagccacuggguggagaucaccgccuugauccugggcgcccaggcauuacccgucuaccugaugacauuaaugaaaggggcgucccgccggucuuggccccucaaugagggcaucauggcgguggggcuggugucccugcucggcagcgcccugcugaagaacgacgucccguuggccggccccaugguggcggggggccugcugcucgccgccuacgugauguccggguccagcgccgaccuuucacuagaaaaggcggccaacguccagugggacgagauggcggauauuacgggcagcucccccaucaucgaggugaagcaggacgaggaugguagcuucucaauccgcgacguugaggagacgaacaugaucacucuccuggucaagcuggcccucaucacugugagcggucuauacccccucgccaucccggugaccaugacgcucugguacauguggcaagucaagacacagcgaagcggcgcccugugggacguuccaagccccgccgcgacccagaaggccgcccugagcgaggggguguaccgcaucaugcagcggggccucuucgggaaaacucaggucggcgugggcauccacauggagggcguguuccacaccauguggcacgucacacgcggcagcgugaucugccacgagacggggcggcuggaacccucaugggccgacgugcgcaacgacaugaucagcuauggcgggggcuggcgccugggcgacaagugggacaaggaggaggacguccaggugcucgccauugagccggggaagaaccccaagcacgugcagaccaagcccggccuguucaagaccuuaacgggggaaaucggcgcggucacacuugacuucaagcccggcaccuccggcagcccgaucaucaaucggaagggcaaagugaucgggcuguaugguaacggcguggucaccaaguccggggacuacgugagcgccauuacgcaggcggagcgcaucggggagcccgacuacgaaguagacgaggacauauuucguaagaagcgccugacgaucauggaccuccaccccggcgccggcaagaccaagcguauccuuccguccaucguucgcgaggcccugaagcgccgccugcgaaccuuaauccuggccccgacgcgcgugguugccgcggagauggaagaggcccugagggggcuuccaaucagauaucagacccccgcgguaaaauccgagcacaccggccgagagaucguggauuuaaugugccacgcuaccuuuacuacccgccugcucagcagcacccgggugccgaacuauaaccuuauagucauggacgaagcacacuuuaccgaccccucauccguggccgcccgcggcuacaucagcacccguguugagaugggcgaggcggccgccaucuucaugaccgccaccccccccggggccaccgacccguucccccaaucgaacucacccaucgaggauaucgagagagagaucccugagcgguccuggaauacgggguucgacuggaucaccgacuaccagggcaagacgguaugguuugugccuagcauuaaagcgggcaaugacaucgccaacugccugcgcaaguccgggaagaagguaauccagcugagccgcaagacauucgacacggaguaccccaagaccaagcugaccgacugggacuuuguggugacuacggacauaagugagaugggggccaauuuccgggccggccgcgucaucgaccccaggcgcugccucaagcccgugauccucacagacgggccggagcgggugauccuggcaggcccaauccccguaacacccgccagcgccgcccagcgccgaggccgcaucgggcggaauccggcgcaagaggaugaucaguacguguucuccggagacccuuugaagaacgacgaggaucacgcccacuggacagaggcaaagaugcuccuggauaacauuuacacgcccgaagggaucauaccgaccuuauucgguccggaacgcgagaagacccaggcgaucgacggcgaauuccggcuccgcggggagcagcggaaaaccuucgucgagcugaugcgccggggcgaccugcccgucuggcucagcuacaaggucgccucugccgggauuagcuauaaggacagggaguggugcuucacgggcgagcggaacaaccagauccuggaggaaaacauggaaguggagaucuggacacgcgagggggagaagaagaagcuuagaccccguuggcucgacgcgcgggucuacgcggaccccauggcccugaaggacuuuaaggaauuugccucaggccgcaagagcauaacccucgauauucucaccgagaucgcgucccugccuaccuaccuuagcagccgcgcaaagcuagcccuggacaacaucgugaugcugcacacgacugagcggggcgggcgcgccuaccagcacgcccucaacgaguuaccugagagucuggaaacccucaugcuuguggcccugcucggcgccaugacagccgggaucuuccuguucuucaugcaggguaaggggaucggcaaacuuagcaugggccugauaacaaucgccguggccuccggguuguuauggguggcggagauacagccccaguggaucgccgccagcaucauccucgaauucuuccugauggugcugcuaaucccggagcccgagaaacagcggaccccccaggauaaccagcuuaucuacgucauccuggccauuuugacuaucaucgggcugauagccgcgaacgagauggggcugaucgagaagaccaaaacugacuuuggguucuaccaggugaagacggagaccaccauucucgacguggaccugcggcccgccucggccuggacccuguacgcggucgccaccaccaucuuaacgccgaugcugcggcacacgaucgaaaacaccagcgcgaaccugucccuggccgccauagccaaccaggccgcggugcugaugggacuagggaaaggcuggccccuccaccgcauggaccugggggugccauuauuagccaugggaugcuacagccaggucaaccccacgaccuugacggccucccuagugaugcuccuggugcacuacgccaucaucgggccgggccugcaggcaaaggccacccgggaggcccagaagcgcaccgcagccggcaucaugaagaaccccaccguagacgggaucacgguaauagaccucgagcccaucucuuacgaccccaaauucgagaagcagcugggccaagugaugcuacuuguacuuugcgcggggcaacugcuccuuaugcggaccaccugggccuucugcgaggugcugacccucgcaacgggcccgauccugacccuuugggaggggaaccccggacgcuucuggaacacgacaaucgccguauccacagccaacaucuuccggggcucguaccucgccggagccggccuggcguucucacugaucaagaacgcccaaaccccccgccgggggaccggcaccacuggggagacccucggcgaaaaguggaagcgccaacuuaacagcuuggaccguaaggaguucgaggaguacaagcgguccgggauucucgaggucgaccggaccgaagccaaguccgcacugaaggauggcucaaaaaucaagcaugccgugagccgcggcaguaguaaaauccgguggaucgucgagcgcgggauggucaagcccaaaggcaaagugguggaccuggggugcggccgcgguggguggagcuacuacauggccacccuaaagaacgucaccgaggugaagggcuauacgaaggggggcccggggcacgaggagcccauucccauggccaccuacggcuggaaccuggugaaguuacacuccggcgucgacguguucuauaagcccaccgagcagguggauacccugcugugcgacaucggggagagcuccagcaacccgaccauugaggagggccggaccuugcgcguccucaaaaugguugagcccuggcuguccagcaagcccgaauucugcaucaagguuuugaacccauacaugccgaccgucaucgaggagcuggagaagcuccagcggaagcacggaggcaaucuggugagaugcccccugucgagaaacagcacccacgagauguacuggguaucuggcgcgagcgggaauaucguguccagcgugaauacgaccuccaagaugcuucugaaccgcuucacaacccggcaccgaaagcccacguaugagaaggacguggaccugggcgccggaacccggagcguguccaccgagaccgagaagcccgacaugacgaucaucggccgccggcuccagcgccugcaagaggagcacaaggagaccuggcacuaugaccaggagaacccguaccggaccugggccuaucacggcagcuacgaggcccccuccaccggaagcgccuccagcauggugaacggcguagugaaguugcuaacgaaaccaugggaugugaucccgauggucacccagcuggccaugaccgacaccacacccuucgggcagcagcgcguguucaaagagaagguagacacacggaccccccagcccaaaccgggcacgcggauggucaugacgaccacagccaacugguugugggccuugcuggggaagaagaagaauccgcggcugugcacccgcgaggaguucaucagcaaggugcggucuaacgcagccaucggcgcgguguuccaggaggagcagggguggacgagcgccucggaggccgucaacgacagucgcuucugggagcucguagacaaggagcgagcccugcaccaagaagguaagugcgagucgugcguguacaacaugaugggcaagcgcgaaaaaaagcugggagaauucggccgugccaaggggagucgggcgaucugguacauguggcucggcgcgcgcuuccuggaguuugaggcccugggguuccucaacgaggaccacugguucggccgggaaaacagcuggagcgggguagagggggagggccugcaccgccugggguacauccucgaggagaucgacaagaaggauggcgauuugauguacgccgacgacaccgccggcugggacacccggauaaccgaggacgaccugcagaaugaggagcucaucacggagcagauggccccccaccacaagauucuggccaaggccaucuucaagcugaccuaccagaacaagguggugaagguccuucggcccaccccgcguggggccgugauggacauaaucucccgcaaggaccagcggggcagcgggcaggugggcaccuacgggcuuaacaccuuuacgaacauggagguccagcucauccgccagauggaggcggagggcgugaucacacaggacgacaugcagaaccccaagggccugaaggagcggguugagaaguggcugcgcgaguguggaguggaucgucucaagcgcauggccaucuccggagacgauugcguggugaagccccucgacgagcgguucgggacgagccugcuguucuugaacgauaugggcaaaguacgcaaggacaucccgcagugggagccguccaagggguggaagaacuggcaggagguacccuuuuguagccaccacuuccacaagaucuucaugaaggacggccggucccugguuguccccugccgcaaccaggacgagcugaucggccgggcccgcauuagccagggagccggcuggucccuccgcgagacugcaugccuggggaaggccuacgcccagauguggagcuuaauguacuuucaucggcgcgaucuccggcuugcaagcauggccaucugcuccgcaguccccacggaaugguucccgacaucucguaccaccugguccauccacgcgcaccaucaguggaugacuaccgaagacaugcugaagguguggaaccgcgucuggaucgaggacaaccccaacaugaucgacaaaacccccgugcacagcugggaggacauacccuacuugggcaagcgagaggaccuguggugcgguuccuuaauaggcuugagcuccagagcaaccugggcgaagaacauccauacggccauaacccaagugcgcaaccugauaggcaaggaggaguaugucgacuacaugccggugaugaagcgguacagcgcccccagugagagcgaggggguucuauga

SEQ ID NO: 26251 - RNA, 9867 nt, Artificial Sequence
  derived and/or modified CDS sequence (opt11) from DENV-4__GQ199884__SS-prME
ucaacaauuacccuccuaugucuuauccccaccgugauggcauuccaucucuccacacgggacggagaaccccuaaugaucgucgccaaacacgagaggggccggccgcugcucuuuaaaacaacggagggcaucaacaaaugcacccuuauagcaauggaccuaggggagaugugugaagacacugugaccuacaaauguccacuauuagucaacacagaaccggaagacauagacugcugguguaacuuaacuucgacaugggugauguacggcacgugcacccagucgggggagcggcgaagggaaaaacgaaguguagcccucacgccucacagugguaugggccucgaaacgcgagccgaaacauggaugucgucggagggcgcuuggaagcacgcccaacggguagagagcuggauacuacgaaaccccggcuucgcacuccuagcuggcuuuauggcauacaugauaggucaaacgggcauccaacgaaccguauucuuuguucugaugaugcuggucgcacccucauacggcaugcguugugucggugucggcaaucgagacuucguggaaggggucagcggaggggccugggucgaccucguauuggagcacggcgggugcgugaccacgauggcgcaagggaagcccacucuugacuucgaacuaacaaagacaacggcgaaggaagucgcgcuccuuagaacauacugcauugaggcuuccaucuccaauaucaccaccgcaacacgaugcccaacccagggcgagcccuaccucaaagaagaacaggaccaacaauacaucugucgacgggacguaguagaccguggcuggggaaacggaugcggauuauucgggaagggcggaguagugacgugcgcuaaguuuucaugcucagguaaaaucacgggaaaccugguccaaaucgagaaccuagaguacacggucguaguaacaguacacaacggagacacccacgcaguaggcaaugacacauccaaucauggaguaacggcaacuaucacgcccagaagucccucaguagaaguaaaacugccagauuacggcgagcucacucuggacugugagccgcgcucagggauagacuucaacgagaugauacuaaugaagaugaagaagaaaacguggcucguacacaaacaaugguuucuggaccuaccucuaccauggacagccggugcagacacauccgagguacauuggaacuacaaagagcggauggucaccuucaaaguaccacaugcuaagagacaggacgucacagugcuaggcagccaagagggggccaugcacagcgcauuagcuggagcgacugagguugacucaggggauggaaaccauauguucgccggucaucuaaaauguaaaguacggauggaaaaacuaagaaucaaaggaaugagcuacacaauguguucgggcaaauucuccaucgauaaagaaauggcagaaacacagcauggaacuacuguggugaaaguaaaguacgaaggggcuggggcaccaugcaagguccccauugaaauuagagacguaaacaaagaaaaaguagugggucgcguaaucagcucgaccccacucgcggaaaacaccaacucggugaccaacauagagcucgaaccacccuuuggggacucauacauugugauaggcgucggcaauagcgcuuuaacacuacacugguuccggaaaggaagcucgauaggcaaaauguucgagucaaccuacagaggcgccaaaaggauggcuauacucggagagaccgcgugggacuucgggagcgugggugggcucuuuaccucacuuggaaaggcaguacaccagguguuuggaagcguauauacgacaauguucgguggggucucauggaugauacgcauacuuaucggauuucugguacucuggauaggcacaaacagcaggaacacgucgauggccaugaccugcaucgcagugggcgggaucacuuuguuucuaggcuucacgguacaggccgacauggguugcgugguuagcuggaguggccgugagcucaaaugcggaagcggaaucuucguuguagacaacgugcacaccuggaccgaacaguauaaguuccaacccgagaguccagcccgucuagcaagcgcaauacuaaaugcacacaaagacggcgucugcgguauacgcucgacaacgcgacuagaaaaugucauguggaaacaaauaacaaacgagcugaauuaugucuugugggaaggagggcacgauuuaacaguaguugcgggcgaugugaaaggaguacuaacgaaaggcaagagggcacuuacgccacccgucagugaccucaaauacucuuggaaaaccuggggaaaagcaaaaaucuucaccccagaggcccgcaacagcacauuucugauagacggccccgacacaagugaauguccgaacgagcgacgggcguggaacagucucgaaguagaagauuauggauucgguauguuuaccaccaacauuuggaugaaguucagggaggggagcuccgagguaugcgaccaccgacuaaugucugccgccaucaaagaccagaaggcaguacacgcugacaugggcuacuggauagagagcuccaagaaccaaaccuggcaaaucgagaaggcaagccuuauugaaguaaaaaccugucucuggccgaaaacacacacgcuaugguccaauggugugcuggaaucccagaugcucaucccgaaauccuacgccgguccauucagucaacacaacuaccgacagggguaugcuacucaaaccgucggcccguggcauuuaggcaagcucgaaauagacuucggagaaugcccaggcaccaccguaacgauccaggaagacugugaccacagaggucccagccuaagaacgaccacggcgucagggaaguugguaacacaaugguguugccgauccugcacaaugccgccuuuacgcuucuuaggagaagaugguugcugguacggcauggaaauuagaccauuaucggaaaaggaagaaaacaugguaaaaucccaaguugccgccggccaggggacgucagaaacauucucaauggggcucuuaugcuugacucucuucguggaagaauguuuaaggcgaagggugacacgaaagcacaugauucuggccguagugauuacucuaugugcaaucauccuaggaggacuaaccuggauggacuugcuccgagcccugauaaugcucggugauaccaugagugguagaauugggggucagacacaccucgccaucauggcaguauucaaaaugaguccgggguauguccucggcgucuuucuaaggaagcuaacgagucgcgagaccgcacucaugguaaucggaauggcaaugacgaccacauuauccauaccccaugacuugauggaguugaucgacgggauaucccugggauuaauccuccugaagaucgucacgcaauucgacaacacccaaguaggcacacuugcccucagccuaacauucaucaggagcaccaugagucuagucauggcguggcggacaauaauggcgguacuguucguagugacacugauaccacugugccgaacauccugcuugcaaaagcagucccacuggguagaaauaacagcacuaauccugggcgcucaggcgcugccagucuaccucaugacccugaugaagggggcaucgcggagaucguggccacucaaugaaggaauuauggcagugggucuuguaucacuccucggaagcgcgcuccugaaaaacgacgucccacuugccgggccaauggucgccgguggucuauuacuugcggcuuacgucaugucggguucaagcgcggaucuaucccuggagaaagccgccaacguacagugggacgaaauggccgauauaacaggaagcucgccuauaauagagguaaaacaagacgaggacgguagcuucagcauccgggacguugaagagaccaacaugauaacccuacucgucaaacuagcgcucauaacugucagcggcuuguacccacuagcuauaccugugacaaugacucugugguacauguggcaaguaaagacgcaacgcucaggagcuuuaugggaugugccgaguccggcagccacacaaaaggccgcccucucggaagguguguaccgaaucaugcaacgagggcucuuuggaaagacccaagucggagugggcauacacauggagggaguauuccacacaauguggcacgucacuagaggcagcgugauuugucacgaaacggggcgccucgaaccauccugggccgacguccgaaacgacaugaucuccuacggagguggguggaggcuuggagacaagugggacaaagaagaagauguccagguacucgccauugagccgggaaagaacccgaagcauguccaaaccaagccaggauuauuuaaaacauuaacaggggaaauaggagcgguaacucuggauuuuaaacccggcacgagcgggucacccauuaucaacagaaagggcaaagugaucggauuguacggaaacggagucguaaccaaaaguggcgacuaugucucggccaucacacaagcggagcgcauaggggagccggauuaugaagucgacgaggacauauuccguaagaaacgucuaacaauaauggaccugcaccccggcgcuggaaaaacaaagagaauccuaccgucuauuguucgagaggcgcuaaaacgccgguuacggacacucauacucgcaccgacgcgaguaguagccgcagagauggaagaagcccuacguggacuuccaauacgguaccaaacacccgcagugaaaagcgagcacacaggccgagaaaucgucgaucucaugugucacgcgacuuuuacaacccgccuuuuaagcagcacaagaguuccuaauuauaaucuaauagucauggaugaagcccacuucacugauccuagcucgguggcugcccggggauauaucucgaccaggguggagaugggcgaagcugcggcaaucuucaugaccgcaacaccaccaggugcaacggaccccuucccucaauccaacucaccuauagaagacaucgaaagagagauccccgaaagaucguggaauaccggauucgacuggauaaccgacuaccaagguaagacggugugguucguccccuccauuaaagcggguaacgacauugcgaacugucucaggaaaagcggcaaaaaggucauacagcugagucgcaagaccuuugacaccgaguaucccaagacaaaacugacagacugggacuuugucgucacgaccgauaucagugaaaugggagccaacuuccgcgcagggcgcgucaucgacccaaggcgaugcuuaaagcccguaauucugacagacggcccugaacggguaauacucgcaggccccauacccgugacacccgcauccgcugcccagcgcagaggcaggauaggccgaaacccugcgcaagaagacgaccaauauguauucagcggagacccccucaagaacgaugaagaccacgcccacuggacagaggcaaaaaugcugcucgauaacauauacaccccggaagggauaaucccaacgcuguucggcccagaaagggagaaaacacaagcaaucgacggagaguuccgauuacggggagaacaaagaaaaacauucguagaacuuaugcguagaggggauuuacccguaugguuaucguacaagguagcaucggcggguaucagcuacaaagaccgagaaugguguuucacaggggaacguaacaaccagauauuagaagagaacauggaaguagagauuuggacaagggaaggggagaagaagaaauuacggccgagguggcuggacgcccgaguuuaugcagaccccauggcccuuaaagacuuuaaagaguucgccuccggccgcaaguccauaacacuagacauacuuacagaaaucgcgucccuaccgaccuaccucucaagcagggcuaaguuggcccuggauaacauuguaaugcuccacaccacugaaagggguggcagagccuaccaacacgcauugaacgaacuccccgagucacuugagacacucaugcuaguagcacugcuuggggcgaugaccgccgggauuuuucuuuucuucaugcaggggaaagggauaggcaagcuaagcauggggcucaucacaaucgcaguggcaagcggccugcuauggguagcggagauacagccucaguggauugcagccaguaucauacuagaauuuuuccuaaugguccuccugauacccgagcccgaaaagcaacggacgccccaagacaaccaguuaauauacgucauacuggccauccucaccaucauaggccuaauagcggccaacgaaaugggacugauagagaagacuaagacggacuucgguuucuaucaagucaagaccgagacgacaauacuagacguagaccuacgcccugcauccgcguggacgcuauacgccguugcaacgaccauacuuacaccgauguugcgccacaccauugaaaacacgagcgcaaaccuuucgcuagccgcaaucgcgaaucaagcagccguccuuauggggcuggggaaaggauggccgcuacacaggauggaccuuggugucccccuacucgcuaugggcugcuauagucaggucaacccgaccacccucacagcaaguuuggucauguuacugguacauuacgcaaucauagguccaggacuacaagccaaagcaacgcgggaggcccaaaaacggacagcagcggggauaaugaaaaauccaaccguagauggaaucacggugaucgacuuagagccuauaagcuacgacccgaaauucgaaaagcaguuaggccagguaauguuguuaguguuaugugcgggacaacuacuccucaugcgaaccacaugggccuucugugaaguacuuacccuggcaaccggccccauccuaacucuaugggaagggaaucccggcagguucuggaacaccaccauugcgguaaguaccgcaaacaucuuccgcggcucguaccuggcuggagcuggccuggcauucucgcucauuaagaacgcccaaacaccgagacggggcaccggcacaaccggggagacacuaggagaaaaauggaaacggcagcugaacucccuugaccggaaagaauuugaggaauacaagaggucuggcauccucgaagucgaccgaacggaagcaaaaucggcacucaaagacggcagcaaaaucaagcacgccguaagccgaggauccagcaaaaucagguggaucgucgagcgaggaaugguaaaacccaaaggcaaagucguagaccugggguguggccgcggagguuggagcuacuacauggcaacacucaaaaacguaacggaagugaaagguuauacaaaaggaggaccaggacacgaagaaccaauccccauggccacguacggauggaacuugguuaaacugcacuccggcguagauguauucuacaagccuacagagcaggucgauaccuuacuuugcgacauaggcgagaguucgucgaaccccacaauugaagaaggacguacccugcgcguacucaagaugguagaaccauggcuaucgaguaagcccgaguucugcaucaagguacuuaaccccuacaugccaacaguaauugaagaacuagaaaaacuccagaggaagcacggagggaaccucgugcgauguccacucucaaggaacucaacucacgagauguacugggugagcggggcguccggcaacauaguaucaucgguuaacacaacaagcaagaugcuacuaaauagauuuacaacgcggcacagaaaacccacuuacgagaaagacguagacuuaggcgcgggcacaagaucagucagcacggagacagaaaagccggacaugacgaucauuggcagacgacuacaacgauugcaggaggaacacaaagagaccuggcacuaugaccaggaaaacccauacagaacaugggccuaccacggaagcuacgaagccccuuccacagguagcgcaaguagcauggucaacggaguagugaagcugcuuacaaagccaugggauguuaucccaauggucacgcaauuagcgaugacugacacgacaccguucggccagcaaagaguguuuaaagaaaaagucgacacacgcaccccgcaaccaaaaccggguacccguauggucaugaccacgacagcuaacuggcuaugggcauugcucggcaagaagaaaaacccaagacucugcacacgcgaagaguucauuagcaaagugcgaagcaacgccgcaaucggcgccgucuuccaagaagaacaaggguggacgucagcgucagaagccguaaacgauagcagguuuugggaacugguagacaaagaacgagcgcuacaccaggagggaaagugugaaucuuguguauacaacaugauggggaaacgagaaaagaaacuuggcgaguucgggagggcaaaaggcucgcgggccaucugguauauguggcuaggagcgcgcuuccuggaguucgaggcccuaggcuuucucaacgaagaccacugguucgggcgagaaaauucauggagcggcguagaaggagaaggccugcaccgguuaggcuauauuuuggaagaaaucgacaaaaaggacggugacuuaauguacgcagacgauacggccggaugggauacaagaaucaccgaggaugaccuccagaaugaggaacucauaaccgaacaaauggcaccccaccacaagauacucgcgaaagcaauauucaagcuaacuuaccaaaacaagguggucaagguauuaagacccacgccacgaggagcaguuauggauauaaucucccgaaaagaccaaagaggaagcggccagguagggacauacggacugaacaccuucaccaacauggaaguacaacucauccggcaaauggaagcugaaggcgucauaacgcaggacgacaugcagaacccgaaaggucuaaaagaaaggguagagaaguggcuucgagaauguggggucgaucgucucaaaaggauggcaauaagcggggacgauugcgucgucaagccgcuagaugagcgcuucggcacaagccuccuguucuuaaacgacaugggcaaagugaggaaagacaucccacagugggaaccgucaaaagguuggaaaaauuggcaagaaguacccuuuugcagccaccacuuccacaagauauuuaugaaggacggacgcagccuagucguccccugccgaaaccaagaugaacuaauuggaagggcccgcauaagucaaggggccggguggagccugcgcgagacugcaugccuagguaaagcguacgcccaaauguggucguugauguauuuucacagacgagaccuacgccuagcguccauggccauaugcagcgcgguccccaccgaaugguucccgacuagccgaaccacauggaguauucacgcccaccaccaguggaugaccacggaggacaugcucaagguauggaaccggguauggaucgaagauaacccaaacaugauugauaaaacccccguccacucuugggaggacauccccuaccugggcaaacgggaagacuuaugguguggcucacucauaggucucuccagccgagccacgugggcuaaaaacauccacaccgcaaucacccaggugcgcaaucugaucgguaaagaggaguauguagacuacaugccagucaugaaaagauauagugcucccucggaaucugaaggaguccuguga

SEQ ID NO: 26252 - RNA, 9867 nt, Artificial Sequence
  derived and/or modified CDS sequence (opt11) from DENV-4__FJ882595__SS-prME
ucaacaaucacccugcucugccugauccccacagcuauggccuuccaucugucuacgcgagauggcgaaccgcucaugauuguggcgaagcacgaacgagggcgaccgcuguuguucaaaacgacggagggcaucaauaagugcacguuaaucgcaauggaccugggggagaugugugaagauaccgucaccuacaagugcccucugcucgucaacaccgaaccagaggacaucgacugcugguguaaccugacgagcacguggguuauguacgggacgugcacccagagcggggaacggcgccgggagaagcgcagcguggccuugacgccgcacuccggcaugggccucgagacccgggccgaaacauggaugagcuccgagggcgccuggaagcacgcccagcgcguggagagcuggauccugcggaaucccggcuucgcccuguuagccggauucauggcuuacaugaucggucaaaccgggauacaaaggacgguguucuuuguccugaugaugcugguggcgcccuccuauggcaugcgaugcgugggcgucgggaaccgcgacuucgucgagggugucagcgggggcgccuggguggaccucgugcuggagcauggcgggugcgugaccaccauggcccagggcaagcccaccuuggacuuugagcugacgaagaccaccgcuaaagaagucgcccugcugcggaccuacugcaucgaggcguccaucucuaacauaacgaccgccacccgauguccgacccaaggggagccauaccucaaggaggaacaggaccagcaguacaucugccgucgggacgugguugacaggggcugggggaacggcuguggccuguucgggaagggcggcguugucacgugcgcgaaguucuccugcaguggaaagaucaccggcaaccuugugcagauagaaaaccucgaguauacggucgugguaaccguacacaauggagacacucacgcuguaggcaacgacacauccaaccauggagucacugccaccaucacgccccgcagccccucgguggaaguuaagcugccggauuacggggagcugacccuggauugcgagccucggagcggaaucgacuucaacgaaaugauccugaugaaaaugaagaagaagacauggcuaguucacaagcagugguuccucgaccuuccguugcccuggacugcaggugccgauacauccgagguacacuggaacuacaaagagcguauggugacguucaaggucccgcacgcgaaacggcaggaugucacaguacucgggucgcaggaaggcgcgaugcacagugcacuugcaggugcaaccgaggucgauuccggugacgggaaucauauguucgcuggccaucucaaguguaaggugcguauggaaaaguuacgcaucaagggcaugagcuacaccaugugcuccgggaaguucucgaucgauaaggagauggcggaaacgcaacaugguaccacggugguaaaggugaaguaugagggagccggagcgcccugcaaggugcccaucgagauccgggacgucaacaaggagaaggugguggggcgugucaucucgagcacccccuuggccgaaaacacuaacucugugacgaauaucgaguuagagccgcccuucggggacuccuauaucgucauaggagucggcaacuccgcauuaaccuuacacugguucaggaaggggaguucaaucggaaagauguucgagagcaccuaccgcggggcaaagcggauggcgauucugggcgagacagccugggauuucgggaguguugggggacucuucacaagccuggggaaagcagugcaucaggucuucggcuccguguacaccaccauguucggaggcgugagcuggaugauccguauccugauaggcuuccucguucucuggaucggcacgaauagcaggaacaccuccauggccaugaccugcaucgccgugggcggaaucacccucuuccugggcuucacggugcaagcggacauggggugcgucguguccuggagcggcagagagcucaagugcgggagcggcauauucguggucgauaacguucauacguggacugagcaguacaaguuccagcccgagucccccgcacggcuugccagcgccauccuuaacgcccacaaggacggcguguguggaauucguuccaccacgcgacucgagaauguuauguggaagcagauuaccaacgagcucaacuacguacugugggagggugggcacgaccucacagucgucgcaggcgacgugaaaggcgugcugacaaaagggaagcgugcgcugacgccgcccgugagcgaccucaaguacagcuggaagaccuggggcaaggccaaaaucuucacccccgaggccaggaacagcaccuuucugaucgacggucccgacacauccgagugcccaaacgagcgcagagccuggaacagccucgaaguggaggacuacggcuucggaauguuuacuaccaacaucuggaugaaguuccgcgaaggcuccucggaggugugcgaccaccggcucaugucugcggccaucaaggaccagaaggccguacaugccgauaugggguacuggauugagagcuccaagaaccagacguggcagaucgaaaaggcgagccuaaucgaggugaagacgugucuguggccgaagacacacacccucugguccaacggggugcuggaaagccagaugcuuauacccaaguccuacgcgggaccguuuagccagcacaacuaccgccaaggauacgccacccagaccgugggccccuggcaccucgggaaacuggagaucgacuucggcgagugcccggguacgacggugaccauucaggaggacugugaccaccgggggccaagccuacggaccacgaccgcuuccggcaagcucguuacccaaugguguugccgcagcugcaccaugccaccgcuucgguuucugggggaggacggcugcugguacgggauggagauccggccccucucagagaaggaggaaaacaugguuaagagccagguggccgcgggacagggcacguccgagaccuucucaaugggucugcucugucucacacuguuugucgaggagugccugcggcgacgugugacccgcaagcacaugaucuuggccguggucaucacgcucugugccaucauccucggcgggcugaccuggauggaccuccugcgggcccuaauaaugcuuggugacaccauguccggccgaaucggggggcagacccaucuugccaucauggcgguguucaagaugucucccgguuacguacucggcguauuccuucgcaaacugacuucgcgagagaccgcgcucauggugauugggauggccaugaccaccacgcuaagcaucccgcacgaccuaauggagcucaucgacggcauuucccuggggcugauucuccugaagaucgugacccaauucgacaacacccaggucgggacgcuggcuuugagccugacguucauaagguccacgaugucacuggugauggccuggcgcacaaucauggcggugcuauuugucgugacuuuaauccccuuaugccggaccagcugccuccagaaacagucgcacuggguggagauaaccgcccugauccugggcgcccaggcccucccugucuacuuaaugaccuuaaugaaaggggcgucacgccggaguuggccccucaacgagggcaucauggcugucggucuuguaucacugcucggcucugcccugcugaagaacgacgucccacuagccggccccaugguagccgggggccucuuacucgcggccuacgugauguccgggucuagcgccgaccuaagucuggagaaggccgccaacguccagugggacgagauggcggacauuaccggcagcucccccaucaucgaagugaaacaggacgaagaugggucuuucucuauaagggacguggaggagacuaacaugaucacccuucuggucaagcuggccuuaaucaccgugagcgggcucuacccauuggccauacccgugaccaugacgcucugguacauguggcagguaaagacccagcgguccggcgcccugugggaugugccgagccccgccgcgacccagaaggccgcccuguccgaggggguguacagaaucaugcagcgaggccucuucgguaagacgcagguggggguggggauccacauggagggcgucuuccacaccauguggcaugucacacgcggcagcgugaucugccacgagaccggacggcuugaacccuccugggcagacgugcgcaacgacaugaucagcuacggagggggcuggcgccugggugacaagugggauaaggaagaggauguacaaguccuagccaucgaaccggguaagaacccgaagcacgugcagacgaagcccggcuuguucaagacccuuacgggggagaucggcgcugucacuuuggacuucaagcccgguacauccgguagcccuauaaucaaucggaagggcaaggugaucggacuguacggcaauggggugguuaccaaaucgggcgacuacguguccgcaaucacgcaggcagagcgcaucggagagcccgacuacgagguggacgaggacaucuuccggaagaagcgccugaccaucauggaccuccaccccggcgcgggcaagaccaagcgcaucuugcccucgauaguccgcgaggccuuaaagagaagacugcggacucuuauccuggcacccacgagagucguggccgccgagauggaggaggcucuacgggggcuccccauccgguaccagacgccagcugucaagagcgagcacaccggaagagagauugucgaccugaugugucaugccacuuuuaccacgcgccugcuuucuaguacccgggugccuaacuacaaccugauagucauggacgaggcccauuucacugacccgucuuccguggccgccagaggguacaucagcacgcgggucgagaugggcgaggcggccgccaucuucaugacugcuacgccccccggagcuacagacccguuuccccagucaaacagccccauagaggacauugagcgagagauccccgaacgguccuggaacacgggguuugacuggaucacggacuaccagggcaaaaccgugugguucguaccgagcauuaaagcgggcaacgacauugccaacugccugcguaaguccgggaagaaaguuauccagcucucucggaaaaccuucgacacggaguaccccaagaccaagcugaccgacugggacuuuguggugacaacggacaucuccgagaugggggcaaacuuccgcgccggcagaguuauagacccccggcgcugccugaagccggugauccucacugacggcccggaacgggugauacuggcagggcccaucccugucacucccgccagugccgcccaacgccggggccgcauugggcgcaacccagcccaggaggaugaccaguauguguucagcggcgacccccugaagaacgacgaggaccaugcgcacuggaccgaagccaaaaugcuacuagacaauauuuacacgccggaagggaucaucccuacccuguucggcccggagagagagaagacccaggccaucgacggcgaguuccgacuccguggugagcagcggaaaaccuucgucgagcugaugcgccggggggacuugcccguuuggcuuaguuacaagguggcgucggcugggaucuccuacaaggaccgcgagugguguuucacgggcgagcggaacaaucaaaucuuagaggaaaacauggagguagagaucuggacccgcgagggggagaagaagaagcugcgcccccgcuggcucgacgcgcgagucuacgcagacccaauggcccugaaagacuucaaggaguucgcauccggccgcaaaagcauaacccuggacauucucacugagauugccucccugccaacauaucuaagcagccgcgcgaagcuagcccuugacaacaucgugaugcugcacaccaccgagcggggaggucgcgcuuaccagcacgcccucaacgagcugcccgagucccuagagacucucaugcucguggcucugcucggggccaugaccgccgggaucuuccuguucuuuaugcaggguacgggcaucggaaaacuaagcaugggccuuaucaccaucgcagucgccagugggcugcuguggguggcggaaauccagccccaauggaucgcggccagcaucauucucgaauucuucuuaauggugcuucucaucccugagcccgagaagcagcggacgccccaggacaaucaacugaucuacgucauccugaccauccucacgaucaucggccugaucgcagccaacgaaaugggccugaucgaaaagaccaaaaccgacuucggcuuuuaucaggugaagaccgagacuaccauccucgacguugaccugcgccccgcguccgccuggacucuuuacgccgucgcuaccacuauucucaccccgaugcugcgccacaccaucgaaaacaccagcgccaaccugucucucgcggcaauagccaaucaagccgcuguccugauggggcuaggcaagggcuggccccugcaccgcauggaucugggcgugccccugcuggccauggggugcuauagccaggucaauccuacgacgcugaccgccucccuggucauguugcuaguucacuaugccaucauuggaccggggcugcaggccaaagcgacccgagaggcccagaagagaacggccgccggcaucaugaagaacccaaccgucgacgggaucaccguuaucgaccucgagcccaucagcuacgacccgaaguucgagaagcagcugggccaagugauguuguuaguccugugcgccgggcagcugcuacugaugaggacuacgugggcguucugcgagguauugacucucgcuaccggaccuauacugacucugugggagggaaacccgggucgcuucuggaacaccaccauugccgugucaaccgccaacaucuuucggggaagcuauuuagcuggggcgggccuggccuucuccuuaaucaagaacgcccagacgccucggagagggacgggcaccaccggggagacacucggcgaaaaauggaagcgccagcugaacucucuagaccgaaaggaguucgaggaguacaagcgguccggcauccucgaaguugacaggaccgaagccaagagcgccuugaaggacgggagcaagauaaagcacgcgguaagccgcggguccagcaagauccgguggaucguggaacgcgggauggucaagcccaagggcaaggugguggaccuggggugcggccgcggcggguggaguuacuauauggcuacgcuuaagaacgucacugagguaaagggguacacgaaggguggcccugggcacgaggagccaauccccauggccaccuacggcuggaaucuggugaagcugcacuccggugucgacguuuucuacaagcccacggagcaaguggacacacuccugugcgacauaggggagucauccagcaacccgacgaucgaagaggggcguacccugagggucuuaaaaaugguggagcccuggcuguccagcaaacccgaguucuguaucaagguauugaacccauacaugccgacggucaucgaagagcuugagaagcuccagcggaagcauggaggcaaccucgugcgcugcccccuguccagaaauagcacccaugagauguacugggucuccggcgcaagcgggaacaucguuucaucggucaauaccacgucaaaaaugcuccugaaccgcuucacgaccaggcaccgcaagcccaccuaugagaaagacguugaccugggcgcuggcacucgcagcgugucgaccgagacagaaaaacccgacaugaccaucaucggccgcaggcuacagcgccugcaggaagagcacaaggagacuuggcacuacgaccaagaaaaccccuaccggacgugggccuaccacgggagcuacgaggccccgaguaccggcagcgcauccagcauggugaacggggucgucaagcuguuaacuaagccaugggacgugaucccgauggucacucaauuggcaaugacggacaccacgcccuuuggucaacagcguguguucaaggagaagguugauacucggacgccucagcccaaacccgguacccgcauggucaugaccacaacggcaaauugguugugggcccuccuagggaagaagaagaacccgcgguuguguacccgcgaggaguuuaucagcaagguccgguccaacgccgcgaucggggccguguuccaggaggagcagggguggacaagcgcgucagaggccgucaacgacagccgcuucugggagcucguggauaaggagcgagcacugcaccaggaaggcaagugcgagucaugcguguauaauaugaugggcaagagagagaagaaacugggggaguucggcagagcuaaggggagccgggcgaucugguauauguggcucggggcgcgauuccuggaauuugaagcccugggguuccucaacgaagaccauugguucggccgggaaaacuccugguccggcgucgagggggagggucuacaucgccuuggguacauccucgaggagaucgauaagaaggacggugaccucauguaugccgacgacacugccggaugggacacgcggaucaccgaggaugacuugcagaaugaagaguuaaucaccgagcagauggcaccgcaccauaagauacuggccaaggccauuuucaaguugaccuaucagaacaaggugguaaagguccuccgccccaccccccggggggccgucauggacaucaucucccgcaaagaccagcgugguucuggucagguaggcacguacggucuuaauaccuucaccaacauggaaguccagcugauccgccagauggaagccgagggcgugaucacccaagacgacaugcagaaccccaagggccucaaggagaggguugaaaagugguuacgcgagugcggggucgaccgacuaaagcgaauggcgaucuccggggaugacugcguugugaaaccacucgacgaacgguucgggacgagccuguuguuccucaacgauaugggcaaggucaggaaggacaucccccagugggagccuuccaaggguuggaagaacuggcaggaggugcccuucugcagccaccacuuccacaagauauuuaugaaggacggccggucccuugugguacccugucgcaaccaggacgaacugauaggccgagcacgcaucagccagggugccggcugguccuugagggaaaccgcuugucuggguaaggcguaugcgcagauguggucgcucauguacuuccaccggcgcgaccuaagacuggccagcauggccaucugcuccgccguucccaccgagugguucccuacgucucgcacgacgugguccauccaugcccaccaccaguggaugaccaccgaggauaugcugaagguguggaaccgggucuggaucgaggacaacccgaauaugauugacaaaacuccagugcauagcugggaggacauccccuaccucggcaagcgcgaggaccuguggugcggcagucuuaucgggcucagcucccgcgcuaccugggccaagaauauccacaccgccaucacccaagugcgcaaccuuaucggcaaggaagaguacguagacuauaugccuguuaugaagcguuacucugccccaucugagagugagggggugcuguga

SEQ ID NO: 26253 - RNA, 9867 nt, Artificial Sequence
  derived and/or modified CDS sequence (opt11) from DENV-4__FJ882596__SS-prME
ucgaccauaacccuacuaugccuaauacccacagugauggcuuuccaccucagcacccgagacggggaaccuuuaaugaucgucgcaaaacacgaacgcggacgcccguuacuauucaaaacuacagaaggcauuaacaaaugcacccugauagccauggaccucggcgaaaugugugaggauaccguuacauacaaauguccccuccuaguaaauacugagccugaagacauagauuguuggugcaaucuuacuagcaccuggguuauguaugggacaugcacucaauccggagagcgcagaagggaaaaacgcucagucgcccuaacaccccacaguggcaugggccucgaaacacgggcugaaacauggaugucaagugaaggggcguggaaacaugcccaacgaguagaaucguggauacuaaggaauccgggauucgcccugcuagccgguuucauggcauacaugaucggacaaaccggcauccagagaacagucuucuucguacuaaugaugcuagucgcuccaagcuacggcaugagaugcguuggagucggcaaccgagacuuuguugaaggaguaucaggcggggcguggguugaccugguccucgaacacggaggaugcgugacgacgauggcucaggguaaacccacacucgauuuugaacugacaaaaacgaccgcaaaggaaguagcgcuacuccgcacauacugcaucgaagcgaguauauccaauauaacgacugcgacgcggugcccuacacagggugagccauaccuaaaagaggagcaggaccaacaauacaucugccgaagagacgucgucgacagaggauggggcaacggguguggucuauucgguaaagggggugugguaacaugcgcgaaauucagcugcagcggcaagauaacggggaaucucguacagauugaaaacuuagaguacaccguaguugugacgguacacaacggggacacccacgcaguaggaaacgacacguccaaucacggaguaacagccacgauaacaccucgaucacccagcguggaggucaaacugccugacuacggggaacucacguuagauugcgaaccccggagcggcaucgacuucaacgaaaugauuuugaugaaaaugaagaaaaagacuuggcuaguccacaaacaaugguuccuagaucuaccgcucccauggacagcuggagcagacaccuccgaaguccauuggaauuacaaagagaggaugguaaccuucaagguaccgcacgcaaagcgccaagacgugacaguccuggggagccaagaaggagcaaugcauagcgcacuggccggcgcaaccgagguagauucgggcgacggaaaccacauguucgcagggcaccugaagugcaaaguacgaauggaaaagcuccggauaaaaggaaugagcuacaccaugugcagcgguaaguucaguauagacaaagaaauggcagaaacccagcacggcacgacaguagugaaggucaaauacgagggcgcaggcgcaccuugcaaaguacccauagaaaucagagacguuaacaaagagaagguagugggccgggugaucucgucaacgccgcuugcagaaaauaccaauuccgucaccaacauagaacuagaaccaccguuuggggacagcuauauugugaucggaguggguaacagugcccucacacuccacugguuuaggaagggcucgaguaucgggaaaauguucgaaaguacguacagaggagcgaagagaauggcaauacuuggagaaacugccugggauuucggaagcgugggugggcuauucacaagccuuggcaaagccguccaccagguguuugggaguguauacacaaccauguucggaggcgucaguuggaugauacggauacugaucgguuuccugguacuguggauugggacaaauuccagaaacacauccauggccaugacauguaucgcaguaggagggaucacguuauuccucggcuucaccguacaagcagacaugggcugcguggucuccuggagcgggcgggagcuuaaaugcggguccggcaucuuuguaguagauaauguccauacguggaccgagcaauacaaguuucaaccagagagucccgccagacuggcuuccgcgauccugaaugcccacaaagacggcguguguggaaucaggagcacuacacggcucgagaacgucauguggaagcaaauaacaaaugagcucaacuacguccuaugggaaggcggccaugaccuaacagucgucgcgggagacgugagaggagugcuaacgaaagggaaacgagcgcuaacacccccagugucugaucucaaguacucauggaaaaccuggggcaaagccaaaaucuucacccccgaagcccggaauagcacguuucucauagacggccccgacacuuccgaaugcccaaaugaacgaagggcguggaacagccuagaaguggaggacuacggauuuggaauguucacgaccaacauauggaugaaauuccgggaagggucuucagaaguaugcgaucacaggcugaugucugcggcuauaaaagaucagaaggcagugcacgcggacaugggcuauuggauagaauccagcaaaaaucagacauggcagaucgaaaaggcuucccugaucgaagucaaaaccugccuguggccaaaaacacacacccuuuggagcaacggaguccucgagucacagaugcuaauaccuaagucguacgccggcccuuucagccagcacaacuaccgucagggauaugcgacccagacggucgggccauggcaccugggaaaguuggaaaucgacuucggggaaugcccagggacgacagugaccauccaagaggacugugaccacagaggcccaucacuaagaacaacaaccgccucuggaaaacucguuacccaaugguguugcagaagcugcacaaugccacccuuaagauucuuaggagaagaugggugcugguacgggauggaaauccgcccuuuaucagagaaggaagaaaauaugguuaaaagccaagucgccgccggacagggcaccagcgagaccuucuccaugggacuauuaugucucaccuuguucguagaggaaugccuacgacgcaggguaacgcgaaaacacaugauucuagccguaguuaucacacuaugcgcaauaauucuuggcggauugacuuggauggacuuacuccgggcucucaucauguuaggagacacgaugaguggccgaaucggagggcagacacaccuugcuauaauggcuguuuucaaaaugucuccaggcuacguguugggaguauuuuugcguaaacucaccagccgagagaccgcccucauggucauaggcauggcgaugaccaccacgcucucaauaccacacgaccucauggagcuuauugacggaaucucuuugggccucauacuccucaagauagugacacaauucgacaacacacagguagggacccuggcucucucgcugacauucaucagaagcaccaugagucucgucauggcguggcgaacaaucauggcuguacuguucguaguaacccucaucccucuaugccguacguccugcuugcaaaaacagagucacuggguugaaaucacugcgcucauacuuggggcccaagcgcugcccguguaccuuaugacacugaugaagggagcgagucgucgauccuggccacucaacgaagggaucauggccgucggacucguaucacuacugggcucagcgcuguuaaagaacgacguacccuuagcaggcccaaugguggcuggaggccugcuauuggcagccuacgucaugagcgguaguagugcggaccugagucucgaaaaggcugcgaaugugcagugggacgaaauggccgacauuacagggucgaguccaaucauagaaguaaaacaagacgaggacgggagcuucagcauccgagacguagaagaaaccaauaugauaacacuccuagucaaacuagcgcuaaucacuguguccggcuuguacccacuggcuaucccagucacgaugacuuugugguauauguggcagguaaaaacgcaaaggucuggcgcauuaugggauguaccaagcccugccgccacccagaaagccgcgcucucagaaggagucuaccgaauaaugcaaaggggacuauuugguaagacucaaguaggcguagggauacacauggagggaguguuccacacuauguggcauguaacgaggggcagugucaucugucaugaaaccggccggcucgaaccaucuugggcagacguacgaaaugacaugaucucauacgguggaggauggcgccuaggggacaaaugggauaaagaggaagacguacaaguccuggcaauugaaccggggaaaaaccccaaacacguucaaaccaagcccggacucuucaaaacacuuacgggggaaaucggagcaguaacccuagauuucaaaccggguacgagcgggaguccaauaauuaacagaaaaggaaaaguaauagggcuauacggaaacggaguggucacgaaaucaggcgacuaugugucagccauaacacaggccgagaggaucggagagccagauuacgaaguagacgaggacauauucagaaagaagcgacuaacaauaauggacuugcaccccggagccgguaaaacgaaacgaauccuccccagcaucgugcgugaagcccuaaaaaggcgcuugcguacccucauacuagcccccacacgaguaguagccgcggaaauggaagaagcccugcgaggacucccaauccguuaucagacacccgccgugaaaagcgaacacacuggacgagaaaucgucgaccuaaugugucaugcgacauuuaccacgcgauuacucagcaguaccaggguaccaaacuacaaccuaaucguuauggaugaagcucacuucaccgacccuuccucggucgcggcucgaggauauaucucuacccggguggagaugggggaagcggcagcgauauuuaugaccgcgaccccgccuggagcgacggacccguucccacaguccaacucgccaaucgaggacauugaacgagaaauccccgaacgaagcuggaacacgggguucgauuggauaacggacuaucagggcaagacaguuugguucgugccaagcaucaaagccgggaaugacaucgcaaacugccuccgcaaaucagggaagaaaguaauccagcuaucgcgcaaaacauucgacaccgaguacccuaaaacaaagcugacagauugggacuucgucgucaccacggacaucagugagaugggcgccaacuucagagcgggccgaguuauagacccccgccgcugccucaaaccggugauccuaaccgaugggccagaaagggucauacuggccggaccgauucccgugacccccgcgagcgcagcccagaggcgcggacggaucgguaggaacccugcacaagaagacgaccaauauguguuuagcggagacccccucaagaacgacgaagaucacgcacacuggacugaagccaaaauguuacuagacaacauauacacaccugagggcauaauuccaacacucuucggccccgaacgagaaaagacacaggcgaucgacggggaguuucgguuacgaggcgaacaaagaaagacguuuguagagcucaugcggaggggcgaucugccgguauggcuaagcuauaagguggcaucagccgggauauccuacaaagauagggaguggugcuucacaggggaacggaacaaucaaauccuggaggaaaauauggaaguagaaaucuggacacgggaaggagaaaagaagaaacuacgaccccgguggcuagacgcgcgcguguacgcagacccgauggcccuaaaagacuucaaagaguucgcaagcggaaggaaaucuauaacccuggauauucucacagaaauagccagcuuaccaacguaucuaucuucgcgcgccaaacuagcuuuagacaacauaguaaugcuacacaccaccgaacgaggaggccgagccuaccagcacgcgcucaacgagcuacccgagucacucgagacacuaaugcugguagcacuccucggcgcaaugaccgcgggcauuuuccuauucuucaugcaagggaagggcauaggaaaacucuccaugggucucaucaccauagccgucgccucgggccuacucugggucgccgaaauccagccacaauggaucgcggcgucgaucauacuagaauuuuucuuaaugguccuacuaauaccugaacccgaaaaacagcggacgccacaagacaaccaauuaaucuaugucauacuaacgauauuaacuauaaucggccuaauugccgcuaaugaaauggggcucauagagaaaaccaaaacggacuuuggauucuaccagguaaagacagagacaacaauacuggacgucgaccuccggcccgccagugccuggacacucuacgcgguggcaaccacgauccuaacucccauguugaggcacaccauagaaaacacgagcgcaaauuugagucuggcagcaaucgcgaaccaagcagcgguucuaaugggucucggcaagggguggccccugcaucgcauggauuugggcgugccgcucuuggcuauggguugcuacucucaggucaaucccacaacccuaaccgcaagucucgucaugcugcugguacacuacgccaucauaggacccggccugcaagcuaaagcgacacgagaagcucagaagagaaccgcagcaggcauaaugaagaacccgaccgucgacggaaucacggucauagauuuggagccgaucagcuacgacccuaaguucgaaaagcaacucggacaaguaaugcuucuaguccugugcgccggccagcuccuccugaugagaaccaccugggcauuuugugagguacucacccuagcuacaggcccaauacucacgcuaugggaagggaauccuggcagguucuggaacacaacaauagcagugagcacagcaaacaucuuccgaggaucauaccucgccggcgcaggacuggcguucucccucaucaaaaacgcccagacaccuaggagaggcacagggaccacaggggaaacccucggagaaaaauggaagcggcagcucaacagccuagaucgaaaagaguucgaagaguauaaacgauccggcaucuuagagguggacaggacagaagcaaaguccgcucucaaagauggaucgaaaauaaaacacgcagucucccgagguuccaguaaaauccgauggauagucgagcgaggcauggugaaacccaaaggcaaaguaguggaccucggcugcggacgagguggauggagcuacuacauggccacgcugaagaacguaacagagguaaaaggcuacacaaaagggggacccggccacgaagaacccauaccgauggcaaccuauggauggaaccuaguuaagcugcacucuggcguugacgucuucuauaagccaacagagcaaguagacacgcuccucugcgacauaggcgaaagcucgagcaaccccacaaucgaagaggggcggacucuucgagugcucaagaugguagaaccauggcugagcuccaagcccgaguucuguauaaaaguacuuaacccauacaugcccacaguuauagaggaacuagagaaacuucaaaggaaacacggagggaacuugguacggugcccccuuagccggaacagcacacacgaaauguacugggugucaggggccuccggcaauauagucagcuccguaaacaccacaucaaaaaugcuacugaaccgguucaccacgcgucaccgaaagccgacuuaugaaaaagacguagaccugggugcgggaacacgaucagugaguacugaaacagaaaaaccagacaugaccaucauaggacgacgccuucagagacuacaagaggaacacaaagagacauggcacuacgaccaagagaacccauaucgaaccugggcauaccacggcucuuacgaagcacccucgaccggguccgcgagcucgauggucaacggcgucgugaaacuacucacgaaaccgugggaugucaucccgaugguaacacaacuagccaugaccgacacgacacccuuuggccaacagcggguguucaaagaaaaaguagacaccaggacaccccaaccuaagcccggaaccaggaugguaaugacaaccaccgcaaacuggcugugggcccuccuaggcaagaagaaaaacccaaggcucugcacgcgcgaagaguuuauaagcaaaguucgaucgaacgccgcaaucggcgcagucuuccaggaggagcaagguuggacgucagcuagcgaggcggucaaugacucacgcuuuugggagcuggucgacaaggagagagcguugcaccaagaagggaaaugcgaauccugcguauacaauaugaugggcaagagagagaagaaacugggagaguuugggcgggccaagggcucgagagcgaucugguacauguggcuuggagcacgcuuccucgaauuugaagcucuaggcuuuuuaaacgaagaucacugguucgggcgcgagaauagcuggucgggcgucgaaggagaaggacuacacaggcuggguuauauacuagaagaaaucgauaagaaagauggcgaccucauguacgcagacgauacggcaggcugggacacuagaaucaccgaagacgaccuccaaaacgaggaauuaaucacugaacaaauggcgccacaccacaaaauacuggcaaaggcgauuuucaaacucaccuaccagaacaagguugucaagguuuuacgccccacaccccggggagcagugauggacauaaucagcaggaaagaucagcggggaaguggacagguagggaccuacggccuaaacaccuucaccaauauggaggugcaguuaauuagacagauggaggcagaaggagucauuacccaggacgacaugcaaaacccaaaaggacucaaggaaagaguagaaaaauggcuccgcgaauguggagucgauagguugaaaagaauggcuauaagcggggacgacugcguagucaaaccgcuggaugaaagguuugggacgagccuccuauuucugaacgacauggguaaggucagaaaggacauaccacagugggaaccaucgaagggauggaaaaacuggcaggaagucccauuuuguagccaucacuuccacaaaaucuuuaugaaagacggccgaagucucguaguacccugcagaaaccaggaugagcuaaucgggagagcacgaauaagccaaggcgcaggauggagccuuagggaaacagccugccucgguaaggccuacgcccagauguggagccuaauguacuuccaucgucgcgaccucagacuagcgucgauggcaaucugcagcgcggucccgaccgaaugguuccccaccucccguaccaccugguccauacacgcccaucaccaauggaugaccacggaagauaugcucaaaguguggaaccgugucuggauugaagacaaucccaacaugaucgacaaaacgccuguucacucaugggaagacauccccuaucuagguaagcgcgaggaccucuggugcggaucauugaucgggcucuccucccgagcaaccugggccaagaacauacacaccgcaaucacgcagguccgcaaccucaucgguaaagaagaguauguagacuacaugcccguaaugaagcgguauagugcuccuucagaaucggaaggggugcuauga

SEQ ID NO: 26254 - RNA, 9867 nt, Artificial Sequence
  derived and/or modified CDS sequence (opt11) from DENV-4__FJ850059__SS-prME
ucaacgaucacacuacuauguuuaauucccacaguaauggcauuccaccucucaacccgggacggcgaaccuuuaaugaucguggcgaaacacgaacgcggaagaccucugcuauucaaaacgacagaagggaucaacaaauguacccugauagccauggaccucggagaaaugugcgaagacacggugaccuacaaaugcccccuccuagugaacacggaaccggaagacaucgacugcugguguaaucucaccaguacauggguuauguaugggaccugcacacagaguggagaaagacgacgcgaaaaacguaguguugcauuaacaccgcacucagggaugggacuggaaacgagggccgaaacguggauguccagcgaaggcgcauggaaacacgcccaacgcguagaguccuggaucuuaagaaacccaggauucgcacuccuagccggauucauggcguacaugaucggucagacgggaauccaaagaacgguguuuuucguacucaugauguuaguagcuccgucauacgggaugagaugugugggaguggggaaucgggacuucguagaggggguuagcgggggcgucuggguugaccuagucuuagaacacggcggaugcgugacaacaauggcacaaggcaaaccuacuuuggacuucgagcuaaccaagacaaccgcaaaagagguagcgcuccugagaacauauugcaucgaggcaucaaucaguaacaucaccacagcaacgcggugccccacacaaggugaaccguauuuaaaggaggaacaagaccagcaguacauaugucgaagggacgugguagaccguggauggggaaacggaugcggucuguuuggaaaaggaggcgugguuacaugcgcuaaauucagcugcagcgggaaaauaacaggcaaccuaguacaaaucgaaaaucucgaauacacggucguggugacagugcacaauggagacacccacgccguggguaacgacaccuccaaccacggggugacggcaacaauuaccccaagaucuccgagcguagaaguaaaacuaccggauuacggagaacuaacacuggacugcgagccccggagcggaauagauuucaacgagaugauacugaugaaaaugaagaagaaaacguggcuggugcacaaacaaugguucuuggaccuaccccucccguggacagcgggcgccgacacaucggaaguccacuggaacuacaaagagaggaugguaacguuuaaagugccccacgcuaaacggcaagacguaaccguccuagguucgcaagaaggugccaugcacagcgcgcucgcaggagcaaccgaaguggacucaggagacggaaaccauauguucgccggacaucuaaaguguaaaguuagaauggagaagcucaggaucaaggggaugucuuauacaaugugcagugggaaguucucaaucgacaaagagauggcugagacacaacacgggacgacuguggucaaaguaaaauacgaaggagccggugcgcccuguaaaguaccgauagaaaucagagaugugaacaaagagaaaguagugggacgaguaaucucgucaaccccucuugccgagaacacaaacucaguaaccaacaucgagcuagagccacccuuuggcgacaguuacaucgucaucggggucgggaauagcgcauugacacuccauugguuucgaaaggggagcucaauaggcaagauguucgaaucaacguacaggggcgccaagcguauggcgauucugggagagacagcaugggacuucggaagcguaggaggacucuucacaucacuaggcaaggccguccaccaggucuucgggucgguguacacaaccauguucgggggaguaagcuggaugaucaggauacuaaucggguucuugguauuguggaucggaacaaauucccguaacacaagcauggccaugaccuguauugcaguuggugggaucacccuauuccugggcuuuaccgugcaggcggacauggggugcguagucucuuggaguggcagggaguugaaauguggcuccgguaucuucgucguagacaacguccacaccuggacagagcaguacaaauuccaaccggagucacccgcucgacuagcgucugcgauccuaaucgcccacaaagacggagugugcggaaucagguccacaacgagacuugaaaacgucauguggaagcagaucaccaacgaguuaaacuacguacugugggaagggggacaugauuugaccguaguagccggcgaugccaaggguguucugacaaaaggaaaacgggcacuaacaccaccagucagcgaccucaaguacagcuggaaaacuuggggaaaagcgaaaauauuuacacccgaggccaggaacagcacauuccugaucgauggaccagacacuagcgaaugcccaaacgagcgccgagcuuggaacagccucgaagucgaggauuacggauucgguauguucacgacaaacaucuggaugaaauucagggagggaaguagcgaaguaugcgaccauaggcucaugagcgcggccauaaaagaccaaaaagcgguacacgcggacaugggauauuggauugagagcucaaagaaccagacguggcaaauugaaaaggcuucgcuaauagaagugaaaacaugucucuggccaaaaacacauacgcuguggucgaacggcguccucgaaucacaaaugcucaucccaaagaguuaugcgggcccauucucacagcacaacuaucggcaaggcuaugcaacacagacagucggucccuggcacuuaggcaagcucgaaaucgauuucggcgagugccccgggacaaccgucacgauacaggaggacugugaucaccggggcccaucacucagaacgacuacagccucgggcaagcuaguaacccaauggugcuguagaagcugcaccaugccacccuuacgguuccuaggagaggacgggugcugguauggcauggaaauaagaccccugagugagaaggaagaaaacauggucaaaagccaagucaccgcggggcagggaaccagcgaaacuuuuucgaugggcuuacuaugccucacgcuauucguagaggaaugucuaagacgaaggguuacacguaaacacaugauccuugcggucgugauaacccuaugcgcgauaauacugggcggacuaacuuggauggaccuauugcgagcgcuaaucaugcugggagacacgaugucuggaaggaucgggggacaaacccaucucgcaauuauggcagucuucaagaugucgccgggguauguccuaggcguauuucuccggaaacugacgaguagagagacagcacuaauggucaucgggauggccaugacaacgacgcuaagcaucccccacgaccucauggaacucaucgacggcaucucucugggauuaauccuauugaagauaguuacccaauucgauaacacccaagucgggacgcuagcgcucagccucacauuuauccgaagcacgaugucauuagucauggccuggagaaccauaauggccguccuauucgugguaacacucauaccacuaugcagaacgagcugccuacagaaacaaagccacuggguagaaaucacagcgcugaucuugggcgcacaagccuuacccguauaccugaugacacuaaugaaaggagcuagcagaagauccuggccauuaaacgagggaauaauggcggugggccucgugagccuacuugguagugcccuucucaaaaaugacguuccccuagccgggccaaugguagcagggggccuccuucucgcggcauacguaaugucgggguccucggcggaccugagucuagaaaaggcugcaaauguccaaugggacgagauggcggacauaacagggagcagcccgaucaucgaggucaaacaggacgaggaugggagcuucucaauacgcgacguggaagaaaccaacaugauaacacugcuagucaaacuggccuuaauuaccgugaguggacucuacccacuagccauaccagucacaaugacacugugguacauguggcaaguaaaaacucagcggagcggagcgcuaugggacgugcccaguccugccgcuacccagaaagccgcacuuuccgaggguguauaucgaaucaugcagcgcggacucuucgggaagacacagguugguguaggaauacacauggaaggaguauuccacaccauguggcacgugacgcgaggcucggugauaugucaugaaacgggccgcuuagaaccguccugggcagacgugcgcaacgacaugaucucuuacggaggaggcuggcgacugggugacaaaugggauaaggaagaggacgugcagguacuagcaaucgagcccgguaaaaacccaaagcacguccagacgaagccaggcuuguucaaaacacuuacgggagaaauuggcgccgucacgcucgacuucaaaccaggaacaucgggaagcccgauaauaaaucgaaaaggcaaagucaucggucuguauggcaacgggguggugacgaaauccggagacuacguaagugcgaucacccaggcugaacgaaucggagagccugacuaugaaguagacgaggacauuuuccguaagaaacgccucacgauaauggaucuacaccccggcgcgggcaagacgaaaagaauacuaccaagcauaguucgcgaagcacuaaaaagacgacugcgaacccucauacucgcgccgacccguguggucgcggcugagauggaggaagcccuacgcggucucccaauaagauaccaaacaccagcagugaaaagcgagcacacuggccgagagaucguagauuuaaugugccaugcuacuuucaccacucgcuuacuauccucgacacgagucccaaauuauaacuugauagugauggaugaagcgcacuucacagacccaagcucggucgcggcgcgcggguacaucucuaccaggguagaaaugggagaggcagcagcaaucuucaugacagccacaccuccgggggcgacagacccguucccucaauccaacucuccaauagaagacaucgaaagagaaauacccgaacgcaguuggaacacggguuucgauuggauuacagacuaccagggaaagaccgucugguuuguaccgagcauaaaagcuggcaacgacauagcgaacugcuuaaggaaauccggaaagaaaguaauucaacucagccguaaaacguucgauacggaauaccccaaaaccaaacugaccgauugggacuucgucgucacaacggacaucagugagaugggcgccaacuucagagccggccgcguuauagacccaagaaggugcuuaaagccggucauccucacagauggacccgagcgagugauacuggccgguccaaucccgguaacaccagcaagcgcagcacagcgaagagggaggauuggccgaaaccccgcacaagaagacgaucaauacguguucagcggggacccgcuaaagaacgaugaagaccaugcccacuggacagaggccaagauguugcuggacaacauuuacacgccagagggcauaaucccaacucuauucgggccggagcgcgagaaaacucaggcuauugacggagaguucagauuaaggggugagcaaagaaaaacguuuguggagcuaaugaggcgcggugaccuaccagucuggcuuucauauaaaguagcaucagccggcauuucauacaaagaccgagaguggugcuucacaggggagcgaaacaaccaaauacuggaggaaaacauggagguugagaucuggaccagagaaggggagaaaaagaaacuuagaccacgauggcuagacgcacgcguguacgcugauccuauggcgcuaaaagauuucaaagaguucgcgaguggaaggaaaaguauaacucucgacauacucaccgagauugcuucccucccgacguaccuguccagucgagcgaaacuagcacuagacaauauaguaaugcuucauacgacagagcgaggcggccgcgcguaccaacacgcguugaaugaacuaccggagagccuagagacacugaugcucguggcgcugcugggagcgaugacugcagguauuuuccuguucuucaugcaagggaaaggaaucggcaagcucucaaugggauuaauaacaauugccgucgcaucuggauuauuauggguggcggagauccagccucaauggauugcugccucaauaaucuuagaguucuuucucauggucuugcucauacccgaaccagagaaacaacgaacaccacaggacaaccagcuuaucuacguuauacucacgaucuugacgaucaucggccuaauugcagcgaaugagauggggcuaauugagaagacaaaaaccgacuucggguucuaucaagucaagacggagacaacuaucuuggacguagaucuacggccggcgucagcauggacgcucuacgccguagcaacaacuauacugacuccaaugcuaaggcacacuauugaaaacacaagcgcgaaccuaagccuagcagccaucgcgaaucaggcagccguauuaauggggcuaggaaagggauggccacuacauaggauggauuuggggguaccucuacuggccaugggcugcuacucccaaguuaauccuacuacacugacggcaucgcuggugaugcuccuaguacacuaugcuauuaucggcccaggccugcaggcuaaggcgacccgggaggcacaaaagagaaccgccgcgggaauaaugaagaaccccaccguggacggcaucacagugaucgaucuggaacccauaagcuaugacccuaaauucgagaagcaacucggccaagucaugcuacucgugcucugcgccggccaacuccugcugaugaggaccacaugggccuuuugcgaaguguuaacgcucgcuaccggaccaauacucacccugugggaaggaaacccaggaagauuuuggaauacgaccaucgccguaagcacagcuaacaucuuccgaggaagcuacuuagcaggggcgggacuagcuuuuucacucauaaagaacgcgcaaacuccccgaagggguacaggcacgacaggugagacucuuggagaaaaauggaaacggcaacugaacucgcucgacagaaaagaauuugaagaauacaagagaagcggaauacucgaaguagaccggacagaagcgaaaagcgcccucaaagacggcagcaaaauuaaacacgcagugucucguggguccucaaaaauacgguggaucguugaaagaggcaugguuaaacccaaaggaaaggucguagacuuggggugugggcggggaggauggagcuacuauauggcaacccucaagaacgugacggaaguaaaaggauacacaaaagggggccccggccacgaagaaccuaucccaauggcaacauacggauggaaccuuguuaaacuacauagcggagucgacguuuucuacagacccaccgaacaaguggacacccugcuuugugacauaggggagagcucgagcaauccuacgauagaagagggacggacgcucagaguacugaaaaugguugaaccguggcuguccagcaagcccgaguucugcauaaaaguacuaaacccguacaugccgacgguaauagaagaauuggaaaagcuccagagaaagcacggugggaaccucguacgauguccacuaucgcggaacuccacacacgaaauguauugggugucuggugcaagugguaauaucguaagcucagugaacacgacaucaaaaaugcuacuuaaucgauucaccacacgacaucguaaaccaaccuaugagaaggauguagaccuaggugcgggcacacggagcgucagcacagaaacggagaagcccgauaugacaauaauaggucgcaggcuccaaaggcuacaagaggaacauaaagaaaccuggcacuacgaccaggagaacccguacagaacgugggcguaccacgggagcuaugaggccccgucuaccggcuccgcaaguucgaugguaaacggaguggugaaacuccuuacgaaaccgugggaugucauaccaaugguuacucaacuagccaugaccgacacaacaccauucgggcaacagcgggucuucaaagagaaaguggacacccguacgccccagccaaaaccugggacucgcauggucaugacuacuacugcaaacuggcuuugggcccuauuagguaagaaaaagaauccgcguuuaugcacccgcgaggaguucauaaguaagguccgaucuaacgcagcaaucggugcaguauuccaagaagaacagggauggacaagugccucagaagccguuaacgacagccgguuuugggaauuagucgacaaagagcgagcauugcaccaagaaggcaaaugugaaucauguguguacaacaugaugggaaaacgcgagaagaaacucggcgaguucggacgcgcgaagggaagcagagcaaucugguacauguggcucggcgcuagauuccuggaguucgaggcauuaggauuccuaaaugaggaccacugguuuggucgcgaaaacucuugguccggcguggaaggggaggggcugcacagacuaggcuauauuuuagaagagaucgacaagaaagacggcgaccuaauguacgcggacgacacggcaggcugggacacccgcaucacagaagacgaccugcagaaugaggagcuaauaacggaacagauggcuccccaccacaagauccuggcuaaagcaauuuucaaacuaaccuaccaaaacaaagucgucaagguccuacgacccacgccccgcggggcggugauggacauuauaucgcggaaagaccagcggggaagcggucagguggggaccuacggauugaacaccuucacaaacauggaaguucaacugauccggcaaauggaggcugaaggaguuauuacucaagaugauaugcaaaaucccaaaggucucaaagaacgugucgagaaguggcucagggaauguggggucgauagacugaagaggauggccauaucgggugacgacugcguuguaaaaccccuggacgaacguuucggcaccagccuccuauuuuuaaaugauaugggcaaaguacguaaagacauaccacaaugggaaccgagcaagggcuggaagaacuggcaagaaguuccguucugcagccaucacuuccauaaaauauuuaugaaggacggcagguccuuagucguaccgugucggaaccaggaugaacugaucggucgcgcccgcaucagccagggggcgggauggucacugcgggaaacugcgugccuggguaaggcguaugcgcaaauguggagcuugauguacuuccaccgcagagacuuaagacucgcaucaauggccaucuguagcgcggucccaaccgagugguuuccaaccucccggaccacuuggucaauacacgcccaccaccaguggaugacaacugaagacaugcugaaaguauggaaucggguguggauagaagacaaucccaacaugauagacaaaaccccaguccacuccugggaagauaucccguaccuagggaaaagagaggaccuuugguguggaagccuaauaggacuaucgucacgcgcgacaugggccaagaacauccacacagcaauaacacaggugcgaaaccugauagguaaagaagaguauguugacuauaugcccgucaugaaaagauacagcgcgcccagugaaagugaaggcguacuauaa

SEQ ID NO: 26255 - RNA, 9867 nt, Artificial Sequence
  derived and/or modified CDS sequence (opt11) from DENV-4__FJ882598__SS-prME
ucgacgaucacccugcucugccugauacccaccgcgauggcuuuccaccuguccacccgcgacggugagccccucaugaucguggcgaagcacgagcgggggcgcccccugcuguuuaagaccacggagggcauuaacaagugcacguugaucgcuauggaccucggugagaugugcgaggacaccguaaccuacaagugcccccugcucgugaacaccgagcccgaggacauagacugcuggugcaaccugaccagcaccugggucauguacgggaccuguacccaguccggggagaggcgccgggagaagcgcagcgucgcccuaacgccgcacuccggcauggggcucgagaccagggcggagaccuggaugucguccgagggggccuggaagcacgcgcaacgcguugagagcuggauuuuacggaaccccggcuuugcguugcucgcuggguucauggcuuacaugauuggucagaccgggauacagcgcacgguguucuucguucugaugaugcugguggcgcccuccuauggcaugaggugcguaggcgucgggaaccgcgacuucguggagggcgugagcgggggcgcguggguugaccucgugcuggaacauggcgggugcgugacgaccauggcccaggggaagcccacgcuggauuucgagcugacgaagaccaccgccaaggaggucgcccuucugcggacguacugcaucgaggcguccauaagcaacaucaccacugccacccgcugcccgacgcagggcgagcccuaccucaaggaggagcaggaccagcaguacaucugccggcgcgacgugguggaccggggcugggguaacggcugcgggcuguucgggaagggcgggguggugacgugcgcaaaguucuccugcagcgggaagaucaccggcaaucucgugcagaucgagaaccucgaguacaccgucguggugaccguccacaacggugauacgcacgccgugggcaacgacaccagcaaccacggugucaccgcaaccaucacuccccgcagccccuccguggaagucaagcugccggacuauggcgagcugacccucgacugcgagccccggagugggauagacuucaacgagaugauacugaugaagaugaagaagaagaccugguugguacacaagcagugguuccucgaccugccccugcccuggaccgcgggcgccgacaccuccgagguacacuggaauuacaaggagcgcauggugacguucaaggucccccacgccaagcggcaggacgugaccgugcucggaagccaggagggcgccaugcacucggcccucgcgggcgccacugagguagacuccggggacggcaaccacauguuugccgggcacuuaaagugcaaggugcgcauggagaagcuccgcaucaagggcaugaguuacaccaugugcuccgggaaguucagcaucgacaaggaaauggcagagacgcagcacgggaccaccguggucaaagugaaguacgaaggcgccggggcgcccugcaaggugcccaucgagauccgggacgucaacaaggagaagguaguggggagggucauuuccagcacccccuuggccgagaacaccaacuccgugaccaacauagagcuggagccgcccuuuggggacuccuauaucgugaucggcgucgguaacagugcccucacccuccacugguuccguaaggggagcuccaucggcaagauguucgagagcaccuaucgcggggccaagcggauggcgaucuuaggggaaacggccugggauuucggcucagugggaggacucuucaccaguuugggcaaggccgugcaccagguauucggcuccguguacacaaccauguucgggggcgugagcuggaugauccgcauccugaucggguuccucguccuauggaucgggacgaacucccggaacaccuccauggcaaugacuugcaucgcggugggcgggauuacccuguuccuaggcuucacagugcaggcggauaugggaugcgucgugucauggagugggcgcgaacucaagugcggcagcggcaucuucgugguagacaacgugcacacauggaccgagcaguacaaguuccagcccgaaucgcccgcccggcuggccagcgccauccuuaacgcccacaaggacggcguguguggcauccgcuccacaacgcggcucgagaaugucauguggaagcagaucaccaacgagcugaacuacgugcugugggagggcggucacgaccucacggugguugcgggggacgugaagggcgugcugaccaaggggaagcgggccuugacgccgcccgucagcgaccucaaguacucguggaagaccuggggcaaagcgaagaucuucacccccgaggcccggaacagcaccuuccugauugaugggcccgacacguccgaguguccgaacgagcgccgagccuggaacagccuggaaguugaggacuacggcuuugggauguuuacgaccaacauuuggaugaaguuucgcgagggcuccagcgagguaugcgaccaccgguuaauguccgcggccaucaaggaucaaaaggccguccacgccgauaugggcuacuggaucgagagcagcaagaaccagacguggcaaaucgagaaggcgagccugaucgaggugaagacgugccuguggccuaagacgcauacccucugguccaacggggugcuggagagccagaugcugaucccgaaaagcuacgccggcccguucagccagcacaacuacaggcagggguaugccacacagaccgucggacccuggcaccucgggaagcuggagaucgacuucggagagugccccggcacuaccgucaccauccaggaagacugcgaccaucgggggcccaguuugcgcaccacgaccgccagcggcaaguuagugacccaguggugcugccgcucaugcaccaugccgccucugcgguuccugggggaggacggcugcugguacgggauggagauucgcccucuuuccgagaaggaggagaacauggucaagagccagguugcugcgggacagggcacguccgagaccuucagcaugggacugcugugccucacccuguucguugaggaaugucugcgccgccgggugacgaggaagcacaugauucucgccguggucaucacgcugugcgccaucauccugggugggcucacauggauggaccuccugcgggcgcucaucauguugggcgacaccaugagcggccggaucggagggcagacccaucuggccaucauggcgguguucaagaugagucccggguacgugcugggcgucuuccugcggaagcugacgucacgugagaccgcccucauggugaucggaauggccaugaccaccacccugagcaucccccaugaccugauggagcucaucgacggcaucucccugggccugauccuacugaagaucgugacacaguucgacaacacccaggucgggacccuggcccucucccugacguucauccgauccacgaugagccuggugauggccuggcgcacaaucauggcggugcuguucgucgugacccugaucccccucugccggacauccugccuccagaagcaaagccacuggguggagaucaccgcccugauacugggcgcccaggcccuaccugucuaccuaaugacacugaugaagggcgcguccaggcggaguuggccccucaacgaaggcauaauggccguggggcugguaucccugcucggcagcgcacuucugaagaacgacgucccccucgcaggccccauggucgccgguggccuccuucucgcggccuacguuaugucagggucuagcgccgaccugucccuggagaaggccgccaacguccagugggacgagauggcggacaucaccggcagcucccccaucaucgaagugaagcaagacgaggaugggagcuucuccauccgcgacguggaggagacuaacaugaucacccucuuagucaaguuagcccucaucacagugagcggccuauacccccuugccaucccggugaccaugacgcucugguacauguggcagguuaagacccagcgguccggagcucugugggacgugcccagccccgccgcuacucaaaaggccgcccuguccgaggggguguacaggaucaugcagcggggccucuucggcaagacacaggucggugugggaauccacauggagggcguauuccauaccauguggcacgucacgcgcggcagcgugaucugccacgagaccgggcggcuagagcccuccugggccgacgugcgcaacgacaugauaagcuacggcgggggcuggcgccugggcgacaaaugggacaaggaggaggacguccagguauuggccaucgagcccgguaagaacccuaagcacguccagaccaaacccggguuauucaaaacccugacgggggagaucggcgcagucacucucgacuuuaagccggggacauccggcagucccaucaucaaccgaaagggcaaggugaucggguuguacggcaacgggguggucaccaaguccggcgacuacgugagcgccaucacucaggccgagaggauuggggagcccgacuacgagguggacgaggacaucuuccggaaaaagcgccucacaauaauggaccuccaccccggcgcuggcaaaaccaagcggauccugccguccaucguccgcgaggcgcugaagcggcgccugcgaacccucauccuggccccgacgcgcgugguggccgccgaaauggaggaggcccugaggggccuccccaucagauaccagacccccgcggucaaaagcgagcacaccggccgugagaucguagaccugaugugccacgccaccuucacgacgcgccugcucagcucgacccggguaccgaauuacaaccugaucgucauggacgaggcccacuucaccgaccccagcuccguagccgcccgaggguauaucagcacgcgggucgaaaugggggaggcggcggccaucuucaugaccgccacaccacccggggccacagacccauucccccagucuaacagccccaucgaggauaucgagagagagauccccgagcgaucuuggaacacgggauucgacuggauaacggacuaccaggguaagaccgugugguucgugccgucgaucaaagcggggaaugacauugccaacugucugcgcaaguccggcaagaaggugauccaacucucuagaaaaaccuucgacacggaguaccccaagaccaaacugaccgacugggacuucguggugaccacggacaucuccgagaugggagccaacuuccgggccggccgcgucaucgacccccggcgcugccugaagcccguuauccucacggacgggccggagcggguaauccuggcaggucccauccccgucacucccgccagcgccgcccagcgcaggggccgcaucgggcggaacccagcccaggaggacgaucaauacguauucuccggggacccccugaagaacgaugaggaccacgcgcacuggaccgaggccaagaugcugcuggauaacauuuacacacccgagggaaucauccccacccuguucggcccggagcgcgagaagacccaggccaucgacggcgaguuucggcuccgcggggagcagcggaagacauucguggagcugaugaggcggggcgauuuacccguguggcucagcuacaagguggccuccgccgggaucuccuacaaagaccgcgaguggugcuucacgggagagcggaacaaccagauucuggaggagaacauggagguggaaaucuggacucgggaaggggagaagaagaaauuacggccccgcuggcucgacgcgagagucuacgccgaccccauggcccugaaggacuucaaggaguucgccuccgggagaaagagcaucacccuggacauucucaccgaaauugccucccugccgaccuauuugagcagccgcgcgaagcucgcccuggacaauauugugaugcuccacacgaccgagagaggcgggcgcgccuaccagcaugcucucaacgaauugcccgagucccuggagacccucaugcugguggcgcugcucggggccaugacugcggguaucuuucuguucuucaugcaaggcaaggggaucggcaagcugagcaugggccucaucaccaucgccgucgccuccgggcugcuguggguggcagagauccagccacaguggaucgccgccaguauuauccucgaguucuuccugaugguguugcucaucccggagcccgagaagcagcggacaccccaagauaaccagcucaucuacgucauacugaccaucuuaacgaucauaggccugauugccgccaacgagaugggguuaaucgagaagacgaagaccgacuucggcuucuaccaagugaagaccgagaccacgauucucgauguggaccugagacccgccuccgcguggacacuguacgccgucgccaccacuauccucaccccgauguugcggcacaccauugagaacacaagcgcaaaccugagucucgcggcuauagccaaccaggccgcagugcugauggggcugggcaagggcuggccccuccaccgcauggaccugggggugccccuucuagcuaugggcugcuacagccaggucaaccccaccacgcuuaccgccucccuggugaugcugcucgugcacuacgccaucauagggccgggacugcaggccaaagcgacacgggaggcgcagaagcggaccgccgccgggaucaugaagaacccuacgguagauggcauuaccgugaucgaccuggagcccauaucauacgaccccaaguucgagaagcagcugggccaggugaugcugcucguccugugugccgggcagcugcuccuaaugcggaccaccugggcguucugcgaggugcugacgcucgcuacgggcccaauccucacccugugggaggggaaccccggccgcuucuggaacaccacaaucgccguguccaccgcuaacauuuuccggggcagcuaccucgcaggggcgggccuggccuuuucccuuaucaagaacgcccaaacaccccgccgggguaccggcacgaccggggagacacucggugagaaauggaagcgccagcuaaauucucuggaucggaaggaguucgaggaguacaagcgcaguggcauccucgaggucgaccggaccgaggcuaagucagcgcugaaggacggguccaagaucaagcacgcggugagccgcggcuccucaaagauccgguggauuguggagcgcggaauggucaaacccaagggaaaagugguggaccuggggugcggcaggggcggguggagcuacuauauggccacuuuaaagaacguaacggaggugaagggcuacacaaaagggggcccgggccacgaggagcccauccccauggccaccuacggcuggaaccuggugaagcugcacuccggcgucgacguauucuacaaacccaccgaacagguggacacgcuccugugcgauauuggggagucauccagcaacccaacuauagaggagggacggacccugcgcguccucaagauggucgagcccuggcuguccagcaagccagaguucugcaucaaggugcugaaccccuauaugccuaccguuauagaggaguuagagaagcuccagcggaagcacggagggaaccuggugcggugcccccuguccaggaacagcacgcacgaaauguacugggucucuggcgccagcgggaacaucguguccuccgucaacacaaccaguaagaugcuccugaaccgcuucaccacgcggcaccgcaagcccaccuacgagaaggacgucgaccugggagcggggacccggagcguguccaccgagacggagaagcccgacaugaccaucauaggccgucggcuccagcgccugcaggaggagcacaaggaaaccuggcacuacgaccaggaaaauccuuaccggacaugggccuaccacgggagcuacgaggcccccuccacgggcuccgccuccuccauggugaacggcgucgucaagcugcucaccaaacccugggacgugaucccaauggucacgcagcuggccaugaccgacacgacccccuucgggcagcagcgcguguucaaggaaaagguagacacccggacaccccaacccaagccggguacgcgcaugguaaugacaaccaccgcgaacugguuaugggcacucuuagggaaaaagaagaauccccgacugugcacgcgcgaggaguucauuagcaaggugcgguccaacgccgcuaucggcgccguguuccaggaggagcaaggguggaccagcgcguccgaggccgucaacgacucacgcuucugggagcucguggacaaggagcgggcccuucaccaggagggcaagugcgaguccugcguguacaacaugaugggcaaacgcgaaaagaagcuaggggaguucggcagagcuaaggggagccgggccaucugguacauguggcucggcgcucgcuucuuggaguucgaggcccugggguuccucaacgaggaccacugguucggucgggaaaauucguggagcggggucgaaggggagggccugcaccgucucggguacauccucgaggagaucgacaagaaggacggcgaccugauguacgccgacgacacagccggcugggauacgcggauuacggaggacgaccugcagaacgaggagcucauuacggagcagauggcgccucaccauaagauccuggccaaggcgaucuuuaagcugaccuaccagaauaagguggugaagguccuccgccccaccccgagaggggccguaauggacaucauuucucguaaggaccagaggggcucaggacagguggggaccuaugggcugaacaccuucaccaacauggagguccagcugauccgccagauggaggccgagggcgugaucacccaggacgacaugcagaaccccaagggccucaaggagcgaguggagaaguggcugcgagagugcgggguagaccggcugaagcgcauggcgaucuccggcgacgacugcguggugaagccccuagacgagcgguucgggacgagcuugcuauuccucaacgacaugggcaaaguccgcaaggacauuccucagugggagccguccaagggguggaagaauuggcaagagguacccuucugcagccaccacuuccauaagauauuuaugaaggacggccggagcuuagugguccccugucgcaaccaggacgagcugaucggccgggcgcgcaucagucagggggccggcuggucacugcgcgagaccgcuugcuugggaaaagcguacgcacaaauguggagccugauguacuuccaccggcgcgaucuccgguuggccagcauggccauuuguuccgccgugcccaccgagugguucccuaccagcagaaccacgugguccauccacgcccaucaccaauggaugacgaccgaggacaugcugaagguguggaaccgcgucuggaucgaggacaacccuaacaugaucgauaagacccccgugcacagcugggaggacaucccauaccucgguaagcgcgaagaccuauggugcggguccuugaucggacucagcucccgggcgacgugggccaagaacauccacaccgccaucacucagguacgcaaccuuauuggcaaggaggaauacgucgacuacaugccggugaugaagcgguacucugccccguccgagucagagggggugcuauga

SEQ ID NO: 26256 - RNA, 9867 nt, Artificial Sequence
  derived and/or modified CDS sequence (opt11) from DENV-4__FJ882601__SS-prME
agcaccaucacacugcugugccugauucccacugugauggccuuccacuuaucgacccgcgacggagagccccucaugaucguggccaagcacgaaagagggcgcccccugcuguucaagaccaccgagggcaucaauaagugcacccucaucgccauggaccucggggaaaugugcgaggauaccguuaccuacaagugcccccugcucguuaacacugagcccgaagacaucgacuguuggugcaaucugaccucaaccugggugauguacgggaccugcacacaguccggggagcgacgcagagaaaaacgcaguguggcccugaccccgcauuccgggaugggccucgaaacccgggccgagacauggaugagcagugagggggccuggaagcacgcccagcguguagaaagcuggauccugcggaaucccgguuucgcgcugcucgccggguucauggccuacaugaucggucagaccgggauccagcgcaccguauucuuuguucucaugaugcugguggcccccuccuacggcaugcguugugugggggugggcaaccgcgacuucguggagggcguguccgggggcgcguggguggauuuggugcuggagcacggcgguugcgucacuaccauggcgcagggcaagcccacccuggacuucgagcucacgaagaccaccgccaaggagguggcccugcuucggacuuacugcaucgaggccuccaucaguaauauuacaaccgcgacacgcugcccgacccaaggcgagcccuaccucaaggaggagcaggaucaacaguacaucugccgucgcgacguaguggaucgggguugggggaacggcugcggccuguucgggaagggggggguggugaccugcgcgaaguucuccugcagcggcaaaaucaccgggaaccugguccagauugagaacuuagaauacaccguuguggucacuguacacaacggcgacacccaugccgucggcaacgacaccuccaaccacggggugaccgcaaccauaacgccucgcagccccuccguggaggucaaacucccggacuacggcgagcugacacucgacugcgaaccccgaucagggaucgauuuuaaugagaugauucugaugaagaugaagaaaaaaaccugguuagugcacaagcaaugguuccucgaccugccuuugcccuggaccgccggcgcggauaccuccgaaguccacuggaacuacaaagagcgcauggucacauuuaaggucccgcacgccaagcggcaggacgugaccguccuggggagccaggagggcgccaugcacucagcauuggccggcgcgaccgagguggacaguggggacggcaaccacauguuugccggucaccugaagugcaagguccgcauggagaagcuacgcauaaaggggaugagcuacaccaugugcucagggaaguucagcauagacaaggagauggcagagacgcagcacgggaccaccgucgugaaggucaaguaugagggcgccggggcccccugcaagguccccaucgagauccgggacgugaacaaggagaagguggugggucgcguuauauccagcacgccguuagcggagaacacgaauucggugaccaacaucgagcuggagccgccauucggggacagcuacaucgucaucggcgucggcaacuccgcccucacgcugcacugguuccggaagggaagcuccaucggcaagauguucgagucuacauaccgcggggccaagcggauggcgaucuuaggcgagacggcgugggacuucggguccgugggcggccuguuuaccucucuggggaaagccguucaccaaguguucggcuccguguacacaaccauguuugggggaguaagcuggaugauucgcauccucaucggguuccucguacuguggauugggacgaauucccggaacacgagcauggcaaugacgugcauagcagugggcgggaucacccuguuccugggcuuuacgguccaggccgacauggggugcgugguguccuggagcgggcgcgagcucaagugcgggagcgguauauuugucguugauaaugugcacacauggacggagcaauacaaauuucagcccgagucccccgcucggcuggccagcgcaauccuaaacgcccacaaagacggcgucugcgggaucagguccaccacgcgguuggagaacgugauguggaagcagauaacgaacgagcugaauuacgugcugugggagggcgggcacgaucucaccgucguggcgggcgacguaaaagguguccuaacgaaggggaagcgcgcgcugaccccuccggugucagaucucaaauacuccuggaagaccuggggcaaggccaaaauuuucacccccgaggcacggaacucaaccuuucugaucgaugggccugauacguccgaguguccgaacgaacgcagggccuggaacagcuuagaaguggaggacuacggauucgggauguucaccaccaauaucuggaugaaguuccgcgagggcuccagugaggugugcgaccaccggcucaugagugccgcuaucaaagaccaaaaagccguucacgcagacaugggauacuggaucgagagcuccaagaaucagaccuggcagauagaaaaggccucacuaaucgaagugaagacgugucuguggcccaagacccacacgcucuggucuaaugggguccuggagucacagaugcucauccccaaguccuaugcgggcccguucucgcagcauaacuaccgccagggauacgccacacaaaccgugggcccguggcaccucgguaagcuggagaucgacuuuggcgagugccccggcacaaccguuaccauccaggaggacugcgaccaccgggggccaagccugaggaccacgaccgcguccggcaaguuggucacucaguggugcugccgcagcuguacaaugccgccacugcguuuccugggggaggacggaugcugguacgggauggagauucgucccuuauccgagaaggaggaaaacauggucaaaucacagguugccgccggccagggcacauccgagaccuucagcaugggguuacuuugccuuacccuguucguagaagagugccuacggagaagagugacucguaagcacaugauacuugcagucgugaucacgcugugugccauuauccugggcgggcucaccuggauggaccugcugcgggcucucaucaugcugggagacaccauguccggccgcaucgggggccaaacccacuuggccauaauggccguguuuaagaugucccccggguacguacucggcguguuccugcggaagcugacaagucgcgagaccgcauugauggugaucgguauggccaugaccaccacgcugagcaucccucacgaccugauggaacucaucgacggcauaucccuuggccugauacuccugaagauagucacccaguucgacaacacccaggugggcacccuagcacucucccugacguucauccgcuccacaaugagccuggugauggccuggcgcaccaucauggccgugcucuucguggucacccugaucccccugugccgcaccagcugccuccagaagcagagccacugggucgagaucaccgcgcugauccugggcgcccaggccuugcccguguaccucaugacauuaaugaagggggccucccgccggagcuggccucucaacgagggcaucauggcggucgggcuggugucccugcucggcucggcccugcugaaaaaugacgugccgcuggccgggcccaugguggccggcggucugcugcuggcagcguacgucauguccgggaguagcgccgaucugucccuagagaaagccgccaacgugcagugggaugaaauggccgacaucaccggcagcucucccauuaucgaggugaagcaggacgaggacgggagcuucaguauacgcgacguggaagagacgaauaugauaacccuauuggugaaacuugcgcucauaaccgugagcggccuauacccgcuggccauccccgucacaaugacguuaugguauauguggcagguuaagacgcagagauccggcgcgcucugggacguuccaagucccgccgccacacaaaaggcggcccuguccgagggggucuaucgcaucaugcagcggggccucuuugggaagacccaagugggcguggggauccacauggagggcgucuuccacaccauguggcacgugacacgcggcagcgugaucugccacgagaccggacgucuggagccuuccugggccgacguucgcaacgacaugaucagcuacggcgggggguggcgacugggcgacaagugggacaaagaggaggauguucaggugcucgccaucgagccggggaaaaacccgaagcauguccaaaccaagccgggccuguucaagacgcugacaggggaaaucggcgcugugacccucgacuucaagcccggcacuuccggcucgccgaucguaaacagaaaagguaaggucaucggacuguacggcaacggggucgugaccaaguccggcgacuauguaucagcgaucacgcaggccgagcgcaucggcgagccagauuacgagguggacgaggacaucuuccggaagaagcgacucacuauuauggaccuccaucccggcgcugggaagaccaagagaauucugccguccauagugcgggaggcccuuaagcguaggcugcggaccuugauccuggcgcccacgcgcgucguggccgcugaaauggaggaggcgcugcggggccugcccaucagauaccagacgccggccgucaaaucugagcacacaggccgggagaucgucgaccugaugugccacgcgaccuucacaacccgccuucucagcuccaccagggugccuaauuacaaccugaucgucauggacgaggcccacuucaccgaccccagcucuguggccgcccgcggguacauuagcacgcggguggagaugggcgaggccgcggccaucuucaugaccgcuaccccgcccggagccaccgacccguuuccccaguccaacagccccaucgaggacaucgaacgcgagauccccgagcgguccuggaacacgggcuucgauuggaucacagacuaccaggguaagaccgucugguucgugccgagcaucaaggcagggaacgacaucgccaacugccuccgcaaguccggcaagaagguaauccaguuaagccgcaagaccuuugacacggaguaccccaagaccaagcugaccgauugggacuuugucgugaccacggacauuuccgagaugggggcgaacuucagggcaggccgcgugaucgacccccggcgcugucuuaagcccgucaucuuaaccgacgggccagagcggguuauccuggccggccccauccccgugacccccgcgagcgccgcccagaggcggggccgcaucggccggaaccccgcccaggaggaugaccaguacgucuucuccggcgauccccugaagaacgaugaggaccacgcccacuggaccgaggcgaagaugcuccuggauaacaucuacacccccgagggaauaauccccacccuguucgggccggaacgugagaagacccaagcuaucgacggagaguuucgguuacgaggggagcaacggaaaaccuucguggagcugaugcgccggggggaucugcccguguggcucucauacaagguagccuccgccgggaucagcuacaaggaccgggaauggugcuucacgggcgaacggaacaaccagauacuggaagagaauauggaaguagagauauggacacgcgagggugaaaagaaaaaacugcggccccgauggcuggaugcucggguguacgcugaccccauggcacugaaagacuucaaggaguucgcuuccggccggaagagcaucaccuuggacaucuuaaccgagaucgccucccuaccgaccuacuugagcucucgcgccaagcucgcucuugacaacaucgucaugcugcacacgaccgagagaggcgggcgcgcuuaccagcacgcccuuaacgagcuccccgaaucccuggaaacccucaugcucguagcccugcucggcgcuaugaccgcggggaucuuccuuuucuucaugcagggcaaagggauuggcaaacugagcauggggcucaucacgaucgccguggccuccgggcugcucugggucgcagagauccagccccaguggaucgcggccucgauuauccucgaauucuuccugauggugcugcucaucccggagcccgaaaagcagcggacgccccaggacaaucagcugauauacgucauacuggccauccucaccauuaucggccugauagccgcaaacgaaauggggcugaucgagaagacgaaaaccgacuucggguucuaccaggagaagaccgagacgaccauacucgaugucgaccugcgccccgcguccgccuggacgcuguacgccguggccacaaccauacucaccccgaugcugcggcacaccaucgagaacaccagcgccaaccugucccucacggcgaucgcgaaucaagccgcuguguuaaugggucugggcaagggcuggccacuccaccgcauggaccugggagucccgcugcuugccaugggcuguuacagccaggugaaccccaccacgcugaccgccucccuggugaugcuccugguccacuaugcaaucaucgggccgggcuuacaggccaaagccaccagggaggcucucaagcgcaccgcagccggcaucaugaaaaaccccacggucgacgggaucaccgugaucgaccuggaaccgaucagcuacgaucccaaguuugaaaaacaacugggccagguuaugcuccuggugcucugcgccggucagcuccugcugaugcgcaccaccugggccuuuugcgaggugcucacgcuggcuaccggaccgauccugacucucugggaggggaaccccggaagguuuuggaacaccacgaucgccguguccaccgcaaauaucuuucggggcagcuauuuggccggggccggccuagcguucucccucauuaaaaacguacagacaccucggagggggaccggcacgaccggggagacccugggcgagaaauggaagcgccagcugaacagccucgaccggaaggaauucgaagaguacaaacgguccggcaucuuggaaguggaccgaaccgaggccaaaagcgcccugaaggacggcucuaaaauaaagcacgcggucagccgcgguuccuccaagauccgguggaucguggaacgcgggauggugaagccgaagggcaaggucguggaccucgggugcggccgcgguggguggagcuacuacauggccacacugaagaacgugacagaggucaagggauacaccaagggugggccggggcacgaagagcccauaccuauggcgacguacggauggaaccuagugaagcuccacuccggcguggacgucuucuacaagcccaccgagcagguagacacauuacugugcgacauaggggagagcuccagcaacccgacgauugaggagggccggacccuccgggugcugaagaugguugagcccuggcuguccucuaagccagaguucugcaucaaaguguugaaccccuacaugccgaccgucaucgaggaacuagaaaagcugcagcggaagcacgggggcaaccuggugcgcugccccuuguccagaaauagcacgcacgagauguacuggguguccggcgccagcggcaacaucgucucuagcgugaacaccaccaguaagaugcuacuaaaccgcuuuaccacacgacaccguaagcccacguacgagaaggacguggaccucggcgccgggacgcggucugucuccaccgagacagaaaagccagauaugaccaucaucggccgccggcugcagaggcuccaggaggaacacaaggagaccuggcauuacgaccaggagaacccguaccggaccugggccuaucacgguagcuaugaggcgcccucaacgggcucagccuccagcauggugaacggcgugguaaagcugcugaccaaaccaugggaugugauuccgauggugacacagcuggccaugacggacacgacucccuucgggcagcagagagucuucaaggagaagguggacacccggacgccccaacccaaaccgggcacacgcaugguaaugacgacuaccgcuaacuggcucugggcccuguuaggaaagaaaaagaaccccagacucugcacgcgcgaggaguucaucagcaaggugcgguccaaugcagccaucggcgccguguuccaggaggagcagggguggaccagcgccuccgaagccgugaacgacucucgcuuuugggaguuggucgauaaggagcgggcacugcaccaggagggcaagugcgagucuugcguguacaacaugaugggcaagcgcgagaagaaacucggggaauucggcagggccaaggggucacgggccauuugguacauguggcugggcgcccgcuuccuggaguucgaggcccucggauuccugaacgaggaccacugguucggcagggagaacucuuggagcggaguggaaggggagggcuugcaccgccucggauacauacuggaggagauugacaagaaagauggugaucugauguaugcggacgauaccgccggcugggacacaagaaucacggaggacgaccuccagaaugaggaacuggugaccgagcagauggcuccccaccacaagauccuggcuaaggcgaucuucaagcucaccuaccagaauaagguggugaagguccugagacccaccccgcgcggggccguaauggacaucaucucccgcaaggaccagcggggcagcggacaggucggcaccuacgggcugaacacguucaccaacauggagguccagcugauccgccagauggaggccgagggggugauuacccaggacgauaugcagaaccccaaggggcugaaggagcggguggagaagugguugcgcgagugcggggucgaucggcuuaagcgcauggccauuaguggggacgacugcguggugaagccgcuggaugaacgguucgggaccagccuccuguuccuuaaugacauggggaagguccgaaaagacauuccccaaugggagccguccaagggguggaagaacuggcaggaggugccuuucuguagccaccauuuccacaagaucuucaugaaggacggacggucacuggugguccccugccgcaaucaggacgagcucaucggcagggcccgcaucagccagggcgccggcuggucccugcgcgagacggcauguuugggcaaggccuaugcccaaaugugguccuuaauguacuuccaucggcgcgaucugcggcuugccagcauggcaauaugcuccgccguucccaccgagugguuccccaccagccgcaccacgugguccauccacgcccaccaucaguggaugaccaccgaggacaugcuuaagguguggaaucggguguggaucgaggauaaccccaacaugauugacaagacccccgugcacagcugggaggacauccccuaccuaggcaaacgugaggacuuauggugcgguucccucaucggcuuaagcucccgggcaacgugggcgaagaacauccacacggcgaucacccaggugcgcaacuugaucggcaaagaggaguaugucgacuacaugccaguaaugaaaagguacagcgccccaucagagagcgaggggguucucuga

SEQ ID NO: 26257 - RNA, 9867 nt, Artificial Sequence
  derived and/or modified CDS sequence (opt11) from DENV-4__FJ226067__SS-prME
ucgaccaucaccuuauugugccugauacccaccgugauggccuuccacuuguccacccgggacggugagccauuaaugauuguugccaagcacgaacgggggcggccccuguuguucaagaccaccgaggguaucaacaagugcaccuugaucgccauggaccugggggagaugugcgaggacaccguuacguauaaguguccccugcucgugaauaccgagcccgaggauaucgacugcuggugcaaccugaccucgaccugggugauguacgggacuugcacucaauccggugagcgacgucgggagaagcguucuguggcucugaccccucacucggggauggggcucgagacgcgggccgagaccuggaugagcuccgagggagccuggaagcacgcccaacguguggagucuuggauccugcggaacccaggcuucgcucugcuugccggauuuauggccuacaugaucggccagaccgggauccagcgcaccguguucuucgugcuaaugaugcugguggccccauccuacggcaugcguugcgucggggucgguaaccgcgacuucguggagggcguuagcgggggcgcguggguggaccucgugcuggagcacggcgggugcgugaccaccauggcccagggcaagccgacccuggacuucgagcucacgaagacuacagcuaaggagguggcccugcugcggaccuacugcaucgaggcuuccaucagcaacaucacaaccgcgacccgcuguccgacccaaggugaaccauaccugaaggaggagcaggaccagcaguacauuugcaggcgagacguuguggaccguggcugggggaacggcugcggucuguucgggaagggcgggguggugacgugcgcgaaguuuuccugcagcgguaagauaacagggaaccugguccaaaucgaaaacuuagaguacaccguaguagucacugugcauaauggugauacgcacgccguagguaaugacacuuccaaccacgggguaacagccaccaucacuccccgcucacccuccguggagguaaaacuuccggauuacggagaauugacccucgacugugagccccggagcggaaucgauuucaaugagaugauccugaugaagaugaagaagaagaccugguuagugcacaagcagugguuccucgaccugccccugcccuggacagccggcgcggauaccuccgagguucacuggaacuauaaggagcgcauggugacguuuaaggugccucacgcaaagagacaagacgugacuguccucgggagccaggagggcgccaugcacagcgcccuagcuggcgcgacugagguggauuccggggacggcaaccacauguucgccgggcaccugaagugcaaggugcguauggagaaacuccgcauaaagggcaugagcuacaccaugugcucuggaaaguucagcaucgacaaagagauggccgagacgcagcaugggaccacggucgugaaggugaaguaugagggagcgggggcccccugcaagguccccaucgagauccgggacguaaacaaagagaaggucgucggccgcguuauauccuccacgccccucgcggagaauacgaacuccgugaccaacaucgaguuggagccgcccuucggcgauagcuacauagucaucggggugggaaauuccgcauugacacugcacugguuucggcgcgguuccuccaucggcaagauguuugaaucuacauaccgcggggccaagaggauggccauccuaggcgagacggcgugggacuucggaucagugggcgguuuguucaccagucucgggaaggccguccaccagguguucggcucaguguauaccacgauguucgggggagucucauggaugauacggauacugauaggguuucucgugcuguggaucggaacuaacucccgcaacaccucuauggccaugacuugcauaacagugggugggaucacgcuguucuugggcuucaccguccaggccgauauggggugcguggugucuuggucaggccgggaacuuaagugcgggagcggcaucuucgucguggauaacgugcacacauggaccgagcaauacaaauuccaacccgagucgcccgcucgccuggccucugccauccugaaugcccauaaagacggcgucugugggauccggucuacgacccgacucgagaacgugauguggaagcaaaucaccaacgagcuaaauuacgcccugugggagggaggacacgaccucacaguaguggcgggagacgugaaaggcgugcugacuaaggguaagagagcucugacuccgccugucagcgaccucaaguacucuuggaagacauggggcaaggcaaagauauuuacgcccgaggcccgcaacagcacauucuuaaucgacggccccgacaccuccgagugcccgaaugagcggcgcgcguggaacucucuagagguagaggacuacggcuucgggauguucaccaccaacaucuggaugaaauuccgggagggcuccagcgaagugugcgaucaccggcucauguccgcggcgauaaaggaccaaaaggccguacacgccgacaugggcuauuggaucgaaucuuccaagaaccagacuuggcagauagagaaggccagccuaaucgaagucaagaccugccuguggccuaagacccacacauuguggagcaacgggguucuggagucacagaugcugaucccuaaguccuaugcaggcccguuuagccagcacaacuaccgacagggguacgccacccagaccgucggaccauggcaccuuggcaaacuugaaaucgacuucggagaaugccccggaaccacagugaccauccaggaggauugcgaccaccgcgggcccucccuccgcaccaccaccgccuccggcaagcucgugacgcaguggugcugccgguccuguacgaugccgccccuuagauuccugggggaggacggcugcugguacgggauggagauucggccucucuccgagaaggaggagaacauggucaagagccaggugacugcaggccaggguacauccgagaccuucagcauggguuuacuuugccuaacacucuucgucgaggagugccugcgccgucgggugacccggaagcacaugauccucguugucgugaucacccugugcgccauuaucuugggcggacucacuuggauggaccugcugcgcgcgcucauuaugcugggcgacacgaugagcggcagaauagggggccagauccaccuggccaucauggcgguguucaagaugagcccaggauacguccucggcguguuucugaggaagcucaccucccgggagaccgcccucauggugaucgguauggccaugaccacgguccugagcauaccccacgaccugauggagcuaaucgacggcaucucccugggccucauuuuacucaagaucgucacccaguucgacaacacccaaguggggacccuggcucucagccugacguuuauucgcuccacaaugccccugguuauggccuggcgaaccaucauggccguccucuucguggugacauugaucccccugugccgcacgagcugcuugcagaagcagucccauuggguggaaauuacugcccugauccugggcgcgcaggcgcuccccgucuaccugaugacccugaugaagggggccagccggcguucuuggccccucaaugagggcaucauggccgucggguuagugagccuucucggcucggcacugcugaagaacgacgucccgcucgccgggcccaugguggccgggggcuugcugcucgccgccuacgugaugucuggcuccagcgcagacuugagccuggagaaggccgccaacguccagugggaugagauggccgacaucaccggguccucuccuauaauagaggucaagcaggacgaagauggauccuucagcauaagagacguggaggagacuaacaugaucacccuccucguaaaguuagccuugauuacugucuccggacuguacccgcuggccauucccgugacuaugacgcuaugguauauguggcagguuaagacacagcggagcggcgcucugugggacgugcccucacccgccgcgacccagaaggcagcccugagcgaggggguguaucggaucaugcagcguggccuauucggcaagacccagguuggcgucgggauucauauggagggcguguuccacacuauguggcacgugacgcggggaagugucauuugccacgagaccgggaggcuugagccgaguugggcggacgugcgcaacgacaugauauccuacggcggggguuggcgguuaggagacaagugggauaaggaggaggacgugcagguacucgccaucgaaccugggaagaaccccaagcacgugcagaccaagcccggacuguuuaagacgcuuaccggggagaucggggcggucacccuagacuucaagccggggacaagcggcucccccaucaucaacaggaaaggaaaggucaucgggcuguacggcaacggggugguaaccaagaguggcgacuaugucucugccauuacacaagccgaacggaucggugagcccgacuaugaaguggacgaggauaucuuccgaaagaagcgguugacgaucauggacuuacacccuggcgcgggcaaaacgaaaaggaucuuacccagcaucguccgggaggcccugaaacgcagacugaggacauuaauccuggccccuacgcgggucguagccgccgaaauggaggaggcccugaggggguugccaauccgguaucagacgccagccgucaaguccgaacacacaggccgagagaucgucgaucugaugugccacgccaccuucaccacucggcugcucagcagcacgcgcgugcccaauuauaaccugauugucauggaugaggcccauuuuacggauccaucaucaguugcagcccggggguacaucuccacgagaguggaaaugggcgaggccgcagccaucuucaugaccgcuacgccaccgggggccacagacccauucccccagaguaacagucccaucgaagacaucgagcgggaaauuccggagcgcagcuggaacacgggauucgacuggaucacagacuaccaaggcaaaacggucugguucgugccgucgauuaaggccgggaacgacaucgccaacugucugcgcaagagcggcaagaaagugauccagcugucccggaaaaccuucgacacggaguaucccaaaacuaagcugaccgacugggacuuugucgugaccacagacaucagcgagaugggggccaauuuccgugcgggacgggugaucgacccgaggcggugccugaagccggucauccucaccgacggacccgaacgggugauccuggcaggccccauuccggugaccccggccucugccgcccagcggcggggccggauaggucgcaacccggcccaagaagacgaccaguacgucuucaguggcgauccccugaagaaugacgaagaccacgcccacuggaccgaggcgaagaugcuucuggacaacauauauacgcccgaggggauuaucccgaccuuauucggcccagaacgggagaaaacccaggccaucgacggggaguuccgcuugagaggggagcagcgcaagaccuuuguggaacuuaugcggcgcggcgaucugcccguauggcuauccuacaaagucgcgagcgccgggaucucguacaaggaccgggaguggugcuucacgggcgagcggaacaaucagaucuuagaggagaauauggagguggaaaucuggacucgggaaggggagaaaaagaagcugcggcccagguggcucgacgcccgcguuuacgcggacccuauggcccugaaggacuucaaggaguucgcuucuggcagaaagucuaucacccuagacauacuuaccgagaucgccucgcugccgaccuaccugagcagcagggcgaagcucgcccuggacaacauugucaugcugcacacgaccgagcguggugggcgggcguaccagcaugcgcuuaacgagcugcccgagagucuggagacccucaugcuaguggcccuccucggcgccaugaccgccgggauuuuccuguuuuucaugcagggcaaggggaucggaaaauuaucuaugggccucaucgcaauugcaguggccagcggucugcuuugggucgccgagauccagccgcaguggaucgcggcuuccauaauccucgaguucuuucugaugguacugcuaauacccgagcccgagaagcagcgcacgccgcaagacaaucaacucaucuacguuauucugacaauccuaacgaucaucggccugaucgccgcaaaugaaauggggcugaucgaaaagaccaaaacggacuucggauuuuaccaggucaagaccgagaccacuauccuugacguggaccugcggccggccucggcauggacgcuguaugcugucgcgaccacaauccucacccccaugcugcgccacacgaucgagaauaccuccgccaaccugagccucgccgccaucgcgaaccaggcugcaguccugauggggcucgggaaaggcuggccucuucaccggauggacuuaggagugccccugcucgccaugggguguuacucccaggugaauccgaccacccugacggccagcuuggucaugcuauuggugcacuaugccauuaucgggccaggccugcaagccaaggcaacccgagaggcccagaagcguacggcggccggcaucaugaagaaccccaccguggacgggaucacagucaucgaccucgagcccaucucuuaugaccccaaguucgagaagcagcugggccaggugaugcuacucgugcucugcgccgggcagcuucuccucaugcguaccaccugggcuuuuugugagguccuaacccucgccacgggccccauacugacccuaugggaagggaauccuggccgguuuuggaacacgaccaucgcgguuagcacagccaacaucuuccggggcuccuaccuugccggggccggccuagccuucagccugaucaagaacgcacagacgccccggcgcgguacugggacaacgggggagacacucggcgagaaguggaagcggcagcugaacucacuugaccgcaaggaguuugaggaguacaagcgguccggcaucuuagagguggaccgcaccgaggccaaauccgccuugaaggacgggaguaaaauaaagcacgcggucucccggggcaguuccaagauccgcuggaucguagagcgcggcauggugaagccgaaggguaaggucguggacuuggggugcggccggggcggguggucguacuacauggcgacuuuaaagaacgugaccgaagucaagggcuacacgaaaggcgguccagggcacgaagaaccgauccccauggcgacguacggcuggaaccuuguuaagcugcacagcgggguggacgucuucuacaagcccaccgagcaggucgacacgcuccugugcgacaucggugaguccagcucaaaccccacgaucgaagagggccggacccugcgggugcuuaaaauggucgagcccuggcugagcagcaagccggaguuuugcaucaaggugcugaaccccuacaugccuacugucaucgaggaguuagagaaacuccagagaaagcacgggggcaaccuggugaggugucccuuaagccggaacuccacucacgagauguauugggucaguggagccuccgggaacaucgucaguuccgugaauacgaccucgaagaugcuccucaaucgguucaccacccgccaccggaagccgacguacgagaaggacguggaccugggugccggcacccgcuccguuagcaccgaaaccgaaaagccggauaugacgaucaucggucgccgccuccagcggcuccaggaggagcacaaagagaccuggcacuacgaccaggaaaaccccuaccgcacuugggccuaucacggguccuaugaggcgcccagcaccggguccgccagcagcaugguuaauggcgugguaaaguuacucaccaagccgugggaugugauucccauggugacccagcuggccaugacagacaccacgcccuucggacagcaacggguguucaaggaaaagguggacacgcgcacgccccagccgaagcccggcacccggauggucaugacgaccacggccaauuggcucugggcacuccuggggaagaagaaaaacccccgccuaugcacccgggaagaguucaucagcaagguacggucuaacgcugccaucggagccguguuccaagaagaacagggauggaccuccgccagcgaggccgugaaugacucccguuucugggagcucgucgauaaggaacgcgcguugcaucaggagggcaagugcgagucuugcguuuacaacaugauggggaagcgcgagaagaagcugggggaguucgguagagccaaggggucccgcgccaucugguacauguggcucggcgcccgauuccuagaguuugaggcccugggguuucuaaacgaggaccauugguucggccgagaaaacaguugguccggcguggagggcgagggccugcaccgucugggguacauccuugaggagaucgacaagaaggacggcgaccugauguacgcggacgacacagccggcugggauacgcgcauaacagaggacgaccugcagaacgaggagcucauaaccgaacaaauggccccgcaccauaagauccuggccaaggcuauauucaagcugaccuaccagaacaaggucgugaaggugcuucggccaacaccccgcggggccgucauggacaucaucucuagaaaggaccagcgcggcuccggucaggugggaaccuacgggcucaacacauucacgaacauggaggugcaacugauacgucaaauggaggcagagggagucaucacccaggaugacaugcagaaccccaaggggcuaaaggagcgcguagagaaguggcugcgugagugcggggucgaucgccugaagcguauggccaucagcggcgacgauugcgucgugaagccccucgacgaacgcuuugggaccucccuacuguuccucaaugacaugggcaaggugcggaaggauauuccacagugggaacccagcaagggguggaagaacuggcaagaggucccuuucuguucccaccacuuccacaaaauuuucaugaaagacggccgcucuuugguggugcccugccggaaccaggacgaacugaucggacgcgcccgcaucucccaaggggcgggcuggagcuuacgggagacagccugucuggggaaggccuaugcucagauguggucucugauguacuuccaccgccgagaucuccgccuggccuccauggccaucugcagcgccguccccacggaaugguuccccacauccaggacuacuugguccauucacgcccaccaccaguggaugacaaccgaagacauguugaagguguggaaccgcguuuggaucgaggacaaccccaauaugaccgacaagacccccguccacuccugggaggacaucccguaucucggcaaacgggaggaccuguggugcgggucccugaucggccuauccaguagggccacgugggccaagaacauacacaccgcgaucacccaggugcgcaaccugauuggcaaggaggaguacguggacuacaugcccgucaugaagcgcuacucggcgcucucggagucggagggggugcucuag

SEQ ID NO: 26258 - RNA, 9867 nt, Artificial Sequence
  derived and/or modified CDS sequence (opt11) from DENV-4__EU854299__SS-prME
ucaaccauaaccuugcucugccuaauacccaccgucauggccuuucaccucucgacacgggauggagaaccacuaaugauaguggccaaacacgaacgggggcguccucuuuuauuuaaaaccaccgaaggcauaaacaaaugcacguugauugccauggacuuaggggaaaugugugaagauacgguaacguacaaaugcccgcuacuugucaacacagaaccugaagacaucgauugcuggugcaaccuaacgucgacauggguuauguacggaacgugcacccaguccggcgaacgucggcgagagaaaagguccgucgcacugacuccccauucagggaugggccuggaaaccagagcagaaacauggauguccuccgaaggagcuuggaagcaugcccaacgagucgaaagcuggaucuuaagaaaucccggguucgccuuacuagcgggauucauggcauacaugauagggcaaacgggcauccaacgcacgguauuuuucguguuaaugauguuggucgccccgagcuacggaaugagguguguggguguuggaaacagagauuucguugaaggcguaagugguggggcuuggguagaccuagugcuagaacacggggguugcgucacgaccauggcccagggaaaaccuacgcucgacuucgaacuaacaaaaaccacagcuaaagaggucgcacuguugaggaccuacuguaucgaggcacuaaucagcaacaucacgacagcaacacggugcccuacccaaggagaacccuaccugaaggaagaacaggaccaacaguacaucuguaggcgugacguaguagaccgcggauggggcaacgguugcggccucuucggaaaaggcggcguaguaacuugcgcaaaauucucgugcuccgggaaaaucacagguaaccucguccaaauugagaaucuagaguauacaguagugguuacaguacacaacggcgacacacaugcgguagggaaugacacaucgaaccacggcguaacagcaacaauuacaccucggagcccguccguagaagucaaacugccagacuauggggaacugacacucgacugcgaaccacgaucagguauagacuucaacgaaaugauucuaaugaagaugaagaaaaagacguggcuaguacacaaacagugguuccuggaccuaccccuaccguggaccaccggggcugauaccuccgagguccacuggaacuauaaagaaaggauggugacguucaagguaccacaugcgaaaaggcaagacguaacgguauugggcagccaggaaggcgccaugcacagugcgcucgcgggcgcaaccgaaguggacuccggcgacggcaaccacauguucgccggacacuuaaaaugcaaagucagaauggaaaaguuacgaauuaaaggcaugagcuacaccaugugcagcggcaaguuuagcaucgacaaagaaauggcugaaacacagcacggaacgacaguagugaagguaaaguacgaaggagcgggcgccccgugcaagguccccauagaaauacgagacgucaacaaagagaaaguggugggaagagugauaucggccacaccccucgccgaaaacacgaauaguguuacuaauauugaacuugagccacccuucggugacaguuacaucgugaucggcguaggcaacuccgcguugacauuacauugguuuaggaaaggauccucgaucggaaaaauguuugaaucaaccuacagaggggccaaaagaauggccauacugggugaaacagcaugggauuuuggcucgguaggaggcuuguucaccucccuaggcaaagccgugcaccaaguauucggcaguguguauaccacaauguuuggaggggucuccuggaugauacgcauccucaucggauuucugguucuguggaucgguaccaacagccggaacacgucaauggcaaugacauguaucgcaguaggagggaucacgcucuuucucggguucaccguacaggcggacaugggaugcgugguuaguuggaguggacgggaacugaaauguggaagcgguauauucgucguagauaauguccacacguggaccgaacaguauaaauuccaaccagagagccccgcccgucuagcauccgcaaucuuaaacgcgcauaaagacggcguuugcgguauacguaguaccacacgacucgaaaacgugauguggaagcagauaacgaacgaauuaaacuaugugcugugggagggcggucacgaucuuacggucgucgccggagaugugaaaggugugcucaccaagggaaaacgcgccuuaaccccacccgccucugaccuaaaauauagcuggaaaacuuggggaaaagccaaaauauuuacacccgaggcccgcaacucgaccuuccucaucgacggacccgauacauccgaaugccccaaugaaagacgagccuggaacuccuucgaaguggaggacuacggcuucggcauguucacaacaaacauauggaugaaauuuagagaggggagcucagagguaugcgaccaccgucuuauguccgccgcaaucaaagaccaaaaagcaguacacgcagacaugggcuacuggauagaaaguucuaaaaaucaaacauggcagauugaacgagcaucacuaaucgaggucaaaaccugccuuuggccaaagacgcauacacuauggucaaacggcgucuuggaaagccaaauguuaauucccaaaagcuacgcggggcccuucucacaacauaauuaccgacaagguuaugccacccagacaguagguccuuggcaccuaggaaaauuggaaauagacuuuggugagugcccagguacgacagucacgauccaagaaaacugcgaccaccgaggaccaucucugagaacaaccaccgcuuccgggaaacucgugacacaguggugcugucggucgugcacaaugcccccucuccgauuccuaggagaagacgggugcugguacggaauggagauccgaccacuaucugaaaaagaagagaacaugguaaaaucccaaguuaccgcaggacaagggacaagcgagacguucuccaugggacuguuaugccucacgcuuuucgucgaagagugccuaagacggcgugucacgaggaagcacaugauccucgcggucguaaucacacuaugcgccaucauauugggaggacuaaccuggauggacuugcucagagcgcuuaucaugcugggcgacacaaugucaggacgcaucggaggccagacccauuuagcgaucauggccguauucaagaugagccccggauacguccuggggguauuuuuacgaaagcucaccucacgcgaaaccgcacucaugguaauuggcauggcaaugacgacgacgcucaguauaccacacgaucuaauggaacucaucgacggaaucucgcuaggacucauccuacugaagaucguaacgcaauucgacaacacccaaguggguacccuggcacuuucccugacauucauaaggucuaccaugucccuggucauggcguggcgcacgaucauggccguccuguucguuguaacacugauuccucuaugccggacaucgugccugcaaaaacaaucgcacuggguagaaauaacagcauugauauuaggagcccaggcauugcccguguaccucaugacccugaugaagggggcaucacgacguuccuggccccugaacgaaggaaucauggccgugggccucgugagccugcuaggcucggccuuguugaaaaacgauguaccacucgcgggucccaugguagcgggagggcuguuguuggccgcguacguuaugucagggagcucagcagaccucucgcuugaaaaagcggccaauguucaaugggacgagauggcggauauaacagggagcagcccuauaaucgaggucaagcaggacgaagacgggucauucucgauaagagauguagaggaaacgaacaugauaacgcucuuaguaaagcuagcccugaucacugugucagggcucuacccucuagcgaucccuauuacaaugacacuaugguacauguggcaggucaaaacucaaaggagcggagcgcugugggacgugccgucucccgccgccacccagaaggcagcauugagcgaaggcguauaccggaucaugcagagaggacucuucggaaagacacaaguuggcgugggcauccacauggaaggaguauuccacacaauguggcacgucacccgcggguccgugauuugccaugaaacugggcgauuagagccaaguugggcagacguccgcaacgacaugauaucguauggugguggcuggagacugggcgauaaaugggacaaggaagaagacgugcaaguacuggcaauagaaccaggaaagaaccccaaacauguucagaccaagccagggcuauucaagacauuaacgggcgagauaggcgcgguaacacuagacuuuaaacccggaaccucgggcuccccgaucaucaaucgcaaaggaaaggugauuggacucuacggcaacggcguuguaacgaaaaguggcgauuacguaagugcgauaacccaagcugaacggaucggcgagccagacuacgaaguggaugaagacauuuuccgcaagaagaggcuaacaauuauggaccugcauccgggggcuggaaaaacaaaacggauccuccccuccauaguaagggaggcacucaaacgcagauugcguacauugauauuggcacccacaagaguagucgcggcagaaauggaggaagcgcuaagaggacucccaauacgcuaccagacacccgcagucaaaucagagcauaccgggcgagagauuguagaccucaugugucacgcgacauucacuacacggcuauuaucauccacaagagucccaaacuacaaccucaucgugauggacgaagcucauuucacugacccguccagcguggcggcacgaggauauauuagcacccgaguagaaaugggagaagcagcugccaucuuuaugacugcaaccccucccggagccaccgauccguucccacaaucuaacucgccaauagaagacauagagcgcgagauaccugaacgaaguuggaacacagguuucgacuggaucacagacuaccaggggaaaacagucugguucgucccuagcaucaaagcgggaaacgauauugcaaacugccuacggaaaucggggaagaaaguaauacagcuaucgcggaaaacuuucgacacggaguacccaaaaacuaaacucacagacugggacuucgugguaaccaccgacaucuccgaaaugggggcuaacuuccgggcagggagagucaucgaccccagacggugccuaaaacccguuauccucacagacggacccgaacgggucauucuggcuggcccuauucccguaacucccgcaucagcggcacagcgacgcggaagaaucggacggaaucccgcacaagaagaugaccaauacguauucucgggggacccacuaaagaaugaugaggaccacgcucacuggacggaagcuaaaaugcuguuagacaacaucuauaccccugagggaaucaucccaacgcuuuucggcccggagagggagaagacgcaagcaauagacggagaguucaggcucagaggagagcaaaggaaaacguuuguggagcuaaugcggaggggugaccuacccguguggcugagcuacaagguagcaucggcaggcauuaguuacaaggaccgugaguggugcuucaccggggagagaaacaaccaaauccucgaggagaacauggaagucgaaauauggacccgagaaggcgagaaaaagaaacugagacccaaauggcuggacgcacggguguacgccgauccgauggcccugaaagauuucaaggaauuugcuuccggccgaaaaucaauaacauuagacauucucaccgaaaucgcgucacuacccacguaccuaaguucgagagccaaauuagccuuagacaacauagucaugcuccacacgacggaacggggcggccgagcauaccaacaugcccuuaacgaguugccggagagcuuagagacgcuaaugcucguagcccuccucggcgcgaugacagcuggcauauuucucuucuuuaugcaggggaaaggaauaggcaaauuaaguaugggguuaaucacgauagcuguagcaucaggcuuauuguggguagccgagauccagccgcaauggaucgcggcuucaauaauacuagaauuuuuccuaauggugcuacuaauaccggagccggagaagcaacgaacaccgcaggacaaccaacucauauacgucauccuuacgauacucaccauaaucggccucauagcagcaaaugagauggggcuaaucgagaaaacaaagaccgauuuugguuucuaccaggucaagacagagacgacuauccuggacguggauuugagacccgcgucggcuuggacacuguaugcgguagcaaccacaauucuuacgccgaugcuccggcauacuauagagaauacgucagcaaaccuaucguuagcggcaauagccaaccaggcagccgugcucauggggcucggaaaaggguggccccugcaccgaauggaccucggcgugccacuguuagccaugggauguuacagucagguuaaccccacaacucuuacagcaagccuggucaugcuccuaguccauuacgcaaucaucggcccagggcuacaagcaaaggcaacuagagaggcacaaaaacgcacugcagccgguauuaugaaaaacccgacaguggauggaaucacagugaucgaccuggaacccaucuccuaugaucccaaauucgaaaaacaauugggccaagucaugcuccugguucugugcgccggccaguuacuucuaaugaggacaacaugggcauucugcgagguucuaacgcuugcaacuggcccgauccuaacccugugggaaggaaacccgggaagguucuggaacacaacaaucgccguaucgacggcaaacaucuuccgaggaucauaccuagcaggagccggccuagccuuuucgcucaucaaaaaugcccaaacaccccgaaggggcacagggacgaccggagaaacccugggggaaaaauggaagcggcagcuuaacucgcucgacaggaaagaguucgaagaguacaaacgauccgggaucuuggaggucgaccggaccgaagcuaagagcgcccuaaaagacgguuccaagaucaagcacgcagucucgcgcggcucaagcaagaucagguggaucgucgaaagaggcauggugaagcccaaagggaaagugguagaucuugggugcggaagaggcgguuggagcuacuacauggcaacucucaaaaacguaaccgaagugaagggguacacaaagggaggacccggacaugaggaaccaauuccaauggcaaccuacggauggaaccugguaaaacuccacagcgggguggauguauuuuacaaaccaacugaacaagucgauacccuacucugugacaucggagaaagcagcagcaacccaacaaucgaagaagggcgaacacuacgcguauuaaaaaugguagagccauggcuguccucaaagcccgaguucugcauaaagguucucaacccauacaugccgacggugauugaggagcuugagaagcuacagcgcaagcauggcggcaaccuaguucgcugcccguuaucgcggaauagcacgcacgaaauguauugggucagcggggcgucagggaacaucgucucguccguaaacacuacauccaaaauguuacugaaccgcuucaccacaagacaccgcaagcccacauacgaaaaagacguggacuugggggcugggacacggagcgucuccacugaaacagaaaaacccgacaugaccaucauuggccgacgucuucaacgauugcaagaggaacacaaagaaacguggcauuacgaccaagagaacccguaucggacgugggcguaucacggaagcuaugaagcccccagcacuggcagcgcuagcuccaugguuaacggcguagucaaacuacugacaaaacccugggacguaauacccaugguaacucaacuugcaaugacagauaccacuccguucggccaacaaagggucuucaaggaaaaaguagacaccaggacaccacaaccaaaacccggcacacguauggugaugacaaccacagcgaauuggcucugggcgcuccucggcaaaaagaagaacccgcgccucugcacgagagaagaguucauaucgaaaguccgaagcaacgccgccauaggcgcaguguuccaggaggaacagggcuggacgagcgcuucggaagcggugaaugacucacgauucugggaacugguagacaaagagcgcgcuuuacaccaagaaggcaaaugcgaaagcugcguauacaacaugaugggcaagagagaaaagaagcucggcgaguucggaagggccaaaggcagcagggcaaucugguacauguggcuaggcgccagauuucuggaguucgaggcacucggcuuccugaacgaggaccacugguucggcagagaaaauagcuggucgggggucgaaggugaaggucuacaccgacuaggauauauauuagaagagaucgauaagaaagauggugaccuaauguacgcagacgacacagcaggcugggauacucggaucaccgaagacgaccuacaaaacgaggagcuuaucacagaacaaauggcaccccaucacaagauccucgcuaaagccauauucaagcugaccuaucaaaacaagguagucaaaguauuacgacccacaccccgcggggcaguaauggauauaaucagcaggaaagaucaacgaggaagcggacaaguugguacauauggucuaaacacguucacaaacauggagguccagcuaauacgccagauggaggcugaaggugugaucacucaagacgauaugcaaaacccaaaaggacuaaaggaaagaguagaaaaauggcucagggagugcggcgucgacagacuuaaacggauggccaucagcggagacgacugcgucgucaagccacuagaugaacgguucgggacaucccuccuguuucuaaacgauaugggcaaaguccgaaaagacauuccccaaugggagccaucaaaaggauggaaaaacuggcaagaaguaccuuucuguagccaccacuuccacaaaaucuuuaugaaggaugggcgauccuuaguagugccgugccgaaaucaagacgagcugaucggucgcgcacgcauaucccaaggugcaggguggucacuccgugagacggcaugccucgguaaagcguaugcgcaaauguggagccucauguauuuccaucgcagggaccuacgccucgcaucgauggcaauuugcagcgccguacccaccgaaugguucccaacgagcagaacgacguggaguauccaugcccaucaccaauggaugaccaccgaggacaugcugaaagucuggaaccgaguguggauagaggacaacccuaauaugauagacaagacaccggugcauagcugggaagacauccccuaccugggaaagcgagaagaccuguggugcgggagccugauaggucucuccucaagagcaaccugggcgaagaacauacauacagccaucacucaggugcgaaaccuaauagggaaagaagaauacgucgacuacaugccuguaaugaaacgauacuccgcucccucggaauccgaaggaguacuguaa

SEQ ID NO: 26259 - RNA, 9867 nt, Artificial Sequence
  derived and/or modified CDS sequence (opt11) from DENV-4__FJ182016__SS-prME
uccacgauuacgcugcucugucuuauccccacggugauggccuuccaccuguccacucgcgacggggagccucucaugaucgucgccaagcaugagcgggggcgccccuuacuguucaagacuacggaaggcaucaacaagugcacacucauagcgauggaccugggggagaugugcgaggacaccgugaccuacaaguguccucugcucguaaacaccgagccugaggacauagacugcuggugcaaccugacguccacuugggucauguacggaaccuguacccaguccggagaacggaggcgggagaaacgcagcguggcccugacgccccacucgggcaugggccucgagacacgggccgagacuuggaugagcuccgaaggggccuggaaacacgcccagcgcguggaaagcuggauccuacgcaaccccggcuucgcucugcucgcuggguucauggcauacaugaucggccaaacaggaauccagagaacggucuucuucgugcugaugaugcugguggcgcccuccuacggcaugcggugcgucggcgugggcaaccgggacuucgucgagggcgucaguggaggugcguggguggaccucguuuuagagcacggggggugcgucaccacaauggcccagggcaaaccgacgcuggauuucgagcucacuaagacgaccgccaaggagguggcucuccuccggacuuauuguaucgaggccuugauauccaacaucacaaccgcaacccgcugcccuacgcagggagagccuuacuuaaaagaggagcaagaucagcaauacaucugccggcgggacgucgucgaccggggcugggguaacggcuguggccuguuugggaaaggagggguagugacuugugccaaguucagcuguuccggcaaaaucaccgggaaccucguacaaauagaaaaccuagaguacaccgugguggucacggugcacaauggcgauacccacgccgucgggaacgauacuagcaaccacgggguuaccgccaccaucacgccucgcucccccagcguggaggugaagcugcccgacuauggggaguuaacucuggacugcgagccccguuccgggauugacuucaacgagaugauccugaugaagaugaagaagaagaccuggcucguucacaagcagugguuuuuagaccugcccuuacccuggacaacuggcgcugacacuagcgagguacacuggaacuacaaggagcgcauggucacguucaaggugccacaugcgaagagacaggacgugacggucuuagggucccaggagggcgccaugcacagcgcccuggcuggagccaccgagguagacucuggggacgggaaccacauguucgcggggcaccucaaaugcaagguccgcauggagaagcuaagaaucaaggguauguccuacacgaugugcucagggaaguuuuccaucgacaaggagauggccgagacccagcacgggacgaccguagugaagguuaaguacgagggagccggggcccccugcaagguucccaucgaaauuagggacgugaacaaagagaagguggucgggagggugauaucggcaacgccauuagcggagaacaccaacaguguaaccaauaucgaguuagaaccacccuucggggacucauacaucgucaucggcgugggcaacuccgcccugacccuucauugguuucggaaggguucguccaucgggaagauguucgagucuacauaucgaggggccaagcgaauggccauacucggugagaccgcaugggauuuuggguccgugggcggccuuuucaccagucucgggaaggcgguucaccagguguucgguucagucuacaccacaauguuugggggcguuagcuggaugauacgaauccucaucggguuccuggugcuuuggaucggaaccaacucucggaacaccagcauggccaugaccugcauugccguggguggcaucacgcuguuccucggcuuuacaguccaggccgacaugggauguguaguuaguuggaguggacgcgaacugaagugugguuccgggauuuucgucguggacaacguccacaccuggaccgagcaauacaaauuccaaccagaaagccccgcgcggcuggcuagcgccauccucaaugcucacaaagacggggucugcgggauacguuccacgacucgguuagagaacgugauguggaaacaaaucaccaacgaguuaaacuacgugcugugggaaggcgggcacgaccugaccgucguggccggggacgugaagggagucuuaacgaaggggaaacgugcucucacuccgccggccucagacuuaaaauacucuuggaaaaccuggggcaaagccaagauauuuaccccagaggcacgcaacucgacuuuccuaauugacgggccagacaccuccgagugccccaacgagcgccgugcauggaacucguucgagguggaagacuauggcuucgguauguucaccacaaauaucuggaugaaauuccgcgaggguucuagcgaggugugugaccaccgcuugaugucggcggccauaaaagaccagaaggccguucaugccgauaugggguacuggauagaguccucaaagaaccaaacguggcaaauugagcgcgcgagccugaucgaagugaagaccugcuuauggcccaaaacccauacccuuugguccaacgggguccucgagagccagauguuaauccccaagaguuacgccggcccguucagccagcacaacuaccggcagggguacgcaacucaaaccguggggcccuggcaccucgggaagcuagagaucgacuuuggcgaaugccccggcaccaccguaaccauccaggagaacugcgaccaccgcgggcccucccugagaacgacgaccgccucuggaaagcucguaacccaguggugcugccguagcugcacgaugccgccccuuagguuccugggggaagacggcugcugguacgguauggagauaaggccacucucagagaaggaagagaauaugguaaagucucaggugaccgcuggucaagguaccagugagacauucaguauggggcuucuaugccucacccuguucgucgaagagugucucagacggcgggucacccgaaagcacaugauccucgcgguggucaucacacucugcgccaucauccugggcgggcucacauggauggaccugcugcgagcgcugaucaugcugggagacacgauguccgggcggaucgggggccagacccaccuggccaucauggcaguguucaagaugagcccgggguacgugcucggcguuuuucugcgcaagcugaccucucgcgagaccgcgcucauggucaucgggauggcaaugacgaccacccugucaaucccacacgauuuaauggaacuuaucgauggcaucagucugggucucaucuuacucaagauugugacccaguucgacaauacccaggucgggacccuggcucucucuuugaccuuuauacgcuccacuaugucacuggugauggccuggcggacgaucauggccguccucuucgucgugaccuuaaucccgcugugcaggaccucgugccuccaaaagcagucccacuggguggagaucaccgcucugauacugggcgcccaggcgcugccggucuaccugaugacgcuaaugaagggggcgucccggcgcagcuggccacuaaacgagggaaucauggcggugggucuggugucccugcucggcagcgcccugcugaagaacgacguuccgcuugccggaccuaugguugcaggcggccuucuucucgcagccuacgugaugucuggcucauccgccgaccugucccuggagaaggcagcuaacguacagugggacgagauggcugacaucaccggaagcucccccaucauugaggugaaacaggacgaggauggguccuucuccauccgggacguggaggaaaccaacaugaucacccuccuggucaagcuggcgcuaauuacggugagcggacuguauccucuugccaucccgaucaccaugacccucugguacauguggcaggugaagacccagcgauccggugcccugugggacguccccucacccgccgccacccagaaggcggcccugucggagggggucuaccggaucaugcagagggggcucuucgggaagacucaagugggcgucgggauccacauggagggcguuuuccacacuauguggcauguuacccgaggcuccguaaucugccacgaaaccggccggcucgagcccaguugggccgacgugcgcaacgacaugaucagcuacggcgguggcuggcgccugggcgacaagugggauaaggaggaggacgugcagguucucgccaucgaaccggggaagaauccuaagcacgugcagacgaagcccggccuuuucaaaacccugacgggagagaucggcgccguaacccuugacuucaagccuggaacuucggggagcccgaucaucaaccgcaagggcaaagugaucggccuauacgguaauggagugguaaccaagucaggcgacuacguuucggcaauuacccaggccgagcgcauuggggagcccgauuacgagguggaugaggacaucuuccgcaaaaaacgccuuacaauuauggaccugcacccgggcgcuggcaagacgaaaagaaucuuaccgagcaucgugcgugaggcucuuaagcgcaggcugcgcacccucaucuuagcacccacacgggucguugccgccgagauggaagaggcgcuccgggggcuccccauccgguaccagacgccggcagugaagagcgagcacacaggccgagagaucgucgaccugaugugccacgcgacauucaccacccggcugcucuccuccacgcgcgugcccaauuacaauuugaucgugauggaugaggcccacuucacagaccccagcucagucgccgcgaggggauauaucagcacgagaguggaaaugggcgaggcggcggcuauuuucaugaccgccacgccgcccggggccacugacccuuucccgcagucgaacagccccaucgaggacaucgagcgggagauacccgagcgcuccuggaauacgggcuucgacuggaucaccgacuaccagggcaagacgguaugguucguuccuaguaucaaggccgggaacgauaucgcgaacugucuacguaaaucaggcaagaaggugauacagcucaguaggaagacuuucgacaccgaguauccgaagaccaagcuaacugacugggauuucguggugaccaccgacaucuccgagaugggggccaacuuccgcgccgggcgggucauagacccccgccggugccugaagcccguaauccucaccgacggcccggagcgcguuauccuggccggcccgauuccagugacgccagcgucagccgcccagcgacgcggccgaauagggaggaacccggcccaggaggaugaucaguacguauucuccggcgacccccugaagaacgacgaggaccacgcccacuggaccgaggcgaagaugcuacuggacaacaucuacacaccugagggaaucauccccacucuguucggcccggagagagaaaagacgcaggcaauugacggcgaguuccgccuacgcggcgaacaacguaagaccuucguggagcugaugcgucggggcgaccuccccguauggcucaguuauaaggucgcgucagccgggaucagcuacaaggaucgagaaugguguuucaccggagagcgcaauaaccagauucuagaggagaacauggaaguggagauauggacccgggagggugagaagaagaagcugcgccccaaauggcuagacgcaagggucuacgcggaucccauggcguugaaggacuucaaggaguucgccuccgggcgcaagucgaucacacuggauauuuuaacugagaucgccagucuaccaaccuaccugucaucccgcgccaagcucgcgcucgacaacaucguaaugcuccacaccaccgagcggggcgggcgggccuaccaacacgcucucaacgagcugcccgaaagccuggagacucucaugcuaguggcccugcucggcgcgaugaccgccggcaucuucuuauuuuucaugcagggcaagggcaucggcaagcugagcaugggguugaucaccaucgccguggcgucaggcuuguuguggguggccgaaauccaaccacaguggauagcggccagcaucauccuggaguucuuccugauggugcuguugaucccggaaccagagaagcagcggacuccccaggacaaccagcugaucuacgugauccugacgauccucaccaucauaggccugaucgccgcgaaugagaugggucugauagagaagaccaagaccgacuucggcuucuaccagguuaagacugaaacaaccauccucgacguugaccugaggcccgccuccgcauggacgcuguacgccguggccacgacaauccugacuccgaugcugagacauaccauagagaacacuucggccaaccuaucgcuagcagccaucgcaaaccaggccgcggugcugauggguuuaggcaaaggcuggccccuccaccggauggaccugggggugccucugcucgccauggguugcuacucacagguuaacccaaccacacuuacugcaucccugguuaugcuacuggugcacuacgcuaucaucgggccaggccugcaggcuaaggccacuagagaggcucagaagcgcaccgcagccgguauuaugaaaaaccccaccguggacgggaucaccgucaucgaccucgagccuaucagcuacgauccuaaguuugaaaagcagcugggccaggucaugcuguuggugcugugcgccgggcagcuucuucucaugagaacgaccugggccuucugcgagguacugaccuuagcgaccgguccgauuuuaacccucugggaagguaacccuggucguuuuuggaauacgacgaucgccgugucgaccgccaacaucuuuagaggcagcuaccucgcgggggcaggccuggcauuuucgcugauaaagaacgcccagacgccgcgccggggaaccggaacuaccggcgagacccucggcgaaaaguggaagaggcagcugaauagccuggaccggaaggaguuugaagaauacaagaggucgggcauccucgaaguugaccggaccgaggccaaaucagcccucaaagacggguccaagaucaagcacgccgucagccgcggaucaucaaagauacgguggauaguagagcgaggcauggugaagcccaaaggcaaagucguggaucuggggugcggccgcgguggguggucuuacuacauggcaacccucaagaacgugaccgagguccggggauacacuaaggguggcccggggcaugaagagcccaucccuauggcgacguauggcuggaacuuggugaaacugcauagcggcgucgacgucuucuacaagcccaccgagcaagucgauacccuccuaugugacaucggagaaagcucuagcaacccgaccaucgaggaagggcgcacgcugcgggugcuaaagauggucgagcccuggcuguccaguaagcccgaauucugcauaaaagugcugaacccuuacaugccgacugugaucgaagagcuagagaaguugcaacgcaagcacgggggcaaccuaguccggugcccccuuucccgcaacagcacccacgagauguacugggugaguggcgcgagcgggaacauugucagcucagugaacaccacuuccaagaugcuccugaaccgguucaccacccgacaccggaaacccaccuacgaaaaagacguggaccugggcgcgggcacgagaucagucuccaccgagaccgagaagccugauaugacuaucauaggccggcgacuccagcgguuacaggaggagcacaaggagacguggcacuacgaccaggagaacccguaucgcaccugggcauaccacgggagcuaugaagcccccuccaccggcagcgcauccucuauggugaacggcguggucaagcugcucaccaagcccugggauguaaucccuauggugacgcagcuggccaugacagacaccacccccuucgggcagcaacggguauucaaggagaagguagacacccgcacaccccagccgaaaccaggcacccggaugguaaugacgacgaccgccaacuggcuuugggcguuacucggcaaaaagaagaacccgcggcuguguacccgggaggaauucauuagcaagguacgguccaacgccgccaucggcgccguguuccaggaggagcagggguggacaagcgcauccgaagcgguaaacgacagccgcuucugggagcuugucgauaaggaacgggcgcugcaccaagagggcaagugcgagucgugcguguauaauaugaugggcaagcgagagaagaaguugggggaauucggccgcgccaaggggagccgcgcuaucugguacauguggcucggggccagguucuuggaauucgaggcguuaggguuccucaaugaggaccauugguuuggacgcgagaauuccuggucuggggucgagggcgagggccugcaccgguuaggguacauacucgaggagaucgacaagaaggacggggaucugauguaugcugacgauacggcggguugggacacccgcaucaccgaagacgacuuacagaacgaggagcuaaucaccgaacagauggccccccaccauaagauccucgcgaaggccaucuucaaauugaccuaccagaauaaggugguuaagguacuccggccgaccccgcgcggggccgucauggacauuaucucccguaaggaccagcgggggucugggcagguuggaaccuacggccugaacaccuucacuaacauggagguucagcugauccgccagauggaggccgagggcgucauaacgcaggacgacaugcagaaccccaagggacugaaggagaggguugagaaauggcuacgugagugcggcguggaccgcuugaagcggauggccaucuccggcgacgacugcguagugaagccccuggacgagcgauucggaaccagccuguuauuccucaacgacaugggcaagguucguaaggauaucccccagugggagccguccaaaggguggaagaauuggcaagaaguccccuucugcagccaccacuuccauagaauuuucaugaaggacggccgguccuuaguugugcccugccgcaaccaggaugagcucaucggccgcgcgcggaucagccagggggccggcuggagucuucgggaaaccgccugccuggggaaggcauacgcccagauguggagccugauguacuuccauagacgugauuuacgacuggcgucuauggcaaucugcagcgccguccccaccgagugguuccccacaagccgaacaacguggaguauucacgcccaucaccaguggaugacaacggaggacaugcuuaagguuuggaaccggguguggauugaggacaaucccaacaugaucgacaagacgcccguccacagcugggaggacaucccguaccuggggaagcgcgaggaccuguggugcgggucucugaucggacucucuucccgggccaccugggccaagaacauccauacagccaucacgcagguccguaaccugauaggcaaggaggaguacguggauuacaugccgguuaugaagcgcuacucugccccuuccgagagugagggaguauuguga

SEQ ID NO: 26260 - RNA, 9867 nt, Artificial Sequence
  derived and/or modified CDS sequence (opt11) from DENV-4__EU854300__SS-prME
agcaccauuacccugcucugccugauccccacggugauggcguuccacuuguccaccagggauggcgagccgcucaugauaguggcgaaacacgagcgggggagaccccugcuguucaagaccaccgagggcaucaacaagugcacgcugaucgcgauggaucugggcgagaugugcgaggacaccgugaccuacaaguguccccugcucgugaacaccgaacccgaagacauugauugcuggugcaaccugacgagcacaugggucauguacggcaccuguacccaguccggggagcggcgccgggagaagcgcagcguugcccuaacgccgcacucaggcaugggccuggagacccgggccgagacguggaugagcuccgaaggggcuuggaagcacgcccagagaguggaaagcuggauacugcggaaccccggcuuugcucugcucgcgggguucauggccuacaugaucggccagaccgggauccagcgcacggucuucuucguguuaaugaugcugguggcccccuccuacggcaugcggugcgugggcguggggaaccgcgacuucguggagggugucucuggaggcgcuuggguggaccucgugcuggagcacggcgggugcgucacgaccauggcccagggcaagcccacccuggacuuugagcucacgaagaccaccgcgaaagagguggcccugcuacggaccuacugcauagaggcccucaucucaaacaucacgaccgcgacccgcugccccacccagggugagcccuaccugaaggaggagcaggaccagcaguacaucugcagacgcgacgugguggacaggggcugggggaauggcugcgggcuguucgggaagggcgggguggugacgugcgccaaguuuagcugcuccggcaagaucaccgggaaccucguccagaucgagaaucuggaguacaccgugguggucaccgugcacaacggcgacacgcacgccgugggcaacgacaccagcaaccacggggucaccgccaccaucacgccccgcuccccuucaguggaggucaagcugccggacuacggcgagcugacccuggauugcgaaccacgguccgggaucgacuucaaugagaugauccugaugaagaugaagaagaagaccuggcucgugcacaagcagugguuccuggauuugccguuacccuggaccacuggcgcugacacgagcgaaguucauuggaacuacaaagagcgaauggucaccuucaaggucccccacgcgaagcggcaggacgugaccguccuggggagccaggagggcgccaugcauagcgcccuggccggcgccaccgaaguggacaguggcgacggcaaucauauguucgcugggcaccuuaagugcaagguaaggauggaaaagcugcgcaucaagggcauguccuauacgaugugcagcggcaaguucuccaucgacaaagagauggccgagacccaacaugggaccaccgucgugaagguuaaauacgagggcgccggggccccgugcaagguacccaucgagauacgcgacgugaacaaggagaaaguggucggccgcgugaucagcgcaacgccgcuggccgaaaacaccaacuccguaacuaacaucgagcuagagccgcccuucggcgacagcuacaucgucaucggagugggcaacuccgcgcugacccugcauugguuccggaaggggucaaguaucggcaagauguuugagagcacguaccgcggggcuaagcggauggccauccucggcgaaacugcaugggauuucgggagcguuggaggacuguuuaccucacuggggaaggccguccaccagguauucggcuccguguacaccacgauguucggaggcgucagcuggaugauccggauucucauaggguuccuggugcuguggaucgggaccaauagccggaacaccagcauggccaugacuugcaucgcagugggggggaucacgcuguucuugggauucaccguccaggccgacauggggugcguggugagcuggaacggccgcgagcugaaaugcggcucaggcaucuucgucguagacaacguacacaccuggaccgaacaguacaaauuccagcccgagucccccgcgcggcuggccagcgccauccucaacgcccacaaggauggcgucugcgggauucgcagcacgacacggcucgagaacgugauguggaagcagauaaccaacgagcucaacuacgugcugugggagggcgggcacgaccucaccguaguggcaggcgacgugaaaggcguccuaacuaaagggaaacgcgcgcucaccccgcccgcaucggaucugaaguacagcuggaagaccugggggaaagccaaaaucuucacccccgagacacggaauuccacguuucuaaucgacgggcccgacacgagcgagugccccaaugagcgccgggccuggaacuccuucgaaguggaggacuauggauuugggauguucaccacgaauaucuggaugaaguuccgcgaggguagcuccgaggugugugaccacagauuaaugucagcagcgaucaaggaucagaaggccguccaugccgauaugggcuacuggaucgaguccagcaagaaccagaccuggcagaucgagcgcgccucccuaaucgagguuaagaccugccuguggcccaaaacccacacccucuggagcaacggggugcuggagagccagaugcugauccccaagagcuacgcgggcccguucucccagcauaacuaccgccaggguuaugccacgcagaccgucggccccuggcaccucggcaagcuugagaucgacuucggcgagugccccggcaccaccgucacgauccaggaaaacugcgaccaccgugggcccagccugcgcacaacuacggccuccgguaagcucgugacucagugguguugucggaguugcaccaugcccccacugcgcuuccugggggaggacggcugcugguaugggauggaaauccggccccuuagcgaaaaggaggagaacauggucaagucccagguaacggccggccagggcaccagcgagacguuuaguauggggcugcuuugccucacccuguucgucgaggagugccugcgccggcgcgugacccggaagcacaugauacucgcaguggugauuacccugugcgcgaucauccugggcggccugacuuggauggaccugcugcgggcccucaucaugcucggcgacaccaugagcggccggaucgggggacaaacgcaccuggccauaauggccguguuuaagaugucccccggguacguauuaggcguuuuccugcgcaagcucaccagcagagagacggcccucauggugaucgggauggcgaugaccaccaccuuauccaucccgcaugaccugauggagcucaucgacggcaucagccugggccucauccuccugaagaucgugacgcaguucgacaauacacaggucggaaccuuggcccucucccugaccuuuauccgaagcacuaugucucuggugauggccuggcggacaaucauggccguucucuucgucgucacccugaucccccuaugccgcaccucuugccugcagaaacagagccauugggucgagaucacggcacugauccugggcgcgcaggcccuccccgucuaccugaugacccugaugaagggggccagccggagguccuggccccucaacgagggcaucauggccguugggcuggugucuuugcucggguccgcgcugcugaagaacgacgucccgcucgccggccccaugguagccgggggacugcugcucgccgcuuacgucaugagcggauccagcgcggaccugagccucgagaaggccgccaacguccagugggacgagauggccgacaucaccggcuccagccccauuaucgaggugaagcaggaugaggacgggucauucagcauccgggacguggaagagaccaacaugaucacgcuccuggucaagcuggcgcucauaacggugucaggcuuauacccccuggcgaucccgauuaccaugacccucugguacauguggcaggugaagacgcaacgcagcggcgcccugugggacguacccucccccgccgccacucaaaaagccgcgcugagcgaggggguguaccggaucaugcagcgcggccucuucgggaagacccaagugggcguggguauccauaucgaggguguguuccacaccauguggcacguuacccggggaucagucaucugccacgagacgggccgccuagaacccagcugggccgaugugcgcaacgacaugauauccuaugguggugguuggcggcugggcgacaagugggacaaggaggaggacgugcagguccucgccaucgaaccagggaagaaccccaagcacgugcaaaccaagccaggccuguucaagacccugaccggggagaucggcgcugugacgcucgacuucaagcccggaaccagcggcuccccgaucaucaaccgcaagggcaaggucauugggcuguacggcaacgggguggugacuaagucgggcgacuacgucagcgccauuacccaggcggaaaggaucggcgagcccgauuacgaggucgacgaggacaucuuucgcaagaaacggcugaccaucauggaccuccaccccggcgcaggcaagaccaagcgaauccugcccagcaucguucgggaggcacugaaacgccggcugcgcacccucauacuggcccccacccggguaguggcggcagagauggaagaggcccugcgcgggcucccgauccgguaccagaccccagccgucaaauccgaacacacuggccgggagaucguggacuugaugugucacgccacguucaccacacggcugcugagcaguacccgcgugccgaacuacaaccugaucgugauggaugaggcgcacuuuaccgacccuagcagcgucgccgcccgggguuauauuuccacccgcguugagaugggcgaagccgcagcgaucuucaugacggcaacccccccaggggccaccgacccguucccccaaagcaauucccccaucgaggacaucgagcgggagaucccggagcgcagcuggaacaccggcuucgacuggaucacggacuaucagggaaagaccgucugguuugugccguccaucaaagcuggcaacgacaucgccaacugccugcgcaagagcggcaagaaggugauccagcucucccggaagaccuucgacacugaguaccccaagacgaagcuuaccgacugggacuucgugguuaccaccgauaucagcgagaugggcgcaaacuuucgggccggacgugucaucgacccucgccggugccuuaaaccagucauccucacggaugggcccgagcgcgugauccuggccggcccuaucccggugacucccgccuccgcggcccagcggcgcggacggauugggcgcaaccuggcccaggaggacgaucaauacgucuucucaggcgacccgcucaaaaacgaugaggaccacgcccacuggaccgaggccaagaugcuucuagacaacaucuacacccccgaggggauuauccccacgcucuuuggccccgagcgggagaagacccaggcgaucgauggcgaguuccgcuugcggggugagcaacgcaagacguucguggagcugaugcggcgcggcgacuuaccgguuuggcuguccuacaaaguugccucagccggcaucagcuacaaggaccgugaguggugcuucaccggcgaacgcaacaaccagauucuggaagaaaauauggaggucgagaucuggacccgggagggagagaagaagaaguugcgccccaaguggcuagaugccaggguguacgccgacccaauggcgcugaaggacuucaaggaguucgccagcggccguaaguccauaacgcucgacauccugacagagauugccagcuugcccaccuaccucuccagccgcgccaaacuggcgcuggauaacaucgucauguugcacaccacggagcggggggggagagcauaucagcacgcccucaacgagcugccggagucccucgagacacugauguugguggcccugcugggcgccaugaccgcggggauauuucuguucuucaugcagggcaagggcaucggcaaguugagcaugggccugaucacaauagccguugccucggggcugcucugggucgccgagauccagccucaguggaucgcggcgucgaucauacuggaauuuuucuugauggugcuacugauacccgagccggagaaacagaggacuccccaggacaaccagcugauuuacguuauccucacuauacugaccaucaucggucugauagccgccaacgaaauggggcucaucgagaagaccaaggccgacuucggcuucuaucaggucaagacggagaccaccauucuagacguagacuuacgacccgccagcgcguggacgcucuacgccguggccacgaccauccugacccccaugcugagacacaccaucgagaauacgagcgccaaucucagccuggcggcgaucgccaaucaggccgccguccugauggggcucggcaagggcuggccgcugcaucgcauggaucugggggugccgcuccuggcuaugggcugcuacucccaggugaaccccaccacccugaccgccagccucgucaugcugcuggugcacuacgcuaucaucgggcccggccugcaggccaaggccacgcgggaggcgcagaagagaaccgccgccggcauaaugaagaacccgaccguggauggcaucacggucaucgaccuggagcccaucucauacgaccccaaguucgagaagcagcugggccaggugaugcuccuggugcugugcgccgggcagcucuugcuaaugcggacaaccugggccuucugcgagguccucacucuggcgacuggccccauacugacgcucugggaagggaacccgggucguuucuggaacacaaccaucgccgugagcaccgcaaacaucuuccggggcuccuaccuggccggggccggccuggcguuuagccucaucaaaaacgcccagacgccucgccgggggaccggcacuaccggggagacccugggcgagaaguggaagcgccagcugaacucccuugaccguaaggaguucgaggaguauaagcgcuccggcauccuggagguggaccggacagaggccaagagcgcccugaaggaugggagcaagauuaagcacgccgucucccgcggcagcuccaaaauccgguggaucguggagagagggauggugaagcccaagggcaaggucguagaccucgggugcggccgcggcggcuggagcuacuacauggcgacucugaagaaugugacagaggucaagggauacaccaagggcggccccgggcacgaggagccuauccccauggccaccuacggauggaaccuggucaaguugcacuccggaguggacguuuucuacaagcccaccgagcagguggacacccugcugugcgacaucggagagagcagcuccaaucccaccauagaggagggccggacgcuccgcgugcuuaaaauggucgaaccgugguugagcaguaagccugaguucugcaucaaggugcugaaccccuacaugcccaccgucaucgaggaacucgagaagcugcagcggaagcacggaggcaaccugguccgcugcccgcucagccggaacuccacucacgagauguacugggucagcggcgccuccggcaacaucgucagcagcgucaacaccacgagcaagaugcuucugaaccgcuuuaccacucggcaccgcaagcccacuuacgaaaaggacguggaccugggcgcagggacacgguccgucagcacggaaaccgagaagcccgauaugaccaucauuggccgccggcuccaacggcugcaagaggagcacaaggagacguggcacuacgaccaggagaaccccuaucggaccugggcguaccacggguccuaugaggcccccucgaccggcuccgccaguucaauggucaacggaguggucaagcuccugaccaaaccuugggacgucauccccauggucacgcagcuggccaugacggacaccacaccguuugggcaacagcgcgucuucaaggaaaagguggauacacggaccccccagcccaaacccggcacgcgcauggugaugaccacgaccgcuaacugguugugggcgcugcuggggaagaagaaaaacccgcggcucugcacucgcgaggaguucaucucaaaggugagguccaacgccgccauaggcgccguguuccaggaggagcagggguggaccagugccagcgaggccgugaaugacucccgcuucugggagcuggucgacaaggaacgggcccugcaucaggaggguaagugcgagagcugcguguauaauaugaugggcaagcgcgagaagaaacuaggggaauucggccgcgccaaggggucccgggccaucugguacauguggcugggcgcccgcuuccuggaguucgaggcccucggguuccugaacgaggaccauugguucgggcgggagaacagcugguccggcguggagggggaaggcuuacaccgacucggguacauccuggaggaaauagacaagaaagacggcgaccugauguaugccgacgacacugccggcugggacacccggaucaccgaggacgaccuccagaacgaggagcugaucacugagcagauggcuccccaccacaagauuuuggccaaggccauauucaagcucacguaccagaacaaggucgugaaggugcugcgccccacgccccguggggccgucauggacaucaucagccgcaaggaccaacggggcuccgggcaggugggcaccuaugggcugaacaccuucaccaacauggaggugcaguugauacgucagauggaagccgaaggcgucaucacgcaggacgacaugcaaaacccaaagggucugaaagagcgaguggagaaguggcuacgcgaguguggcguagaccgacucaagcgcauggcgaucagcggcgacgacugcguagugaaaccgcuggaugagcgguucgggaccucccugcucuuucugaacgauauggguaaagugcgcaaggacaucccacaaugggagcccaguaagggguggaagaacuggcaggagguccccuuuugcagucaccacuuccacaagaucuucaugaaggacggccggucgcuaguggugccgugccggaaccaggacgaacucaucggccgggcgcgcauuucgcagggggccggguggagccugcgcgagaccgccugccuggggaaggcuuaugcccaaauguggucccucauguacuuccaccggcgcgaccugcggcuggccucuauggccaucugcuccgccgugcccacagagugguuccccacgucgcgcacaacguggagcauccacgcccaccaccaguggaugaccacggaggauaugcucaagguauggaaccgcguguggauagaggacaacccgaacaugaucgacaagacccccguccacucgugggaggacauccccuaccugggcaagcgcgaggaccuguggugcgggagccucaucggccuguccagcagggccaccugggcgaagaacauacacaccgccauuacgcaggugcgcaaccugaucggcaaggaggaguacgucgacuacaugcccgucaugaaaagauacuccgcccccagcgaauccgagggagugcucuga

SEQ ID NO: 26261 - RNA, 9867 nt, Artificial Sequence
  derived and/or modified CDS sequence (opt11) from DENV-4__FJ182017__SS-prME
aguaccauaacacuccucugcuuaaucccuacgguaauggccuuccaucucuccacccgcgacggcgagccguugaugaucgucgccaagcaugagcguggucgcccacugcuguucaagaccaccgagggcaucaacaaguguaccuugauagcgauggaccucggggagaugugcgaggacacugugaccuauaagugcccucuacucgugaauaccgagcccgaagacauagacugcuggugcaaccucacguccgccugggucauguacggcaccugcacccaaaguggggaacggaggcgugagaagcgcagcguggcccugaccccgcacagugggaugggccucgagacucgggcggagacguggaugucgagugaaggagccuggaagcaugcgcagcgaguggaaagcuggauccuccggaacccuggcuucgcacugcucgccggcuucauggcguauaugauuggccagaccgggauccaacgcacugucuucuucguauuaaugauguuaguagcuccaucguacggcaugcggugcgucggcguggggaacagagacuucguggaaggcgucucugggggcgccuggguggaccucguccuggagcacggcgguugcgucacgaccauggcccagggcaaacccacccuggacuuugaguugacaaagacuacugccaaggagguggcuuuacugcggacuuacugcauagaggcgcucauauccaauauuaccacagccacgcgcugcccgacucaaggggagcccuaccugaaggaggagcaggaccaacaguacaucugccgucgugacguaguagaccggggcugggggaacggcuguggucuguucgggaagggcggggucguuaccugcgccaaguucagcugcagcgguaagaucacgggcaaccucguccagaucgagaaucuggaguacaccgucgugguuacugugcacaauggcgauacccacgccgucggcaacgacacgagcaaucacggggugaccgccaccaucacccccaggucccccuccguggaagucaagcugccggauuacggcgaacucacguuagacugcgagccuaggucugggaucgacuuuaacgagaugauccugaugaagaugaagaagaagacguggcucgugcacaagcaaugguuucuagaccugccccugccguggaccaccggcgcggacacgucggagguucauuggaauuacaaggagcgcaugguuacauucaaggucccccacgcuaagcgacaggacgucaccgugcugggcucccaggagggcgccaugcacagcgcccuggccggcgcgaccgaggucgacuccggggacggcaaccacauguuugccgggcaccucaaguguaaaguacgcauggagaagcugagaaucaagggcaugagcuauaccauguguagcggcaaguucuccauagacaaggagauggccgagacgcagcacgggaccaccgucgugaaggugaaguacgaaggcgccggggcucccugcaagguccccaucgaaauccgggacgugaacaaggagaaagugguaggccgcgugauuucggccaccccucuggcagagaacacgaauucggugacuaacaucgaauuggagccgccauucggggacagcuauauuguuaucgguguggggaacuccgcccuaacgcugcacugguuccgcaaggggagcuccauuggcaagauguucgagagcacguaccgcggggccaagcggauggcaauccucggcgagacggccugggacuucgggucaguuggugggcuguucacaagccugggcaaggccguccaccaaguguucggcagugucuauaccacuauguucggcggcguaagcuggaugauucgcauccucaucggcuuccugguccuguggaucggcacgaacuccaggaacaccucgauggccaugaccugcauugcugugggugggaucacccuguucuugggcuucacgguccaggcggacaugggcugcguggucuccuggagcggccgugagcugaaaugugggagugguaucuuugugguggacaacgugcauaccuggacugagcaauacaaguuccagcccgagagcccugcccggcuggccagcgcuauucucaacgcccacaaggacggcgucuguggcauucgcuccaccacccggcuggagaacgugauguggaagcagaucaccaacgagcugaauuacgugcuaugggagggcgggcacgaccugaccguuguggcuggagacguaaagggcgucuuaacaaaggggaagcgcgcccucacgccgccagcgagcgacuugaaauacucuuggaaaaccugggggaaagccaagauuuuuacuccugaggcccggaauagcacuuuccugaucgacggcccugacacgucagagugcccgaacgagcgucgcgcauggaacagcuuugaaguagaggauuauggcuucggcauguuuacuaccaacaucuggaugaaauucagggagggcuccagcgaggugugugaucaccgccucauguccgccgccauaaaggaucaaaaggccgugcacgcggacaugggcuacuggaucgagucauccaagaaccagaccuggcagaucgagagagccagccugaucgaagugaaaacguguuuauggcccaagacccacacccucuggucuaauggagugcuggagagccagaugcugauccccaaauccuacgccggaccguucagccagcacaacuaccgccagggguaugccacccagaccgucggccccuggcaccucggcaagcuugagaucgacuucggagaaugccccggcacgaccgugacaauacaagagaauugugaccacagagggccgucucugcguaccacgaccgcgucuggcaaguuagugacgcaguggugcugucgaagcugcaccaugccgccccugcgcuuccugggugaagacggcugcugguaugggauggagauccgaccucugagugagaaagaggagaacauggucaagagucaggucacugcgggccaaggcaccagugagaccuuuagcaugggacugcugugccuuaccuuguucgucgaggagugucuccgacggcguguaacgcggaaacacaugauacuugccguggucauaacacuuugcgccaucauccugggcgggcucaccuggauggaccugcuccgagcccucaucaugcugggugacaccauguccggccggauugggggccagacgcaccuugccauuauggcaguauucaagaugagucccggguacgugcucggaguuuuccugcgcaagcucaccagccgagaaaccgcccucauggugaucgggauggccaugacaacgacucucagcaucccgcacgaccuaauggagcucauagacggcauaucccucggccuaaucuugcugaagaucguaacccaguucgacaacacccaagucggaacgcuggcccucucucuuacuuuuauucgcucuaccaugagccuggugauggccuggcggaccaucauggcggugcucuucgucguaacccugauccccuuaugccgcaccuccugccuucaaaagcagagccacuggguggagauaaccgccuuaaucuugggcgcccaggcccuccccguguaucuuaugacccugaugaagggggccagucggcgcuccuggccucugaacgagggaaucauggccgugggguuggucucccugcucggcuccgcccuguugaagaacgauguuccgcuugccggacccauggucgccgggggucugcuuuuggcggccuacgugaugucugggagcucggccgacuugucacuggagaaggcugcuaacguccaaugggacgagauggcggacauuacgggcagcuccccgaucaucgaggugaaacaggaugaggacgggagcuucuccauccgggacguggaggaaaccaauaugaucacccuccuggucaagcuggcccuaauaaccgugaguggcuuauacccccuggcaaucccuauuacgaugacccucugguacauguggcagguuaagacucaacgcuccggcgcucugugggacguccccucgcccgcugcgacccaaaaggccgcacuguccgaggggguguaccggauuaugcagcgcgggcuuuuugggaagacgcaggucggcgucgggauacacauggaggggguguuccacacgauguggcacgugacccggggcucuguaauuugccaugagaccggccgccuggagcccaguugggcagacgugcgaaacgacaugauaagcuauggaggcggauggcggcugggcgacaagugggacaaggaggaggacgugcagguccucgccaucgagccgggcaagaaccccaagcaugugcaaaccaagcccggccuguucaagacccugaccggggagauuggggcgguaacccucgauuucaaacccgggacuuccggcagcccgauuaucaaccgcaagggcaagguaaucgggcuguacggcaacggcguggugacgaaguccggcgauuacgugagcgccaucacacaggccgagagaaucggggagcccgacuaugagguagacgaggacaucuuccgcaaaaagcggcuaacgaucauggaucuccacccaggcgccgguaagacaaagcgcauucugcccuccaucgugcgggaggcgcugaagcgccggcuacgcacacucauucuggcucccacucgggucguggcagccgaaauggaggaggcccugcgcggguugcccauccgguaccagacgcccgcgguuaagagcgagcacaccgggcgcgagaucgucgaccugaugugccacgccaccuucaccacccggcugcucuccagcacccgcguaccgaacuacaaucucauaguuauggacgaggcccauuucacggaccccagcuccgucgccgcucguggguacauaagcacccggguggagaugggcgaggcggccgcgaucuucaugacagccaccccccccggggcuacggacccauucccgcaguccaacagccccaucgaggacauugagagggaaauccccgagcgcuccuggaacaccggcuucgacuggaucaccgacuaccaaggcaagacggucugguucgugccgagcauaaaagcggggaacgacaucgccaacugccugcgcaaguccgggaagaaggucauacagcuuucccggaagacguucgacaccgaguauccaaagaccaaacugacggauugggacuucgucgugacgaccgauaucuccgagaugggggccaauuuccgggccggacggguaaucgacccgcgccggugccucaaaccggucauacuaaccgaugguccagagcgcguuauccuugcgggcccgauucccgugacacccgccagcgccgcgcaacggcgcggacggaucggucggaacccggcccaggaagacgaccaguacgucuuuucgggcgacccccugaagaacgacgaggaccaugcgcacuggacggaggcuaagaugcuacuagacaacauauacacucccgaggggauuauuccgacucuguucgggccggagagagagaagacacaggcgaucgacggcgaguucagguuacggggggaacagcggaagacguucguggagcugaugcggcggggcgaccugccuguuuggcugagcuauaaggucgcguccgccgguaucagcuauaaggaccgggaguggugcuuuaccggcgagcgaaacaaccagauccuggaagaaaacauggaaguggagauauggacccgagagggcgaaaaaaagaagcuacgccccaagugguuggaugcgcggguguacgccgaccccauggccuugaaagacuucaaggaguucgcuuccggucgcaagagcaucacucuggacauccucacugagaucgccucccuuccaacguacuugagcucccgcgcaaaguuagcccuggacaacaucguaaugcugcacacuaccgagcggggugggcgcgccuaucagcaugcccucaacgagcuucccgagagccuggagacgcucaugcucguggcgcuacucggagccaugacagccggaaucuuccuauucuucaugcagggcaaggggaucgggaagcugaguauggggcucaucacaaucgccguggccuccgggcuguugugggucgccgaaauccagccacaguggaucgccgccagcaucauccucgaguucuuucugaugguccugcucauuccggagcccgagaaacaaaggaccccccaggacaaccagcugauuuauguuauccuuaccauccucacuaucaucggucugaucgcugccaaugagaugggccugauugagaagacaaaaaccgacuucgguuucuaccaagugaagaccgaaacgacuauccucgacguugaucuacgccccgcguccgccuggacccuguacgccguggcgacuacaauccucaccccgaugcuacggcacacaaucgagaacaccagcgcaaaucugucccuggcggccauugccaaccaggcagccguccugaugggucugggcaagggcuggccccuccaccgcauggacuuggggguaccacugcucgcuauggguugcuacagccagguuaacccuacuacccugaccgcgagucuggucaugcuccugguucauuaugccaucauugggccuggccugcaagcgaaggcgacgcgggaggcccagaagcgcacggcggccggcaucaugaagaaccccaccguggaugggaucaccgucaucgaucuagagcccaucucguacgacccuaaguucgagaagcaguuaggccaggugaugcugcucgcccugugcgcggggcagcugcuccugaugcggacuacaugggcguucugcgaggugcugaccuuggccaccggcccaauccugacccuuugggaagguaacccuggccgcuucuggaacacgaccaucgccgucucaaccgcaaauauauuccggggcucuuaccucgcgggggccggccuggcguucucccugaucaagaaugcucagaccccccgccgggguacggguacuacuggggaaacccucggcgaaaaguggaagcgacaacuuaacagccuggaccggaaagaguucgaggaguacaagcgguccggcauucucgaaguggaccggacagaagcuaagucagcgcuaaaggacgggaguaaaauuaagcaugccgugucacgcggcuccagcaagauccgguggaucgucgagcgcgguauggugaaaccgaaagggaaggucgucgaccuggggugcgguaggggcgggugguccuacuacauggcuacgcucaaaaacgugacagaggucaaagguuacaccaaggguggaccgggccaugaggagccuaucccaauggccaccuacggcuggaaucuggucaagcugcacagcgguguggacguauuuuacaagcccacggaacaggucgacacccugcugugcgacaucggagaguccuccagcaacccaaccaucgaggaggggcggacccugcgcgugcuaaaaaugguggagccauggcucucgagcaagcccgaguuuugcaucaagguacugaaccccuacaugccaacugugauugaggaacuggaaaaacugcaacggaagcacgguggcaaccugguacgcugcccucucagccggaacucgacucacgagauguacuggguguccggcgccagcgggaacauuguguccagcgucaacaccaccuccaagaugcuccugaaccgcuuuaccacccgucaccgcaagcccaccuacgagaaggacguggaccugggcgcagggacccggucaguguccacggagacugaaaagccagacaugaccauaaucgguaggcgguuacaacgccugcaggaggagcacaaagagaccuggcauuacgaccaggagaacccauaucggacgugggcguaccacgggagcuacgaggcccccagcaccgguucagccucgucgauggucaaugggguggugaaacuucucacgaagccuugggacguaauuccuauggugacccagcuggcaaugaccgacaccacgcccuucgggcaacagcgcguguucaaagagaaagucgauacgcgcacgccucagccaaagccggggaccagaaugguaaugaccaccacagcuaacuggcugugggcccuccuggggaagaagaagaacccccggcugugcacccgcgaagaauucaucuccaaaguccggagcaaugcugcgauuggcgcagucuuccaggaggagcagggguggaccagcgcauccgaggcuguuaaugacagccguuucugggagcucguggauaaggagcgggcccugcaccaggagggcaagugcgaaucuugugucuacaauaugaugggcaagcgcgagaagaagcuuggugaauucggccgggccaaagggagccgggcgauaugguacauguggcucggggcccgcuuucuggaguuugaggcccugggcuuucucaaugaggaccacugguucggccgggaaaacucauggagcgguguggaaggggagggccugcaccgauugggguacauacucgaggagaucgacaagaaggacggcgaccugauguacgccgacgacacagcgggcugggacacgcggauaacagaggacgaccugcagaacgaagagcuaauaaccgagcagauggccccgcaccacaagauccuugccaaggccaucuucaagcugacuuaucaaaacaagguggucaaggugcucaggccgacaccacgcggugccgugauggacaucaucuccagaaaagaccaacggggcaguggucaaguagggaccuauggacuuaacaccuucaccaauauggaggugcagcugauccgccagauggaggcagaagggguuaucacccaggacgacaugcagaaccccaaaggacugaaggagagaguggaaaagugguuacgcgagugcgggguggaccgccugaagcguauggcuauauccggagaugacuguguggucaaaccccucgacgagcgguucgggacgagccugcuguuccucaaugacauggguaaggugcgaaaggacaucccacagugggagccaaguaagggguggaagaacuggcaggaggugcccuucugcucacaccacuuccacaagaucuucaugaaggacggccgaucccuggucgugcccugccgcaaccaggacgaguugauaggccgggcgcgcaucagccaaggggccggcuggucucuccgcgaaacugccugcuugggaaaagcguacgcccagauguggagccugauguacuuccaccggcgcgaucuccgucuggccucuauggccaucugcagcgccguaccuaccgagugguuuccgaccucacgcacgaccuggucuauccacgcgcaucaccaauggaugacaaccgaggacauguugaagguuuggaaccggguguggaucgaagauaaccccaauaugauagacaagacacccguacacagcugggaagacauccccuaccucggaaagcgcgaggaucucuggugcgggucccugauagggcuuuccucccgggcgaccugggccaagaacauccacacugccaucacacaggucagaaaccugaucggcaaggaggaguacgucgauuacaugcccgugaugaagcgauacagcgcccccucugagagcgagggugucuuauga

SEQ ID NO: 26262 - RNA, 9867 nt, Artificial Sequence
  derived and/or modified CDS sequence (opt11) from DENV-4__EU854301__SS-prME
ucgacuaucacccugcugugccugauucccacgguaauggcuuuucaccugucaacucgcgauggagaaccacucaugauugucgccaagcacgaacgggggcgcccccugcuguucaagaccaccgaagguauuaacaagugcacgcugaucgcgauggaccucggggaaaugugcgaggauacagucaccuauaaaugccccuuauuagugaauaccgagcccgaggacaucgauugcuggugcaaccuaacguccaccugggucauguaugguacuugcacccaguccggggagaggcggcgggaaaagcgcagcgucgcgcugaccccgcacuccgguaugggccucgaaacgcgggccgagaccuggaugagcuccgagggggccuggaaacacgcgcagcgcguggaaucauggauucugaggaacccuggguucgcgcugcucgccggguuuauggcuuauaugaucggccagaccgguauccagcgcacugucuucuuugugcugaugaugcugguagccccaucauauggcaugcggugugucggcguggggaaccgcgacuucguagagggcguauccgggggcgcguggguggaccucgugcuggaacauggcgggugugucaccaccauggcccagggcaaacccacccuggacuucgagcucacgaagaccacagccaaggagguggcgcugcugcggacauacugcaucgaggcuucuauaagcaacauuacgaccgcgacucgcugcccgacgcaaggggaacccuaccugaaggaggagcaggaccagcaguacauaugccggagggacguuguggaccggggcugggggaacggcugcggucuuuucgggaaaggaggggugguuaccugcgccaaguucucuugcaguggcaagaucaccgggaaccuuguccaaauugagaaccucgaauacaccgucguggucacggugcacaacggagacacgcacgcagucggcaacgauaccuccaaccauggggugaccgcaaccaucacgccacgcagcccuucuguggaggucaaacugcccgacuauggggagcugacguuagacugugagccccgaagcgggauugauuucaacgagaugauacugaugaagaugaagaaaaagaccuggcuggugcacaagcagugguuccucgaccugcccuugcccuggaccacgggcgccgacacgucugaggugcacuggaacuacaaggaacgcaugguaaccuucaagguaccucacgcgaagcggcaagauguaaccgucuugggaagccaggagggcgccaugcacagcgcccuggcuggggccaccgagguggauucgggggacggaaaccacauguucgcggggcaccugaagugcaagguccgcauggagaagcuccgcaucaagggaaugagcuauacgaugugcaguggcaaguucagcaucgacaaggagauggccgagacccagcacgggaccacugucguaaaagucaaguaugagggagccggggcccccuguaaggucccgaucgaaauccgggacgugaauaaggagaagguggucggccgcgugauuuccgccacgccucuugcagagaacaccaacagcgugaccaacaucgagcuggagccaccuuucggggacuccuacaucgucauuggcguggggaacagugcccucacgcugcacugguuucggaagggguccagcauaggcaaaauguucgagucuacuuacagaggcgcgaagcggauggccauucugggcgaaaccgcgugggacuucgggagcgugggcgguuuguucacguccuuagggaaggccgugcaccaaaucuucggcagcguguacaccacgauguucgggggcgucuccuggaugauccggauccugaucggguuucuuguccuguggaucggcaccaacucgcggaacaccucgauggcgaugaccugcaucgccgugggcgggaucacgcuguuccugggguucaccguacaagccgacauggggugcgucgugucuuggucaggucgcgaacucaaguguggcaguggcaucuucguugucgacaacgugcacaccuggaccgagcaguacaaguuccagcccgaaagcccagcacgguuggccucggccauucugaacgcccacaaggauggagucugcgggauccgcagcacgacccgccuggagaaugucauguggaaacagauaaccaacgagcugaacuacguguugugggaaggcgggcacgaccucaccguagucgcaggagauguaaagggcgugcuuacgaaggggaagcgcgcucugaccccgcccgcuucggaccucaaauacagcuggaagaccuggggcaaggccaagaucuucacccccgaggcccgaaacuccacguuucuaaucgacggcccugacacaagcgagugcccgaaugagcgccgggcguggaacuccuuugaagucgaggacuacggcuucgguauguucaccaccaauaucuggaugaaauuucgggagggcagcucggaagugugcgaucaccgccugaugagcgcggccaucaaggaccagaaagcggugcacgcagauaugggcuacuggauugaguccaguaagaaccagacguggcagaucgaaagagcuucccuuaucgaggucaagaccugccuguggcccaagacccacacucuguggagcaacggggugcuagagucacagaugcugauccccaaguccuaugccggcccuuucucgcagcauaacuaccggcaaggguacgccacccagacgguuggccccuggcaccucgggaaguuagagaucgacuucggggagugccccggaaccacaguuacaauccaggagaauugcgaccaccgagguccaagccuccgcacgacuaccgccagcgguaagcugguuacacaauggugcugucgcuccugcacgaugccgcccuugcgcuuccugggggaggacggcugcugguacgggauggagaucaggccccuuagcgagaaggaggagaacauggugaagucccaaguuaccgccggccagggcaccagcgagacuuucuccaugggacuacugugccugacacuauuuguggaagagugccuccgccggcgagucacccggaagcacaugauccucgcgguggucaucacccucugcgccaucauccugggcggucugacuuggauggaccuucugcgcgcccugauuaugcucggugacacaaugucuggccggaucgggggccagacgcaccuugccaucauggccgucuucaagaugucccccggguacgugcugggcguauuccuccguaagcugaccagccgggagacugcgcugauggucauuggcauggccaugacgaccacccuuucgauuccacacgaucugauggagcuuaucgaugguaucagucuaggccugauacuguuaaagaucgugacacaauucgauaacacgcaagucgggacacuugcgcugucccucacauucauccgcuccacuaugucccuggucauggccuggcggacuaucauggcggugcuguucguugugacccucaucccauuaugcagaaccaguugucuucagaagcagucccacugggucgagauaaccgcuuuaaucuugggcgcccaggcuuugcccguguaccucaugacauugaugaagggcgcgagucggcgcagcuggcccuuaaacgagggcaucauggcgguggggcucgugagucuccuaggcuccgcgcuccugaagaacgaugugccgcuggcaggaccaauggucgcgggaggacuccugcuggccgcauacgucaugagcgggagcuccgccgacuuaucgcuggagaaggcagccaacgugcaaugggacgagauggccgacaucacuggcuccagucccaucaucgagguuaagcaggacgaggacgggucuuuuagcauucgggacguugaggagacaaacaugaucacacugcucgugaagcuggcucugauuaccgucuccggccucuacccgcuggcaauaccgaucaccaugacacugugguacauguggcaagugaagacccaacgcucuggugcccucugggacgugccguccccugccgccacccagaaggccgcgcuuagcgagggggucuaucggaucaugcagcgcggauuauucgggaaaacacaagugggcgugggcauccacauggagggcguauuccacaccauguggcacguuacucgaggauccguuaucugccacgagaccggcagguuagaacccuccugggccgacgucaggaacgacaugaucuccuacggcgggggcuggcggcuuggagacaagugggacaaagaggaggacguacagguucuggccaucgagccagggaaaaaccccaagcacguccagacaaagccuggccucuuuaaaacauuaaccggggagaucggcgcaguaacgcuggacuucaagcccgggaccagcgguucgccaaucaucaaccgcaagggcaaggugaucggucucuaugggaauggggucguuaccaaguccggagacuacguguccgccaucacacaagcagaacggaucggggagccagauuacgaaguugacgaggacaucuuccgcaagaagcgucugaccaucauggaccugcaccccggcgccggcaagacaaagcggauccucccgagcaucgugcgggaggccuuaaaacgccggcugcgcacccucauccucgcgccgacccgggugguggccgccgagauggaggaggcccucagggggcuaccaauacgcuaccagacaccagccgugaagagugagcacaccggccgcgaaaucguggaccuuaugugccacgcgacguucaccacucgauugcuaagcagcacuagggucccuaacuacaaccuaaucgugauggaugaggcucauuuuacagacccuagcagcguggccgcccggggcuacaucuccacgaggguggagaugggagaggccgcggccauauucaugaccgcgacgccgcccggugccaccgacccauucccucagucaaacucccccauagaggacaucgagcgggaaauccccgagcgaucauggaauacgggauucgacuggauaaccgacuaccagggcaagacggugugguucgucccuagcauuaaggcggggaacgacaucgcaaacugccuccgcaagagcgggaaaaagguaauccagcuuucccggaaaacguucgacaccgaguaccccaagacaaagcucaccgacugggacuucguggucacuaccgacauaagcgaaaugggggcuaacuuucgcgccggccggguuaucgacccccgacguugccugaagccugugauccugaccgaugggccggagcguguuauccucgcgggucccauucccguuacgccugcguccgcggcccaacggcgcgggcgaauagggcgcaacccggcgcaagaggacgaucaguacguuuucagcggggacccccugaagaacgacgaggaccacgcgcauuggaccgaagcuaaaaugcuguuagacaauaucuacaccccagaggggaucauccccacgcuguucggcccggaacgggagaaaacucaggccaucgacggcgaguuccgcuuaagaggggagcagaggaagaccuucgucgagcucaugcggcgcggagaccugcccgugugguuaucauacaaagucgcaagcgcggggaucagcuacaaagaucgggaguggugcuucacuggagagcgcaacaaccagaucuuggaggagaacauggaagucgagauauggacccgggagggcgagaagaagaagcugcgccccaaguggcuggacgcgcgaguauacgcggaccccauggcccucaaggacuucaaggaguucgccagcggccgcaaguccaucacccuugacaucuugacggagauugccucacucccgacuuaucuguccagccgcgccaaacuggcgcucgacaacaucgugaugcuccauaccaccgagcggggcgggcgcgccuaucagcacgcacugaacgaacuacccgaguccuuggagacgcucaugcuugucgccuuacugggagcgaugacggcagggaucuuucucuucuucaugcagggcaagggcaugggcaagcuguccaugggccugauuaccaucgccguggcaagcgggcuccuauggguggcagaaauccagccccaauggaucgcagccuccaucauccuggaguuuuucuugaugguccuuuugaucccggagcccgagaagcaacgcacaccccaggacaaccagcugaucuaugugauccugacuauccugaccaucauaggccucaucgccgcgaaugagaugggacugaucgagaagaccaagaccgacuucggguucuaucaggugaaaacggagacgaccauccuugacguggaccuccgccccgccuccgcguggacccuguaugccguggccacgacuauucugaccccgaugcucagacauacgauugagaacacuuccgccaacuuaucgcuugcagcgauugccaaucaggccgccguccucaugggucugggcaagggcuggccgcugcaucgcauggaucucggggucccuuuacuggcaaugggcugcuacagccaggugaaucccaccacccucaccgcgagccuggugaugcuccugguccacuacgccauaaucggcccgggccugcaggcaaaggccacgcgggaggcgcagaagcgcaccgccgccggaaucaugaagaauccuacaguggacgggaucaccgucaucgaccuggagccuauauccuacgaccccaaguucgaaaagcagcugggccaagucaugcugcugguccucugcgcggggcagcuguuucugaugcggacuaccugggcauucugugaggugcucacccuggcuaccggccccauccugacguuaugggaggggaaccccggcagguucuggaauaccacaaucgccgugagcaccgcaaauaucuuccggggaagcuaccuggccggagcuggccuggcuuucagccuuaucaaaaaugcccaaacgcccagacgggggaccgguaccaccggggagacccuaggcgaaaaguggaagcgccaacugaacucccucgaccggaaggaguucgaagaguauaaaagaagcgguauauuggaggucgaccggacggaggcuaaguccgcgcugaaagacgggagcaaaaucaaacacgccgucagcaggggcagcuccaaaauaagauggaucguagaacggggcauggugaagccaaagggcaaggucgucgaucucgggugcggccgcggcggcuggaguuacuacauggcgacacuaaagaaugugaccgaggugaagggcuacaccaaaggugggccggggcacgaggagcccauccccauggccacguauggcuggaaccugguaaagcuccacagcgguguagacguauucuacaaacccaccgaacaaguagacacccugcugugcgacaucggggaguccagcuccaauccgaccaucgaggagggucguacucuccgagugcuaaaaaugguggagcccuggcucagcucaaagcccgaguuuugcauuaagguauugaacccguauaugccuacugucauagaggagcuggagaagcugcagcggaagcacgggggcaaccuggugcgcugcccccucucucgcaacuccacccaugaaauguacugggucucuggcgccagcgggaacaucgugucuuccguuaacacuacgagcaagaugcuacuuaaccgcuucaccaccaggcaccgcaagccuaccuacgagaaggauguagaccucggcgccgggacacguagugugagcaccgagacggagaagcccgacaugacgaucaucggacgccggcugcagcgccugcaagaggagcacaaggaaacauggcacuacgaccaagagaacccuuaccgaaccugggcguaccacggguccuaugaggccccgagcaccggcuccgccucuucaauggucaacggcguggugaagcucuuaacaaagccgugggacgucaucccuauggugacccaacuggccaugacugacaccaccccguucgggcagcagcguguauucaaggaaaagguggauacaaggacuccccaaccgaaacccggcacccgcauggugaugaccacgaccgcaaacuggcucugggcccugcugggcaagaaaaagaacccacggcucuguacccgcgaagaguucaucuccaaaguacgguccaacgccgcuauaggcgccguuuuccaggaggagcaggguuggaccuccgcuagcgaggcggugaaugacucccgcuucugggagcugguggacaaagagcgggcgcugcaccaggagggaaagugugagagcugcgucuauaacaugaugggcaagcgcgagaaaaagcucggggaguucggccgcgccaagggcucccgggccaucugguacauguggcugggcgcccgcuuccuggaguucgaggcgcucggauuccugaacgaggaccacugguuuggccgggagaacagcuggucuggcgucgagggggagggucugcaucgccucggauacaucuuagaggagauagauaagaaggacggagacuugauguaugccgacgacacggccggcugggacacccggaucaccgaggacgaucuccagaacgaggagcugauaaccgagcagauggcaccccaccauaagauccuggccaaagccaucuucaagcucaccuaccagaacaaaguugugaaagugcugcgacccacgccgcgcggggccguuauggacaucaucucacggaaagaccagcgggguuccggacaggucggcaccuacggguuaaauacguucacuaacauggagguucagcucauccggcagauggaagccgagggcgugaucacccaggaugacaugcagaaccccaaaggccugaaggagcgggucgagaaguggcuccgggaaugcgggguagacaggcucaagcgcauggccaucucuggcgacgacugcguggucaagccacuggacgagcgguucgguaccucucuacucuucuuaaaugacaugggcaaggugcgaaaagauauaccccaaugggaaccaucgaagggcuggaagaacuggcaggaggugcccuucugcucccaccacuuccacaagauuuucaugaaagacggccggagcuugguggugccgugcagaaaccaggacgagcucaucggccgggcgcgcaucucacagggcgccggcuggucucuccgcgaaacagccugucuggggaaggccuacgcccagauguggucccucauguacuuucaccggcgcgaucugcgucuggcgagcauggcaaucugcagcgccguucccaccgagugguucccgacguccagaaccacuuggagcauccaugcccaccaccaguggaugaccacagaggauaugcucaaaguuuggaaucgggucuggauugaagacaacccaaacaugauagacaagacacccgugcacucaugggaagacaucccguaccuggggaagcgugaggaccucuggugugggagccucaucggccugucuucucgggccacgugggccaaaaacauccacaccgccauaacgcagguucgcaaucugaucggcaaggaggaguacguggacuacaugcccgccaugaagcgguauucggccccuagcgagagugagggggugcucuga

SEQ ID NO: 26263 - RNA, 9867 nt, Artificial Sequence
  derived and/or modified CDS sequence (opt11) from DENV-4__FJ639736__SS-prME
agcacuaugacccuucucugucugaucccgacggcgauggccuuucaccuaucgacccgcgauggcgagccguuaaugaucguggcgaagcacgagcgggggcgcccccugcuguucaagacuaccgagggcauaaacaagugcacauugaucgccauggaucucggcgagaugugcgaggacacugucacauacaagugcccccuacuugugaacaccgagccagaggacauagacuguugguguaacuugacaagcacgugggucauguacggcacgugcacgcaguccggggagcggcgccgggagaaacguucugucgcacugacaccgcacucgggcaugggccucgagacccgggccgaaacuuggaugagcuccgagggggccuggaagcacgcgcagcgaguggaaagcuggaucuuacggaaccccggauucgcccuccucgcaggcuucauggccuacaugaucggccagaccgggauccagcgcacgguuuuuuucguccugaugaugcuggucgcgcccuccuaugggaugcggugcguaggcguaggcaaucgugauuucguugaagggguuagcgggggcgcguggguugaccucguccuggagcacggcgggugcgugacuaccauggcucagggcaaacccacccuggacuucgagcucacgaagaccaccgcaaaggaggucgcccugcuccggaccuauugcaucgaggcccucaucucuaacaucaccaccgcgacccgcugcccgacccagggggagcccuaccugaaggaggagcaggaccagcaguacaucugccgccgcgacgugguugaccggggcugggguaacggaugcggccuguucgggaagggcggggucgugacgugcgccaaauuuagcugcuccgguaagaucacggggaaccugguacaaaucgagaaucuggaguacacagucguggugacugugcauaacggcgacacgcacgccguuggcaacgacacaagcaaccacggcgucacggccaccauuacgccccgcucccccagcguggaagugaagcugccggacuauggggaacuuacucuggacugcgagccccguuccgggaucgauuucaacgagaugauacugaugaagaugaagaagaaaacgugguugguucacaaacagugguucuuagaccugccgcuccccuggaccgcgggcgcagauaccucagagguccacuggaauuacaaagagaggaugguaacuuucaagguaccgcacgccaagcggcaggacgugaccguacuggggagccaggaaggcgccaugcacucagcacuugcgggagcgaccgagguugacagcggggacggcaaccacauguucgccgggcaccucaaaugcaaggugcgcauggaaaaacugaggaucaagggcaugucauauaccaugugcagcgggaaauuuuccaucgauaaggagauggccgagacacagcacgguaccaccguggucaaggugaaguaugagggcgccggugcgcccugcaaggugcccauugagauacgggacgucaauaaggagaagguugucggccgcguuaucucuucuacacccuuagccgagaacacgaacucgguaaccaacaucgaguuggaaccgcccuuuggggacuccuacauaguaaucggcguagggaacucggcgcucacccugcauugguuccguaaagggucgagcaucgguaagauguucgagucaaccuaccguggggcgaagagaauggccaucuuaggcgagacugccugggacuucgggagcguuggcggccuguucaccucccuggggaaagcagugcaccaggucuucggcucgguguauaccacuauguucgguggcguauccuggaugauccgcauauugauuggguuccugguccuguggauagggacgaacucucgaaacaccucuauggccaugaccugcaucgcggugggagggaucacacuguuccucggguucacgguacaggcggauauggggugugucgucagcugguccgggcgcgagcugaagugcgggucaggcaucuucgugguugacaacguucacaccuggaccgagcaauauaaguuccagccagagagccccgcgcggcucgccuccgcgauccugaacgcccacaaggauggcgugugcgggauccgcagcaccacgcgucuggagaaugucauguggaagcagaucacgaacgagcugaacuauguuuuaugggagggcgggcacgacuuaacaguagucgcgggugaugucaaaggaguacugacgaaggggaagcgcgcccucacucccccuguguccgaccucaaauacucauggaaaacuuggggaaaagcaaaaaucuucacccccgaggcacggaacucaaccuuccugauagacgggcccgacacgagcgagugcccgaacgagagacgcgcuuggaacagccucgaaguagaggacuauggauuugggauguucacuacgaacaucuggaugaaauuucgugagggcucgagugaggugugcgaucaccgguuaaugucggcggccauaaaggaccagaaggccgugcacgcagauaugggcuacuggaucgaguccucaaagaaccagacuuggcaaaucgagcgcgcgucccugaucgaggugaagacgugucuauggcccaaaacacacacccuauggagcaacggaguacuugagucccagaugcucauccccaaaaguuaugcgggcccguucagccagcauaacuaccgccagggcuacgcaacccagaccguaggccccuggcaccuggggaagcuggagaucgacuucggagaaugccccggaaccaccgugaccauacaggaggacugcgaccaccguggucccagucuccggacaacgacugcaagcggcaagcuggugacccaguggugcugccggagcugcaccaugccaccccugagauuucucggggaagauggcuguugguaugggauggagauuaggccguugucugaaaaggaggagaacauggucaaaucccaggugacggccggccagggcacaagcgagacauucuccauggggcugcuuugccugacacuuuucgucgaggagugcuuacgccggagagugacccggaaacacaugauucuggcaguggucaucacccugugcgccaucauccucggagggcugaccuggauggaccugcuuagagcacuaauuaugcuaggcgacaccaugagcggccggaucgggggccagacgcaucucgccaucauggcuguauucaagaugaguccaggguacgugcugggcgucuuucuacgcaagcucacuucgcgggagacagcguuaaugguuaucgggauggccaugaccacgacccuguccauaccccaugaccucauggagcugaucgauggcaucagccuaggcuuaauccuguugaaaaucguuacccaguucgacaacacccaagucggcacucucgcuuuauccuugaccuucaucaggagcaccaugagucuagugauggccuggcggaccaucauggccguccuguucgucgugacgcugaucccccuaugccgcaccucuugcuuacagaagcagucgcacuggguggagaucacugcgcuaauucugggagcccaggcacuuccgguauaccugaugacucucaugaagggggccuccaggcgcuccuggccucugaaugagggaauaauggcgguagggcuuguuagccuucugggcuccgcgcugcucaagaacgaugugcccuuagccgguccaaugguggcagggggccuauuacuggccgcguauguuaugagcgggucguccgcagaccugagucuggagaaggccgccaacguccagugggacgagauggccgacaucaccggcucaagucccaucaucgaagugaaacaggacgaggacggguccuucagcauccgggacguagaggagacaaauaugaucaccuugcugguuaaacuagcgcucaucaccgucagcggcuuauacccccuagcgauaccggugacgaugacccucugguacauguggcagguaaagacccagcgcucuggugcccugugggacguacccuccccugccgccacgcagaaggcggcccucagugaagguguguaccgcaucaugcagagaggcuuguucgggaagacccaagucggugugggaauacacauggaaggaguguuccacacgauguggcacgucacgcgcggcucagugauaugucacgagaccgggcggcuagagccaagcugggcugacgugaggaacgacaugauauccuacggagguggcuggcggcucggcgacaaaugggauaaagaggaggacgugcagguucucgccaucgaaccggggaaaaaccccaagcacgugcagaccaagccgggccuuuuuaagacacuaaccggggagaucggcgccgucacacuggacuucaaacccgggaccagcggcucccccaucaucaaccgcaagggcaaggugaucgggcuguacggcaacgggguggucaccaagaguggugauuauguuuccgcgaucacucaagccgagcggaucggggaaccugacuaugaaguagacgaggacauuuuccgcaagaagcggcuaaccauuauggaccuccacccaggagcaggcaagaccaagcgcaucuuaccgucuauaguucgggaggcccugaagcgccggcuccgcacccuaauauuagcgcccacccgggugguggccgccgagauggaagaggcccuccguggguuaccgauccgguaccagacccccgccgucaaauccgagcacaccggccgcgaaauaguggaucugaugugccacgcgacguucacaacucgucucuuaagcagcacacgggugccgaacuacaaccugaucguuauggacgaggcccauuucacggaccccucaagcguagccgcacgggguuacaucaguacucguguugagaugggcgaagccgcggccauuuucaugacugcuaccccccccggugccacggacccauucccccagagcaauagucccaucgaggauaucgagcgggaaauacccgagcggagcuggaacacaggcuucgacuggaucaccgacuaccaaggcaagacagucugguucguaccaucgaucaaagccgggaacgacauugcuaacugcuugcgcaagagcggcaagaaggugauccagcuaucgcggaaaacguuugacacagaguaucccaagaccaaacugacugacugggauuuuguggucacgaccgacaucucugagaugggggcgaacuuccgcgccggucgcgucaucgauccgcgcaggugucucaagcccgugauccuaaccgacgggccggagcgcgucauccuggccggcccgauccccgucacacccgcaagugccgcccagcggcguggcagaaucgggcgcaaccccgcacaagaggacgaucaguacguguucucaggugaccccuugaagaaugaugaggaccacgcccacuggacugaagcuaagaugcugcuugacaauaucuacacccccgaggggaucauuccaaccuuguuuggcccggaacgugagaagacccaggcaaucgacggugaguucaggcuaaggggagaacaacgcaagacguuuguugaacuaaugcgucguggggauuugcccgucuggcugagcuacaaggucgccucagcagggaucuccuacaaagaccgggaguggugcuuuaccggugaaagaaacaaccagauccuugaggaaaacauggagguugagauuuggacccgggagggggagaagaagaagcuccgaccccgguggcuggaugcccgcgucuacgcagaccccauggcccuaaaggacuucaaggaguucgcuuccggccgcaaguccaucacccuggauauccugaccgagaucgcgagcuuaccuaccuaccugucaagccgggccaaauuagcgcuggacaacaucguuaugcuccacacuaccgaacgcggcggccgugccuaccaacacgccuuaaacgagcugcccgagagccuagagacccugaugcugguggcccuccugggcgcgaugacggcagggauuuuccuguuuuucaugcagggcaaagggauugggaagcuuucgaugggccugaucaccauugcagucgccagcggguuacucugggucgccgagauccagccccaauggauagcagcaaguaucauccuggaguucuuccuaauggugcucuugauccccgagccagagaagcagagaaccccucaggacaaucagcugauuuaugucauccugacgauucugacgaucauuggucuuauugcagcaaacgaaauggggcucaucgagaagaccaagaccgacuuuggcuucuaccagguaaagacggagacuaccauacuggacguggaccuacgaccggcgagugcauggacccucuaugcggucgccaccacgauccugaccccuaugcugcgacacacuaucgagaauacauccgcgaaccucucacuggcagcgaucgccaaucaggccgcgguucuuaugggccucggcaagggguggccccugcacaggauggaucugggggugcccuuacuggcaaugggcugcuauucccaggucaaccccacgacguuaacggcgagucucgugaugcuucuugugcauuacgccaucauugggccgggcuuacaggcaaaggccacccgggaggcacagaagcggacggccgccgggaucaugaaaaaccccaccgucgacgguaucaccguaauagacuuggagcccauuuccuacgaucccaaauucgagaagcagcucgggcaggugaugcuccugguccucugcgccggacaacugcugcuaaugcguaccacaugggccuucugcgaagugcugacccuagcgaccggcccgauccuuacccucugggaaggcaaucccggccgguucuggaacacgaccauugcagugagcaccgcuaauaucuuccgcgguuccuauuuggccggggccggccuggcguuuagccuuaucaagaacgcccagaccccacgccgugggacgggcaccacgggggagacccugggcgagaaauggaagcgucagcugaacucguuagaucgcaaagaguucgaggaauacaaacggaguggcauccuagaggucgaucgcacggaggccaaguccgcacugaaggacgggucaaagaucaagcacgccgugucccgaggaaguuccaagauucguuggauugucgagcgggggauggucaagccuaagggcaaggugguggaucucgggugcggccggggcggguggagcuacuauauggcgacauugaagaacgugacggaggugaagggcuacaccaaggggggcccgggccaugaggagcccauccccauggccaccuacggauggaaucuagugaaacuccauucuggcguugacguuuucuacaagcccaccgaacagguggauacgcugcugugugacaucggcgaaucaagcuccaacccgaccauagaggaaggccgcacucugcggguucugaagaugguggaacccuggcugagcuccaagcccgaguucugcauuaagguucugaaucccuacaugccaacggucaucgaggagcucgagaaguugcagcguaagcacgggggcaaccugguacgcugcccccucagccgcaauuccacccacgagauguacugggucucaggcgccuccgggaacaucguguccagugugaacacaaccagcaagaugcugcuuaaccgguucaccaccagacacagaaaaccgaccuacgagaaagacgucgaccucggcgccggcacucgguccgugucaacggagaccgagaagcccgauaugacaaucaucggacggcgcuugcagcggcuccaggaggagcacaaggaaacguggcauuacgaucaggagaacccguaucgcaccugggcguaccacggcaguuaugaggcccccagcaccggcucggcaagcucaaugguaaacggaguggugaagcuccugaccaagcccugggaugugaucccgauggucacccagcuggccaugacagacaccacccccuucgggcagcagcgaguauucaaggaaaagguggacacucgcacaccccagccaaagccgggcacccggauggucaugacgaccacggccaacuggcucugggcgcuucugggcaaaaagaagaaccccagacucuguacacgggaggaguucaucagcaagguccgcagcaaugccgcgaucggugccguguuucaagaggagcaaggguggaccuccgcuuccgaagcagucaacgacucccgguuuugggagcugguggacaaggagcgcgcucugcaccaggagggcaaaugcgagucuugcguuuacaacaugaugggcaagagagagaagaagcuaggggaguucggccgggccaaggggagucgagccaucugguacauguggcugggagcccgguucuuagaguucgaggcacucggauuccugaacgaagaccacugguuuggccgcgaaaacucauggucgggcguggagggggagggguuacaucggcucggauauauccuagaggagauagacaagaaagacggggaccugauguaugccgacgacaccgccgguugggacacgcgcaucaccgaggaugacuuacagaacgaagaacugaucaccgaacagauggcgccccaucacaagauccuggcaaaggccauuuucaagcucaccuaccaaaacaaaguugugaagguucugcggccaacaccgcgcggggccguaauggacauaauuucucgaaaggaucaacgcggcucuggacagguaggcacguacgggcugaacaccuucaccaacauggaaguccagcucauccggcagauggaggcugagggcguuauaacccaggacgacaugcagaacccgaagggccugaaggagcggguggaaaaauggcugcgggagugcggggucgaccgccucaagcggauggccaucaguggcgacgauugcgugguuaagccccuggaugagcguuuugggacuucccuguuguuccuaaacgacauggguaaaguacggaaagacaucccacagugggagccgagcaagggguggaagaauuggcaggagguuccuuucuguucccaccacuuccacaagauauuuaugaaggacggacgcagccuggugguccccugccggaaucaagacgagcuuaucggccgagcgcgcaucucccagggggcuggcuggagccugcgagaaacugccugucuggggaaggccuacgcccagaugugguccuuaauguacuuucaccggcgggacuuaaggcuggcgagcauggccauuugcucggccgugcccaccgaaugguucccgacaagcagaacgaccuggagcauccacgcccaccaccaguggaugaccacugaagacaugcucaagguguggaacagagucuggauugaagacaauccaaauaugauugacaagacaccaguacacucuugggaggacauucccuacuuaggcaagcgggaagaccuaugguguggaucccuuaucggccuguccagccgagccacuugggcuaaaaacauacacaccgcuaucacccaagugcggaaucugauuggcaaggaggaguacgucgauuacaugccggucaugaagagguacagcgccccaagcgaauccgagggggugcucuga

SEQ ID NO: 26264 - RNA, 9867 nt, Artificial Sequence
  derived and/or modified CDS sequence (opt11) from DENV-4__FJ639737__SS-prME
agcaccauaacccuacucugccugauccccacggugauggccuuccacuuguccacccgugacggcgagccccuuaugaucguugccaagcaugagcgggggcgacccuuauuguucaagacgacggaaggcaucaauaaguguacgcucaucgcgauggaccucggcgagaugugcgaggacaccgugaccuacaaaugcccccugcucaucaacacggagccagaagauaucgacugcuggugcaaccugacgagcaccugggugauguacggcaccugcacacaaucuggggaacggcgcagggagaagcgaagcguugcccucacgccgcacuccggcaugggccucgagacccgggcagaaaccuggaugucuagcgagggggccuggaagcacgcccaacguguugagagcuggauccugcggaaccccggcuuugcgcugcucgccggguucauggcuuacaugaucggccaaaccgggauccagcgcaccguguucuucgugcugaugaugcugguggcucccuccuacggcaugagaugcgugggcgucgggaauagagacuucguggagggcguuagcgggggcgcguggguagaccucgugcuggagcacggggggugugugacaaccauggcacagggcaagcccacgcuggauuucgaacucacaaagaccaccgccaaggaggucgcucugcuccggaccuacugcaucgaagcccucaucaguaauauaacgaccgcgacccgcugcccgacucagggggagcccuacuuaaaggaagagcaggaccagcaguacaucugccggagagacgugguggaccggggcuggggcaacggcuguggcuuauucggcaagggcgggguggucacgugcgccaaguucagcugcuccgguaagauaaccggaaaccucgugcagauugaaaaccucgaauacaccgucguuguuaccguccacaacggugacacgcacgcggugggcaacgacaccagcaaccacgggguaaccgcuacuaucacccccagaucccccucgguggaggugaagcugccggacuacggcgagcucacccuggauugugaaccccgguccgggaucgacuucaacgagaugauccugaugaagaugaagaaaaagaccuggcucguccacaaacagugguuucuugaccugccccuccccuggaccgccggcgcggacacgagcgagguccauuggaacuacaaggagaggaugguuacguuuaaggucccgcacgccaagcggcaggaugucaccgugcuggggucgcaggaaggugccaugcacagcgcccuggcgggcgcgacugagguggacuccggggacggcaaucacauguucgccgggcaccucaagugcaaggugcgcauggagaagcugcgcaucaaagggaugucguauaccaugugcagcgguaaguuuuccaucgacaaggaaauggcggagacgcaacauggcaccaccguggucaaggugaaguacgagggcgccggggccccauguaaagugccuaucgagauacgugacguuaacaaggagaaaguggugggccgcguaaucagcucuaccccacuggcggagaauacgaacagcgugaccaacaucgagcuugaaccgcccuucggggacucguauaucguaaucggcgucggcaacagcgcacucacccugcauugguuccggaaaggguccagcaucggcaagauguucgagucgaccuaccgcggggcaaagcggauggcgauccuuggagagacggcgugggacuucggaucugugggaggcuuauucacaucccuggggaaggcaguacaccagguauucggcagcguguacaccacgauguucgggggagugucauggaugauccgcauccugaucggguuccuugugcuguggaucggaacgaacucuaggaacacguccauggccaugaccugcaucgccguaggcgguaucaccuuauuccuuggcuuuacgguccaggcugacauggggugcgucgugaguugguccggucgcgagcugaaaugcgggagcggaaucuuuguggucgacaacgugcacaccuggaccgagcaguacaaguuucaaccagagagccccgcccgauuggcgucugcaauacucaacgcgcauaaggacggugugugcgggauccgcagcaccacgcgccuggagaacgucauguggaagcagauaaccaacgagcugaacuacgugcucugggagggcgggcacgaccugaccguggucgccggcgacguaaagggcgugcugaccaaagggaagcgggcguuaacaccgcccgucuccgaccugaaguacagcuggaagacuuggggcaaggccaagauauucacccccgaagcccggaacuccaccuuccugaucgacggucccgacacgagcgagugcccuaacgaaaggcgggcuuggaacucccuugaggucgaggacuacggcuucgggauguuuaccaccaauauuuggaugaaauucagagagggcagcuccgaggugugcgaccaucgccugaugagugcggcgaucaaggaccagaaggcaguacacgcagacaugggauacuggaucgaguccagcaaaaaccagacuuggcagauugagcgcgcaucccugauugaggugaagacaugucucuggcccaagacccacacucuguggagcaauggggugcuggagucccagauguugauccccaaaagcuacgcgggaccguucucccagcacaauuaccggcagggcuacgccacccagaccgucgggcccuggcaccuugggaagcuggagaucgacuuuggugagugccccggcacgaccgugaccauccaggaggacugcgaucaccgcgggccaucucuccgcaccacgacugccagcggcaagcuuguuacgcaauggugcugccggucgugcaccaugccgccccugcgcuuccucggggaggacggcuguugguacgggauggagaucagaccccugagcgagaaagaggaaaacaugguuaagagucaggugacugcuggccagggcaccucugagaccuuuuccauggggcugcucugccuaacccuguucguugaggagugcuuacgccgucgcgucacucggaagcacaugauccuagcuguggucaucacccugugcgcgaucauucucggcgggcugaccuggauggaccugcuccgcgccuuaauaaugcuuggcgacaccaugagcggacgaauugggggccagacgcaccucgccaucauggccguauucaagaugucccccggguacgugcugggcguauuccugcgcaaguuaaccagccgggagacagcccugauggugaucgggauggcgaugaccacgacccugaguaucccccaugaucucauggagcuuauugacggcaucagccuaggguugauccuccuaaagaucguuacucaauuugaugacacccaggucgggacgcucgcacugucccuuacauucauacguucuaccaugagucuagugauggcguggcggacgaucauggccguguuguucguggugacgcugaucccccucugccgcaccagcugccugcagaagcagucccacuggguggagaucacagcauuaauacucggcgcgcaagcccugcccguguacuuaaugacccuuaugaagggggccagccgccgcucuuggccccugaacgagggcaucauggccguggggcuggugagccuccugggguccgcucugcucaaaaacgaugucccccuggcagggcccaugguggccggaggcuuacuacuggccgcuuacgugaugucgggaucauccgccgaccugagccucgagaaagccgcgagcguccagugggacgaaauggccgacaucacggggucgucccccaucaucgaggugaagcaggacgaggacgggucauucuccauccgggauguggaggaaaccaauaugaucacccugcuggucaagcucgcccugaucaccguuagcggccuuuacccccucgcgauuccggugacgaugacccucugguacauguggcaggucaagacccagaggaguggcgcccugugggacgugcccagccccgccgcaacccagaaggccgcccuguccgaggggguauaucgcaucaugcagcgcggccuguucgggaagacccagguaggcgugggcauucacaucgagggaguauuccacacgauguggcacguuacccggggaagugugauaugccacgagacugggcgccuggagccaaguugggcagacgugcgcaaugauaugauaucguacggcggggguuggcggcucggcgauaagugggacaaggaggaggacguucagguccuggcaauugagccagggaagaaccccaaacacgugcagacgaagcccggccuguucaagacgcucaccggggagaucggcgccgucacccuggacuucaagcccgguaccuccggcuccccgaucaucaacagaaagggcaagguuauagggcuguacggcaaugggguggucacgaaaucgggcgacuacguaagcgccaucacccaggccgagcgaauuggggagcccgacuacgagguggacgaggacaucuuccguaagaagcgguuaaccaucauggaccugcaccccggcgccggcaaaacgaagcgcauucugccguccauaguccgggaggcccugaagcgccggcuccggacgcuuauccucgcccccacccggguaguugccgccgagauggaggaggccuuacguggucuccccaucagguaccagacacccgcugugaagagcgagcacaccggccgcgagaucguggaucucaugugccacgccacguucaccaccagacucuuaucguccacgcgcguacccaacuacaacuuaaucguuauggacgaggcgcacuucacggaucccagcuccguugccgcccggggauacaucagcacccgggucgagaugggugaggcagccgcgauauucaugaccgcaaccccccccggggcaacggacccauucccccaauccaacagcccuaucgaagacaucgagcgugagauccccgaacgcuccuggaacacaggauucgacuggaucaccgacuaccagggaaaaaccgugugguucgugccuagcauaaaagccgggaacgauaucgccaacuguuugcgcaagagcggcaagaaggucauccagcugagccggaagacauucgacaccgaguaccccaagaccaagcugaccgacugggacuucguugugaccaccgacaucagcgagaugggggcgaacuuccgugcgggccgcgucaucgacccccgccggugccuaaagcccguuauccugaccgacggaccggagcgagugaucuuagccggucccauaccggucacccccgccagcgcggcgcagcgucgaggcagaaucggccgcaacccggcccaagaggacgaccaguacgucuucuccggcgacccgcucaaaaacgaugaggaccacgcccacuggacggaggccaagaugcuucuggacaacauuuauacccccgaggggauaauccccacccucuucggccccgagcgggaaaagacccaagcgaucgacggugaguuccgccugagaggcgagcagcgcaagacguucguggagcugaugcgacgcggagaccuccccguuuggcugagcuauaaaguggccuccgccgggauuucuuacaaggaccgggaguggugcuucaccggcgagaggaacaaccagauccuggaggagaacauggagguggagaucuggaccagggagggagagaaaaagaagcuccgcccccgguggcuagacgccagagucuacgccgacccaauggcgcugaaggacuuuaaggaguucgccucgggccgcaagucaaucaccuuggacauauuaacggagaucgccucccugcccacguaccucucuagccgggccaagcuggcccuggacaacaucgugauguuacacaccaccgagcgcggcgggcgggcguaccagcaugcccugaacgagcugcccgagucccucgagacccugaugcuaguggcacuccugggagccaugacggcggggaucuuccuguucuucaugcagggcaagggcaucggcaaacugucuaugggccugaucacaaucgccgucgccucuggucuucucuggguagccgagauacagccccaauggaucgccgccucuaucauccuggaguucuuccugauggugcuccuuaucccggagcccgaaaagcagcgcaccccccaggacaaccagcugauuuacgugauccugaccauccugacaauuaucggccugaucgccgcaaacgagauggggcuaaucgagaaaaccaagaccgauuucggcuuuuaccaggugaaaaccgaaacgaccauccuggacguggaccuaaggccugcgucugcuuggacccucuacgcugucgcaaccacgauccugaccccgaugcugcgccauacgaucgagaacacuagcgccaacuugucccuggcggccaucgcgaaucaggccgccgugcuuauggggcucggaaagggcuggccacugcaccguauggacuuaggggugccccuccucgccaugggcugcuacagccagguaaaccccacuacccugaccgccucccucgugaugcugcugguccacuacgcaaucaucggaccgggccuccaagcgaaggccaccagagaagcccaaaagcggacggcggccggcaucaugaagaaucccaccgucgacgggauaaccgugaucgaccuggagcccaucuccuaugacccaaaauucgagaagcagcuuggccaggucaugcuccuggugcugugcgccgggcagcuccuucuaaugcgcacgaccugggccuucugcgaggugcucacccuggcuacaggcccgaucuuaacccuuugggaggggaaccccggacgguucuggaacacgacaaucgcgguguccaccgccaacauuuuccgcggcagcuaccuggccggggccggucuugcuuuuucccuaaucaagaaugcgcagaccccccggcgcgggacgggcaccaccggggagacccuuggugagaaauggaagaggcagcugaacagccucgaccgcaaagaguucgaggaguacaagcgcuccggcaucuuggaggucgaccgaacugaggccaaguccgcccugaaggacggguccaagaucaagcacgccguuagccggggcuccucaaagauacgcuggaucguggagcgcgggauggugaaacccaagggcaaggugguggacuuagggugcggccgcggcggcuggagcuacuacauggcgacgcuuaagaacguaaccgaagugaagggauacacuaagggggggccggggcaugaggagcccauccccauggcgaccuaugguuggaaccuggugaagcuucauuccggaguggacguauucuacaagcccauagagcaggucgacacucuacugugugacauaggugagaguuccagcaaccccaccaucgaagaaggccgcacccuacggguccugaagauggucgagccauggcuguccagcaagcccgaguucuguauuaaagugcugaaucccuacaugccgaccguuaucgaggagcuagaaaagcugcagcgcaagcacggcggcaaccucgugcgguguccccucucccgcaacagcacgcacgagauguacugggucuccggcgccagcgggaacaucgugagcagcgucaacacuaccuccaagaugcugcugaaccgguucaccacgcgccaccggaagcccaccuaugagaaagacguugaccuuggcgcuggcacgcgcagcgucuccacggagacggagaagcccgacaugacgauuaucggcagacgccugcaaagacugcaggaggagcacaaggaaaccuggcacuacgaccaggagaacccguaccgcaccugggccuaucacgggagcuaugaggcgccaucuacggguagcgccuccagcauggugaacggugucgugaaacuccugaccaagcccugggacguaaucccgauggucacccagcuggcuaugaccgauacgacccccuucgggcagcagcgcguguuuaaggaaaagguggacacacgcaccccccagcccaaaccgggcacccggauggucaugaccaccaccgcaaacuggcuuugggcccugcuggggaagaagaaaaacccacgccuuugcacgcgggaggaguucauaagcaaggugagauccaacgccgccaucggcgcuguguuucaggaggagcagggauggaccagcgcguccgaggcagucaacgauagccguuucugggaguuaguggacaaggaacgcgcgcugcaccaggagggcaaaugugaauccugcguguacaacaugaugggcaagcgcgagaagaagcucggugaguucggacgggccaaagggagccgugccaucugguacauguggcugggcgcccgcuucuuggaguucgaggcacucgguuuccugaacgaggaccacugguucggccgcgagaacuccuggagcggcgucgagggagaaggacuacauagacucgguuauauccuggaagagaucgacaagaaggauggcgaccugauguacgcggacgacacagccggcugggacacccguaucacggaggacgaccugcagaacgaggagcugauuaccgagcagauggccccgcaccacaaaauucuggccaaagcgaucuucaaacucaccuaccagaacaagguggugaagguccugcggccgaccccgcgcggggccgugauggacaucauuucccguaaggaccagcgcggaagcggucaggucggcaccuacggguugaacacauucaccaacauggagguccaacucauccggcagauggaggccgagggcgugaucacccaagacgacaugcagaacccuaaaggccucaaggagcgcguggaaaaguggcugcgggaaugcggggucgaucgcuugaagaggauggccaucagcggagacgacugcguagugaagcccuuagacgaacgcuucgggaccucacugcuauuccugaacgacaugggcaagguaaggaaggacauaccacagugggaaccgaguaagggguggaagaacuggcaggaggugccauucugcucacaucacuuccacaagauuuucaugaaggacggccgcucccugguggucccgugccggaaucaggacgagcucaucggccgcgcccgcaucagccagggggcagguuggucgcucagggagacggccugucucgggaaggcauacgcccagauguggucccugauguauuuucaccgccgggaccuucgcuuggcgucgauggcgaucugcucugccgugcccacugagugguucccuaccagccggaccacgugguccauacacgcccaccaccaguggaugaccaccgaagacaugcucaagguguggaaucgcgucuggauagaggauaaccccaacaugauagacaagacucccguccacuccugggaggacauccccuaucucgguaagcgggaggaccuguggugcgguucccucaucggucugagcuccagagccacgugggcaaagaacauacacacagcaaucacucaggugcggaaccugaucggcaaggaggaguacguugauuauaugccggugaugaagcgcuacucugcgcccuccgagagcgagggugugcucuga

SEQ ID NO: 26265 - RNA, 9867 nt, Artificial Sequence
  derived and/or modified CDS sequence (opt11) from DENV-4__FJ639738__SS-prME
ucgacgaucacccugcucugccugauccccaccgugauggccuuucaccugucaacgcgcgacggggagccccucaugaucgucgccaagcacgagcgggggcgcccccugcuuuuuaagacaaccgagggcaucaauaagugcacguuaauugccauggaccugggggagaugugcgaggacacuguuaccuacaaguguccccugcucguuaacacugagccugaggacaucgacuguugguguaaccugacgucgaccugggucauguacgggaccuguacucaguccggggagaggcgccgggagaagagaagcguagcccugacgccgcacuccggcaugggccucgagacccgagccgagaccuggaugagcucugagggggccuggaagcacgcccagcgcgucgaguccuggauccugcggaaucccggcuuugcgcuccuugccgguuuuauggcauauaugauaggccagacaggcauccagcgcacgguguucuucgugcugaugaugcugguggccccuuccuacggcaugcgcugcgucggcgugggcaaccgcgacuucguggagggcgucagcggaggggcuuggguggaucuuguacuggagcacggagggugcgucaccaccauggcccagggaaagcccacucuggacuucgaacucacuaagacuaccgccaaagaaguggcucugcugcguacguauugcaucgaagcgcucaucuccaacaucacgaccgcgacucgcuguccgacccagggagaaccuuaccugaaggaggaacaagaccagcaauauaucugccggcgcgacguggucgaccggggcugggggaacgguugcggccucuuugggaaaggcgggguggugaccugcgcgaaguucagcugcucgggcaagaucacugggaaccucguccaaaucgagaaucuagaauauaccgugguggucacagugcacaacggcgauacgcaugcggucggcaacgacaccagcaaccacggcgugaccgcgacgauuacgccccgcuccccaagcguggagguaaaacugccggacuacggcgaacucacccuggacugcgagccucgguccgggauagacuucaacgagaugauucugaugaaaaugaagaagaagaccuggcucguacauaagcagugguuucuugaccuaccguugcccuggaccgcaggcgcagacaccagcgaggugcauuggaacuauaaggaacgcaugguaacguucaagguuccgcacgcuaagcggcaagacgugaccguccugggaucccaggagggcgccaugcacucagcccuggccggcgcgaccgagguggacagcggggacggcaaccauauguucgcgggacaccucaagugcaagguccgcauggaaaagcugagaauaaaggguauguccuacacuaugugcagcggcaaguucuccaucgacaaggagauggcugagacgcagcacgggaccaccguggugaaggugaaguacgagggcgcaggcgcaccuugcaagguccccaucgagauccgggacgugaacaaggagaaggugguugggcgcgugaucagcuccaccccucuggcggagaauacaaacucggugaccaacaucgagcucgagccgccuuucggcgacuccuacauugucaucggggugggcaauucggcccucacucugcauugguuccggaaagguagcagcaucggcaaaauguuugaaagcacguaccgcggagccaagaggauggcgauuuuaggggagacggccugggacuucggaucugugggaggccuguucacaucgcuggggaaggccguccaccaaguuuucggcucuguuuauaccacaauguucgggggcgucucauggaugauccgcauucuaauuggguuccuggugcuguggaucgggaccaacagccguaacaccuccauggccaugacguguaucgcgguuggcgggaucacccuguucuuaggauucacgguucaggccgauaugggguguguggugaguugguccggccgcgagcugaaaugcgggucgggcaucuuugucguggacaacgugcauacguggacugaacaauacaaauuccagcccgagucacccgccaggcuggccucagccauacucaacgcccacaaggauggcguaugcgggauccguagcaccacgcggcuggagaacgucauguggaagcaaauaacuaacgaacugaacuacgugcucugggagggcgggcaugacuuaaccgugguggccggcgacguuaagggcguccucaccaaggggaaaagggcgcucaccccgcccgugagugaccugaaguacucuuggaagaccugggggaaggccaaaauuuuuacuccugaagcccggaacucaacguuccugaucgaugggccggacacgagcgagugcccgaacgaacggcgggccuggaacucauuagaggucgaggauuacggcuucgggauguucaccacaaacaucuggaugaaauuucgcgaggggucguccgaagucugcgaccaccggcuaaugagcgccgccaucaaggaccagaaagcggugcacgccgacaugggauacuggauugaguccuccaaaaaucagaccuggcagauagaacgcgccucucugauugagguuaagacgugccucuggcccaagacccacacgcuguggagcaacgggguccuggagagucagaugcucauccccaagaguuacgcggggccguucucccagcacaacuaccggcaaggguacgccacccaaacugugggccccuggcaccuggggaaguuggaaaucgacuuuggagaguguccuggcacgaccgugacgauccaagaggacugcgaccaucgcggccccagccuccgcaccaccaccgcgagcggcaagcuggucacccaauggugcugccgguccugcaccaugccaccccugagguuccucggggaggauggcugcugguauggaauggaaauucguccccugagcgagaaggaggaaaacauggugaaaucgcagguaacggcaggccagggcaccagcgaaacauuuuccauggggcugcucugucugacacuguucguugaggagugccugcgacgucgggugacgcggaagcacaugauacuggcggucguaauaacccuuugugcgaucaucuuaggagggcugacuuggauggaccuguuacgcgcgcugaucaugcugggugacacgaugagcggccggaucggaggccaaacgcaucucgcaaucauggccguguuuaagaugucccccggguacgucuuagggguguuccuacgccgguugacgagccgcgagacagccuuaaugguuauuggaauggcgaugaccaccacccugaguaucccucaugacuuaauggagcugaucgauggcauaucgcugggccucauccugcucaagauaguuacccaguuugacaacacccagguggggacgcucgccuuaucccugacuuucauccgguccaccaugagccuagugauggccuggcguaccauaauggccgucuuguucguggugacgcugauaccccucugccggaccucaugccugcagaagcagagccauugggucgagauaaccgcccuaauacucggcgcacaggcccugccaguuuaccugaugacccucaugaagggggcuagccgacgaucguggccccugaacgagggcaucauggccguggggcuggucagucugcugggcuccgcgcuucucaaaaacgacguuccgcuggccggaccuaugguggccgggggccuuuuacuggccgcuuacgucaugagcggguccagcgcagaccugagccucgagaaggccgccaacgugcagugggacgagauggccgacaucacgggcuccucucccaucauagaggucaaacaggacgaggacggcuccuucagcauccgcgacgucgaagaaaccaacaugaucacgcugcucguaaagcucgcccugauaaccguguccggccuauacccccuugcuaucccggucacgaugacgcugugguauauguggcaagugaaaacccaacgcucuggcgcccugugggacguuccaucccccgccgcgacucagaaggccgcgcuuucggagggggucuaccgaaucaugcagcguggucuguucgggaagacucaggugggcgucgggauacauauggaaggcguguuccacacgauguggcacgucacgcgcggcaguguuaucugccacgagaccgggcgccuggagcccagcugggccgacguccggaaugacaugauauccuacggagggggcuggcgccucggugacaagugggacaaagaagaggacgugcagguacuugccguugaaccggguaagaacccuaaacacgugcagaccaagcccggucuguuuaagacgaucaccggugagaucggggccgugaccuuggauuuuaagcccggcacaagcggcuccccgauuaucaaccggaagggcaaggucaucgggcuguacggcaacggcgugguaacgaagaguggcgacuacguaucugccaucacccaggcggagcgcaucggggagcccgacuacgaaguggacgaggacauuuuccggaagaaacgccucaccauuauggaccuccaccccggggccggcaagaccaagcggauauuaccgucuaucguucgcgaggcccuuaagcggcgccugcggacgcucauccuugccccaacgcgcgucguggcggccgaaauggaggaggcccugcgagggcuccccauccgcuaccagacccccgcaguuaaguccgagcacaccggccgggagaucgucgaccuaaugugccacgccacguucaccacccgccugcuuucuagcacacgggucccgaauuauaaccuaauagucauggacgaggcgcacuucacggaccccuccagcguggccgcccgcggguauauauccacccggguggaaaugggagaagccgcugcgauuuucaugacagcuacaccacccggggccaccgauccuuucccgcaauccaacucccccaucgaagacaucgagcgagaaauccccgagaggaguuggaacaccggcuucgacuggauaaccgacuaccagggcaaaacgguaugguucgucccguccauaaaggcugggaacgacaucgcuaacugccugcgaaaaagcggcaaaaagguaauccagcucuccaggaagacguuugacaccgaguacccgaagacgaaacuuacggacugggacuucguggucacgaccgacauuucugagaugggggcgaacuuccgggccggccgcgugauagacccccguaggugccuuaagcccgugauccucacagacgggccggaacgggugauccuggcuggaccaauucccgugaccccagccuccgcggcccagcgccggggcaggauaggacggaaccccgcacaagaggaugaucaguaugucuucucuggcgacccccugaagaaugacgaagaccacgcgcacuggacggaggccaagauguuauuggacaacauauacacccccgagggaaucauccccaccuuauucggcccagagcgagaaaagacacaggcgaucgacggcgaguuccggcuccgcggggagcagcggaagacguucguagaguuaaugcgucggggcgaccugcccguguggcucuccuacaaggucgcgagcgccgggauuuccuacaaggacagagaaugguguuuuacaggggagcggaacaaccagauccuagaggaaaacauggagguggagaucuggacccgggaaggugagaagaagaagcugcgucccagauggcucgaugcccgcguguacgccgaucccauggcacuuaaggacuuuaaggaguucgccagcggucggaaguccaucacacucgacauccucaccgagaucgccagccugccgacauacuugagcucacgcgccaaacucgcccuggacaacaucgucaugcugcauacuacugagcgaggcggacgcgcuuaccagcacgcgcucaacgagcugccagagucacuugagacguugaugcuaguggcccuguugggcgccaugacggcggggauuuuccuguucuuuaugcagggcaagggcaucggcaaacuuucgaugggccucaucaccaucgccgucgccagcggacugcugugggucgccgaaauucagccacaguggaucgcggccucgaucauccuagaguuuuuccuaaugguguugcucaucccggaacccgagaagcaacggacaccccaggacaaccagcuuaucuacguaauccugacgauccucaccaucaucggucugaucgccgcuaacgagaugggacuaaucgagaagaccaagaccgacuucggcuucuaucaggucaagaccgagacgacuauucuggacguggaucugagacccgcgagcgccuggacccuguacgcgguggcaaccacgauauugaccccaaugcugcggcauacgaucgagaacaccuccgccaaccugagccuugcugccaucgccaaccaagcugcgguccugaugggacuggguaagggcuggccccuccaccgcauggacuugggcguaccgcugcucgccauggguugcuacucccaagugaaucccacgacccugaccgcuucucucgucaugcuccugguccacuacgcgauaaucgguccgggccuccaggcuaaggccacccgggaggcccaaaaacggacggcagccggcaucaugaagaaucccaccguggaugggaucacugucaucgaccucgagcccaucucauacgauccgaaauucgaaaagcagcugggccaagugaugcugcucguguugugugcagggcagcucuuauuaaugcggacgacuugggccuucugcgagguccugacccucgcaacuggcccgauccugacccugugggagggaaacccaggacgcuucuggaacacgaccauagcggugagcaccgcgaacauauuccggggcuccuaccucgcuggggccggccucgccuucucccugaucaaaaacgcacaaaccccacgacgagguacgggaaccacgggggaaacccuaggcgagaaguggaagcgccagcugaacucccuggauaggaaggaguucgaagaguacaagcgcagcggcauccucgagguggaccguaccgaggcaaaaucagcgcugaaggaugggaguaagaucaagcacgccguaucacgcggcuccuccaagauucgcuggaucguugaacggggcaugguuaagcccaaaggcaagguuguggaccuggguugcggucguggcgggugguccuauuacauggcuacgcugaagaacgugacugaggucaagggcuacaccaaagggggcccugggcacgaggagccaaucccuauggcgacauacggguggaaucuugucaagcugcauagcggcguugacgucuucuacaagcccacggaacagguggacacgcuccugugcgacaucggggagagcucgagcaauccuacuaucgaagaaggccggacgcuacgcgugcuaaagauggucgagccguggcuuucaagcaagcccgaguuuugcauaaagguucugaaccccuauaugccgacugucaucgaggagcuggagaagcuccagcggaagcaugguggcaaucugguacgcugcccccugaguagaaauucgacgcacgaaauguacugggucucuggggccucggggaacaucguuagcuccgugaacaccacuagcaagaugcucuuaaaccgcuuuacaacccgucaucgcaaacccaccuacgagaaggacguggaccugggugccggcacacggucaguaagcacggaaacagagaaaccugacaugacaaucauuggccgccggcugcagcgccuucaggaggagcauaaggaaacguggcacuacgaccaagagaacccguacaggacgugggcuuaccauggauccuacgaagcgcccuccaccggcucggccagcuccauggugaacggcgugguuaagcugcucaccaaacccugggacgugauaccuauggugacccagcuggcgaugacggacaccacccccuuuggacagcagcgcguuuuuaaggaaaagguugacacccgaacgccccaaccaaaaccaggaacccgcauggugaugacgaccacggcaaacuggcugugggcacugcuggggaagaagaagaauccccgguuaugcacaagagaggaguucaucucaaagguccggaguaaugcggcuaucggagccgucuuccaggaggaacagggguggacguccgccagcgaggccgugaacgauucccgcuuuugggagcuagucgacaaggagcgggcgcuucaccaggagggcaaaugugagagcugcguguacaacaugaugggcaagcgggaaaagaaacuaggggaguucggacgcgccaaggggucccgggccaucugguacauguggcucggggccagguuccuggaguucgaggcccugggcuuccucaacgaagaccacugguuuggcagggagaauagcuggaguggcguagagggggagggccugcaccgccugggguacauccuugaggagaucgacaagaaagacggugaucugauguaugcagaugacaccgccggcugggauacgcguaucaccgaggacgaccugcaaaacgaggagcucaucacugagcaaauggccccgcaccacaaaauccuggcaaaggcgauuuucaagcugaccuaucagaauaagguagucaagguacucaggcccacccccagaggggccgucauggacaucauaagcaggaaggaucagcggggcuccggacaggugggcacauacgggcugaacaccuucaccaacauggaaguacagcuuauccgccagauggaagccgagggggugaucacacaggaugacaugcagaaccccaaaggucucaaggagcguguggagaaguggcuucgcgagugcggaguggaccguuugaagcgcauggccaucucuggcgacgacugcgucgugaagccucucgacgaacgguuuggaacgucccugcuuuucuugaacgauauggguaaggugcguaaggauauaccacagugggagccaucgaagggguggaaaaacuggcaggaggucccauuuuguucccaccacuuccacaagauuuuuaugaaggacggacggagccugguagugccuugccguaaccaagacgagcugauuggaagggcccggauuucccagggggcgggcuggagcuuacgcgagacagcaugucuggguaaggcauaugcgcagauguggucccucauguacuuccaccggcgcgaccuucggcuggcgagcauggcgaucugcagcgccguccccacugagugguucccuaccucccguacgaccuggagcauacacgcacaccaccaguggaugacgacugaggacaugcuuaagguguggaaccgcguauggaucgaagacaaccccaacaugaucgacaagacucccguucauuccugggaggacaucccuuacuuggguaagcgcgaggaccuguggugcgggagccugaucggccucuccagcagagccaccugggcuaagaauauacauaccgcgauuacacaggugcgcaaccugaucgguaaggaggaguauguagacuauaugccgguuaugaaaagauacuccgcccccucggaguccgagggggugcuguaa

SEQ ID NO: 26266 - RNA, 9867 nt, Artificial Sequence
  derived and/or modified CDS sequence (opt11) from DENV-4__FJ639739__SS-prME
agcaccaugacccugcucugccugauucccacugcuauggccuuccaccuuuccacgcgagauggcgagccgcucaugaucgucgcgaagcacgagcgggggcguccccugcuguucaagaccaccgagggcaucaauaagugcacgcugaucgccauggauuuaggggaaaugugcgaggacaccgucaccuacaagugcccacuccuaguuaacacugagcccgaggacauugauuguuggugcaaccuuacgucuaccugggugauguacgguaccugcacccaguccggggagcgaagacgcgagaagcgaagcguggcauuaacgccgcacuccggcaugggccuagagacccgggcagaaaccuggaugagcucagaaggggcuuggaaacaugcgcaacgcguugagucauggauccugaggaaccccggguucgccuugcucgccgguuuuauggccuacaugaucggucaaacugggauccaacgcacaguguucuuuguccugaugaugcucguggcuccuuccuacggcaugcggugcgucggcgucgggaaccgcgauuucguggagggcgugagcgggggcgccugggucgaccucgugcuggagcacggcgguuguguuacgaccauggcccagggcaagccgacccuggacuuugagcucaccaaaaccacggcaaaggaggucgcccugcugcggacuuacuguauagaggcgcucaucuccaauaucacgaccgcaaccagaugucccacccagggugagcccuaucugaaggaggagcaggaccagcaguacaucugucggcgcgaugugguagaccguggcugggggaauggcugcgggcuguucggcaaagguggcgugguuacaugcgccaaauucagcugcuccggcaagauaacagggaaccucguacagaucgagaaccuggaauacaccguuguggucaccgugcacaacggcgacacgcacgcggugggcaacgacacuagcaaccacggggugacggccacuaucacgccccgcucgcccagcguggagguaaaacugccggacuauggugagcucaccuuagacugcgagccccggucugguaucgacuucaacgagaugaucuugaugaaaaugaagaagaaaaccugguugguccacaagcaaugguuucuggaucucccucuccccuggacugcgggcgccgauacguccgagguucacuggaacuacaaggaacgcauggucacauucaaggucccucaugccaagagacaggacguuaccguacugggaucccaggaaggcgcgaugcacagcgccuuggcaggcgccaccgagguugacagcggagacggcaaccacauguucgcuggacaccucaaguguaagguccgaauggaaaagcugaggauuaagggcaugaguuacaccaugugcuccggcaaguucagcauugacaaggagauggccgagacgcagcacggcaccaccgugguaaaggugaaguacgagggagccggggcgcccugcaaaguccccauagagauucgggacguaaauaaagagaaggugguaggccgggucauuagcucaacuccccuggcugagaauacgaauagcgugaccaacauagagcucgagccgcccuucggggacaguuacauuguaaucggcgucggcaauagugcucugacgcugcacugguuccggaaaggguccuccaucggcaagauguucgaguccacauaccgcggcgccaagagaauggcgauccucggcgagacagcgugggacuucgggagugugggcggccuauucacaagucuaggaaaggccguucaccaggucuucgggagcguauacacgacaauguucgggggcgugucuuggaugauccgcauccucauuggguucuuaguccuguggaucggcacuaacagccggaacacuucaauggcaaugacaugcauugccgugggcgggaucacccuguucuugggcuucacugugcaggcggacauggggugcguugugagcuggagcgguagggaauuaaagugugguagcggaauuuuuguggucgauaacguucacaccuggacggaacaguacaaguuccaacccgagagccccgcacgucuggccuccgccauucucaacgcccacaaggacggcguaugcggcaucagaaguaccacccgguuggagaacguaauguggaagcaaauaacgaacgagcucaacuacgugcuaugggaaggaggacacgacuuaacuguaguugcgggcgacgugaagggcgugcugacuaaggggaagcgcgcccucacgccgcccguauccgacuuaaaauacagcuggaaaaccuggggcaaggccaaaaucuucacuccggaggcccgcaacucaacguucuugauagacgggcccgacacuagcgagugcccaaacgagcgccgggcauggaacuccuuagaaguugaagauuacggcuucgggauguucacaaccaauaucuggaugaaguuccgcgaggggagcuccgaggugugcgaucaccggcucaugagcgccgccaucaaagaccaaaaggcaguacaugccgacaugggcuauuggaucgagucaagcaagaaccagaccuggcaaauagagagagcgucccugauagaggugaagacuugccucuggccuaagacccacacucuguggaguaacgggguucuggaaucacaaaugcuuauccccaagucguacgccggcccguuuucccaacacaauuaccggcaaggguacgcaacccagacggucggccccuggcaccuagggaaacuggagauugacuuuggcgagugucccggaaccaccgucaccauccaggaggacugcgaccacagaggucccucacuccguaccacaacagccagcgguaagcuggugacccagugguguugcaggucaugcacgaugccgccacugcgcuuuuuaggggaagaugggugcugguacgggauggagauccggccucugucugagaaagaggagaacauggucaaaucccaggugacggccggacaggggaccagugagacguucuccauggggcuguugugccugacccuguucgucgaggagugccuccgucggcgcguuacgcggaagcacaugauucuggcggucguaaucacccugugugcaaucauacucggcgggcugaccuggauggaccugcuucgugcccugauaaugcugggcgacaccaugaguggcagaaucggaggccagacgcaucucgccauaauggccguauucaagaugaguccgggcuacguguuaggcgucuucuuacgcaagcucacaagccgggagaccgcacucauggugauagggauggccaugacaaccacccugaguauaccgcaugaucucauggagcuaaucgacggcaucagccugggccuuauucuacucaagaucgugacccaguucgauaacacgcagguugggacgcucgcgcugagucuuaccuucaucagauccaccaugucccucguaauggcauggaggacaauuauggccgugcuguucgugguuacuuugauuccccucugcaggacuagcugucugcagaagcaaagucacuggguagagaucacggcgcugauccuaggggcucaagcccugcccgucuaccugaugacccucaugaagggggccucacggcgguccuggccucuuaacgaaggaaucauggcuguggggcugguaucacuccugggcuccgcccuucucaagaaugaugucccgcuggccggccccaugguggccgggggccugcuucuagccgcguacgugaugagcgggucgucugcugaccucagccucgagaaggcggccaacguccagugggacgagauggccgacaucacggguuccaguccuaucaucgaaguaaagcaggacgaggaugguucuuucagcauccgcgauguggaggaaaccaauaugaucacacugcuggucaagcucgcgcuuaucacuguguccggacuguaucccuuagcgauccccgugacuaugacccugugguauauguggcaagugaaaacucagcgcagcggugcccugugggaugugcccagcccggccgcuacccagaaggcggcacuaagcgaggggguguaccggaucaugcagcguggacucuucggaaaaacccagguaggcguggggauccacauggagggcguguuccauacgauguggcacgucacccggggcuccgugauuugucacgaaacagggcgcuuggagccaucaugggccgacguccgcaacgacaugaucucuuacggcggggguuggaggcuaggcgacaagugggauaaggaggaggacguacaggugcuggccaucgagccgggcaagaauccuaagcacgugcagaccaagcccggacuguuuaagacgcucgcaggggagaucggcgcagucacccuggauuucaagccugggaccagcgggucgccuaucaucaaucgcaagggcaaggugauaggacuguacggaaaugggguggucaccaaaagcggugacuacgugagcgccaucacgcaagcagagcggaucggugaaccagacuacgagguggacgaggacaucuucagaaagaagcgauuaaccauaauggaucuacaccccggcgccgggaagacaaagcgcauccucccgagcaucgucagggaggcgcugaagcgccggcuacgcaccuugauucuggcccccacccgugucguggccgccgaaauggaggaggcccuccgcgggcugcccauacgguaucaaacccccgcggugaaguccgagcacaccggcagggaaaucguggaccuaaugugccacgcuacguucacgacacggcuucuaagcagcacucggguaccgaacuacaacuugaucgucauggaugaagcccacuucaccgacccguccucaguggccgcccgcggguacaucucgacucgcgucgaaaugggugaggcugccgccauuuucaugaccgccaccccucccggggccacugacccguuuccgcagagcaauucucccaucgaggacauagagcgggagaucccggagcgcaguuggaauacgggcuucgacuggaucaccgacuaccaaggcaagaccguaugguucgugccauccaucaaggcggggaacgacaucgccaacuguuugcguaagagugguaagaaggugauacagcuguccagaaaaaccuucgacacggaguacccgaaaaccaagcugaccgauugggacuuuguggucaccacggacaucagcgagaugggggcaaacuuuagagccggccgggugaucgacccccgccguugccucaagccagugauucugaccgacgggcccgagagagucauccuggcaggccccauccccgucacccccgcaagugcagcucagcgucggggccggaucgggcgcaacccugcacaggaggacgaucaguauguguucaguggugacccccuaaagaaugacgaagaucacgcgcacuggaccgaggcgaagaugcuccuugauaacauuuacacgcccgaggggaucauccccacucucuuuggaccugagcgggagaagacccaggccauagacggcgaguuccgccuacguggggagcagcgcaaaaccuucguugaauugaugcggcgcggugacuugcccguguggcuguccuacaagguggccagugcugggauaucguacaaggaucgcgaguggugcuuuacgggcgagcgcaacaaccaaaucuuggaagagaacauggaggucgagaucuggacccgggagggggaaaagaaaaagcuccgcccccguuggcuagacgcgcgcguauacgccgacccaauggcccugaaggauuuuaaggaguucgcaagcggccguaaauccaucacccucgacauccucaccgagauugccucuuugccaaccuaccucucuucacgggccaagcuggcccuggacaacaucguaauguuacacacgaccgagcgcggcggccgcgccuaccagcacgccuuaaacgagcuucccgagucacuugagacauugaugcugguggcauuacugggagccaugacggccgggaucuucuuauucuucaugcaggguaaggggaucggcaaacuauccaugggccugaucaccaucgcuguggcgucggggcugcucuggguggcggagauccagccacaguggaucgcagccucuaucauacuagaguucuuucucauggugcuccugauucccgagcccgaaaagcagaggaccccacaagauaaucagcucaucuauguuauucugaccaucuuaaccaucaucggccugaucgcggccaacgaaauggggcucaucgagaaaacaaagaccgacuucggauucuaucagguaaagaccgaaaccaccauccuggacguggaccugcgcccagcgucagccuggacauuauacgccgucgcuacuacaauccugacgccgaugcugcgccacacaaucgagaauacaucugcuaacuugucacuugcagccauagccaaucaggcagccguccugauggggcuuggcaagggcuggcccuugcacaggauggaccugggggugcccuuacucgcgaugggcuguuacucacaaguaaaccccaccacgcugaccgcgucauuagucaugcuguuaguccacuacgccauaaucgggccgggacuccaggccaaagcaaccagagaagcccagaagaggacggccgccggcaucaugaagaaccccacggucgacgggaucaccgugauagaccuggagcccauaucuuaugaccccaaauucgagaaacagcuuggccaggugauguugcuaguccuuugcgccgggcagcuucugcucaugcgaaccacgugggcguucugugaggugcugacauuggccacagggcccauccugacucugugggaggggaaucccggccgguucuggaacacuacgauagccgugagcacggccaacaucuuccgcggcuccuaucuggccggagcaggacuagccuucuccuuaaucaaaaacgcgcaaacaccccgacgcgggaccggaacgacaggugagacccugggcgagaaguggaagcgacagcugaacucgcucgaucgcaaggaguucgaggaguacaagcggagcggcauccuggaggucgaccgcaccgaggccaaguccgcuuugaaggaugggagcaagaucaagcacgcugugucgcguggcagcagcaagauacgcuggaucguagagcgugggauggucaagcccaaggggaagauugucgaccucggguguggacgcggcggguggaguuacuacauggcaacgcugaagaacgugacggaagucaaaggguacaccaaaggagggccggggcacgaggagccgauccccauggccaccuacggguggaaccuggugaagcuacacagcggcguggaugucuucuauaagccgaccgaacagguggauacgcugcucugugacauaggagaguccagcuccaauccgaccaucgaggagggcaggacgcugagaguguugaaaaugguugagcccuggcugucauccaagcccgaguucugcauuaagguguugaacccguacaugccgacggugaucgaagaacucgagaaguuacagagaaaacacggcggcaacuuaguccguugcccacucagccgcaacuccacgcacgagauguacugggugagcggcgcgucugggaacauugucagcagcgugaacacgaccucaaagaugcuacugaaucgcuucaccacucgacaucggaaacccacuuacgagaaagacguggaucucggcgcgggaacccguucggucagcaccgaaacggagaaacccgacaugacuaucaucggccggcgccuucagaggcugcaggaggagcacaaggagaccuggcauuaugaccaagagaacccguacagaacaugggccuaccaugggucauacgaggcgcccucaacgggauccgcuagcucgaugguuaacggagugguuaagcuccuaaccaagcccugggacgugaucccgauggugacccagcuggccaugacagauacgacuccguuuggacaacagcgggucuuuaaggaaaaaguggacaccagaacaccccagccgaagccgggaacgcggauggugaugaccacaacugccaacuggcucugggcccugcuggggaagaagaaaaauccuaggcucugcacgcgagaagaguucaucagcaagguccgcucaaacgcagccaucggagccguauuccaggaggagcaaggauggaccuccgcgagcgaggccgugaacgacagucgcuuuugggaacuuguggacaaagagcgcgcucugcaccaagagggcaagugcgagucgugcguguauaacaugaugggcaagcgcgagaagaagcucggagaguucggccgagccaaggggucccgagcgaucugguacauguggcugggcgcgcgcuuccuggaguucgaagcgcuuggauuuuuaaacgaggaccauugguucggccgcgagaacucgugguccggcguggagggagaaggccugcacaggcucggguacauccuggaggagaucgacaaaaaggauggcgaccugauguacgcggacgacaccgccgguugggacacccguaucacugaggacgauuuacagaaugaagaacuaaucaccgagcagauggcuccccaucacaagauacuggccaaagcuaucuucaaguugacguaucagaauaagguagugaaggugcugaggcccaccccucgcggcgcggugauggacaucaucagucggaaggaccaacgcggcuccggacaggugggcaccuacggacuaaacacguucacaaacauggaaguacaacucauccgacagauggaggccgaaggcguuauaacccaggacgauaugcagaacccaaagggauugaaggagcgcguggagaaguggcuucgggagugcgggguagaccgccucaagcggauggcuaucucaggcgacgacugugucgugaagccccuagacgagcgcuucgggacaucucugcuguuccuaaacgacauggguaaagugcgcaaggacauuccccagugggagccguccaagggcuggaagaacuggcaagaaguacccuucugcagccaccauuuccacaagauuuucaugaaggaugggagaagccugguggugcccuguagaaaccaggaugaauugauuggccgcgcccgaaucucccagggggccggcuggucccugcgagagaccgccugccuaggaaaggcauacgcgcagauguggucccuaauguacuuccaccgucgggaccugcgguuggcgucgauggccaucugcagcgcaguucccaccgaguggcucccgaccucccgcaccacguggucgauccacgcccaccaccaauggaugaccaccgaggauaugcugaagguguggaaccgcguguggaucgaagacaaccccaauaugaucgacaagacccccgugcauaguugggaggacauccccuaccugggaaagcgggaagaccucuggugcgggagccugaucggccugaguagccgcgcgaccugggccaagaacauccacacagccauaacccagguucggaaccugaucggcaaggaagaguauguggacuacaugccggucaugaagcgguacuccgcgccuagcgagagugaggguguacuguag

SEQ ID NO: 26267 - RNA, 9867 nt, Artificial Sequence
  derived and/or modified CDS sequence (opt11) from DENV-4__JN819409__SS-prME
ucuaccaucacucuacuaugucugaucccaaccgugauggcuuuccaccugucuacccgcgacggggagccccucaugaucguggcaaagcacgagcgggggcggccucugcuguuuaagacgaccgaaggcauaaacaaaugcacacucaucgcuauggaccugggggagaugugcgaggacaccgugaccuacaagugcccccucuuagugaacaccgaacccgaggacaucgauugcugguguaaccugaccgccaccugggugauguacgggacuugcacccaaucaggggagcggcgcagggagaagcgcuccguggcccugaccccgcauagcgggaugggccucgagacccgggccgagaccuggaugucuagugagggggccuggaagcacgcgcaaaggguggaauccuggauacugcggaacccaggcuucgcccugcucgccggguucauggcguacaugauuggccagaccgggauccagcgcacggucuucuucgucuugaugauguugguggcccccaguuacgggaugcggugcgucggcguugggaaccgagacuucguggaaggcgucuccgggggcgccuggguggaccucgugcucgagcauggcgggugcgucaccaccauggcucaagggaagcccacccucgauuucgagcucacgaaaaccacugcuaaggagguggcucugcugcggaccuacugcauagaggcgcucaucucaaacaucaccaccgccacccgcugcccgacccagggggagcccuaccugaaggaagaacaggaccagcaguacaucugucggcgcgacguggucgaccggggauggggaaacggcugcggccuguucgggaagggcgggguggugacgugcgcuaaguuuuccugcagcggcaagaucacugggaacuuaguccagaucgagaaccuagaauacaccgugguggucacaguccacaacggcgacacgcacgccguggguaacgacacuagcaaccacgggguuacugccacaaucacgccccgaagccccuccguggaggucaagcucccggacuacggcgagcucacacuggacugcgaaccccggagcgggaucgacuucaacgagaugauccugaugaagaugaagaagaagaccuggcuagugcacaaacaaugguuccuggaccugccccuccccuggaccgcgggcgcggacaccuccgaggugcauuggaacuacaaggagcgcauggugacguucaaggucccgcacgccaagcggcaagacgugaccguacucgguucucaggagggagccaugcauuccgcccuggcgggcgccaccgagguggacagcggggauggcaaccacauguucgccgggcaccuuaaaugcaagguccggauggaaaaacuucgcaucaaggggaugagcuacacuaugugcagcgguaaguucucaaucgacaaggagauggccgagacgcagcacgggacgaccgucgugaaggucaaguacgagggagccggggcgcccugcaagguccccaucgaaauccgggacgugaacaaagagaagguugucgggcgcgugaucuccagcacgccgcuggccgagaauacgaacggggugaccaauaucgagcuugagccucccuucggagacuccuacaucgucaucggugugggaaauucggcccuuaccuuacauugguuccgcaaaggcuccagcaucgggaagauguuugaguccacguaucgcggcgccaagcggauggcgauucucggggaaacggccugggauuucggcagcgucggcgggcuguucaccucacuaggcaaggcaguccaccagguuuuugguuccguguacaccacgauguucggcggggucuccuggaugauccgcauccugauaggcuuccugguguuauggaucggcacaaauucucgaaacaccuccauggccaugacauguauugccguaggagggaucaccuuauuccucggcuucacgguacaggcggacaugggaugcguggugagcugguccgggcgcgagcucaagugcggcagcggcaucuucgucgucgacaacguccacacguggaccgagcaguacaaguuccagccugagucucccgcccgacuggcuucggccauccucaacgcccacaaagacggggucuguggcauccggagcaccacgcggcuggaaaacgugauguggaaacagaucaccaacgaacugaacuacgugcucugggaaggcggccacgaccugaccgucguagcgggcgacgugaaggggguccugacgaagggaaagcgcgcccuaacgccucccguguccgaccugaaguacagcuggaagaccugggggaaggccaagaucuucacccccgaggccaggaacuccaccuuccuaaucgacgguccagacacgagcgagugcccaaacgaacgccgggccuggaacucccucgagguggaagacuaugguuucggcauguucacgaccaauaucuggaugaaguuccgcgaagggagcuccgaagucugcgaucaccggcugaugagcgcggcgaucaaggaccagaaggccgugcaugccgauaugggguacuggaucgaguccucaaagaaccagaccuggcaaauagagcgcgcuucgcuuauugaggugaagacgugccucuggcccaagacccacacccuauggagcaauggcguucuggaaucccagaugcucaucccuaagucuuacgccggccccuucucccaacacaacuaccggcagggcuacgcaacccagacaguggggccuuggcaccugggcaaacuggagaucgacuuuggcgagugccccgguaccaccgugaccauacaggaggacugugaccaccgcggccccucucugcgcaccacgacagcuuccgggaagcuagucacucaguggugcugccgaucgugcacaaugccgccucuacgcuuccucggagaggacgggugcugguauggaauggagauuagaccacugagcgagaaggaagagaacauggugaagucccaggucacggccggccaagggaccucggagacuuucuccaugggucugcucugccuaacccucuucguggaggagugccuccgacggcgcgugacgcggaagcacaugaucuuggcggucaucaucacacugugcgcgaucauacuuggaggccugaccuggauggaccugcuacgcgcucugauuaugcuuggggacaccaugagcgggcggauaggugggcaaacgcaccucgccaucauggcaguguucaagaugucccccggcuacgugcugggggucuuccugagaaaacucaccucgcgggaaacggcgcugauggugaucggcauggcaaugacaacgaccuuguccaucccgcacgauuugauggagcugauagaugguauuucauuaggucuaaucuuauugaaaaucgugacccaauucgacaacacucaggucgguacccucgcccugucccugaccuucauccgcuccaccaugucucucgugauggcauggcggaccaucauggcaguucuguucgucgugacgcuuaucccccucugucgcaccagcugccuacagaagcagucccacuggguggaaaucaccgcgcugauccucggggcccaggcgcugcccguguaccugaugacccuuaugaagggggccucgagaagauccuggccccuuaacgagggcaucauggcggugggccuggugagccugcugggcucggcccugcucaagaacgacgucccguuggccgggcccaugguugccggaggacuacuguuagcggcuuacgugaugucaggauccagcgccgaccugagccucgagaaggccgccaacguccaaugggaugaaauggccgauaucacggggaguagcccaauuaucgaggugaagcaggacgaggacggcuccuucagcauucgggauguagaggagaccaacaugaucacccugcuggucaagcucgcgcugaucacugugagcggccuguacccauuagccauccccgugaccaugacccugugguacauguggcagguuaagacucagcgcagcggcgcccugugggacgugcccagccccgcagccacccaaaaagcggcacuguccgaggguguguaccggaucaugcagcgcggucuguuugggaagacccaggucggggugggcauccacauggagggcguauuccacacgauguggcacgucacccgggguuccgugauuugccacgagaccggcagacucgagcccagcugggccgacguacgcaacgacaugaucuccuacgggggcggcuggcgacucggcgacaagugggacaaggaggaggacguacaggugcuggccauagagccggguaagaacccuaagcacguacaaacaaagcccgggcuguuuaagacccucaccggcgagauuggggccgucacccuggacuucaagcccggaaccagcggcuccccuaucaucaaccgcaaggggaaggucaucggauuauacgggaacggcguggugaccaagagcggggacuacguguccgcgaucacacaggccgaacggaucggcgagccugacuacgagguggacgaggacaucuuccguaagaagcgccucaccauuauggaccugcacccgggggccgggaaaacaaagcgcauccugccgucuaucguccgggaggcccugaagcgccggcuucggacccuuaucuuggcgccgacucgggugguggcagcagaaauggaggaggcccuccguggacugccaauacgguaccagacccccgccgucaagucggagcacacagggcgcgaaaucguggacuuaaugugccacgcuacguucaccacccggcucuugucgucgacucgcguuccgaauuacaaucugaucguaauggacgaggcccacuucacggaccccagcagcguggccgccagggguuacaucuccacccgggucgagaugggggaggcagcggcuaucuucaugaccgccacgccgccgggcgcuaccgacccguucccccagagcaacucccccaucgaggacauugagcgggagauacccgagcgcagcuggaacaccgguuuugacuggauaaccgacuaccaggggaagacagugugguucguaccguccaucaaggccggcaacgacaucgccaacugucugagaaagagcgguaaaaaggugauccagcugucccggaaaacguucgacacagaguaucccaagaccaaguugaccgacugggauuucguggugacgaccgacauuagcgaaaugggugcgaacuuccgcgcugggcgggucaucgaccccaggcggugccucaagcccgugauacugaccgacggcccagagcgcgugaucuuggccgguccuauccccgucacccccgcguccgcugcccaacggcgaggacggauaggucgcaacccggcccaggaggacgaccaguacgucuucucgggugacccucucaagaacgacgaggaccaugcccacuggacggaggcuaagauguuacuggacaacaucuacacucccgagggcaucauucccacccucuucggccccgagcgggaaaagacgcaggccaucgauggugaguuccgucuccggggcgagcagcgcaagacguuuguggagcugaugcggcgcggggacuugcccgucuggcuguccuacaagguggccagcgccggcaucuccuacaaagaccgggaguggugcuucacuggggagcgcaacaaccagauccuugaggagaacauggagguggagaucuggacacgagagggcgagaagaagaagcuccguccccgguggcucgacgcccgcgucuacgcggaccccauggcccugaaagacuucaaggaguucgcuagcggacgcaaguccaucacauuggacauccugaccgagauugccagccugccgacguaccucuccagcagagccaagcuggcgcuggacaacaucgugaugcuccauaccaccgagcgcgguggccgggccuaucagcacgcccugaacgaacucccggagucccucgagacccuaaugcugguggcccuccugggggcgaugaccgcaggcaucuuucuguucuucaugcaggggaaggguaucggcaagcuaagcauggggcuuaucaccaucgccgucgcuuccggccuacucuggguggccgaaauucaaccccaguggauagcggccuccauuauccuggaauuuuuccugaugguguuacugauaccugagcccgagaagcagcgcacgccccaggacaaccaguuaauuuacgucauacugaccauccugacgaucaucgggcugaucgccgccaaugaaaugggccucauagagaagaccaagaccgacuuuggguucuaucaggugaagacugagaccaccauccucgacguggaccugcggcccgccagcgcguggacccucuacgcugucgccaccacuaucuuaaccccgaugcugaggcauaccaucgagaauaccucagcgaaucucucccuggccgcgaucgccaaccaggccgccguucugaugggcuuaggcaagggguggccacugcaccggauggaccugggcgugccccuccuggccauggguugcuacucccaggucaaccccacgacucugaccgcaagccuggugaugcugcuggugcacuaugcaaucaucgguccuggacuccaggccaaggccacccgugaagcgcagaagagaacggccgccgggaucaugaagaauccgaccguggacggcaucacugucaucgaccuggaacccaucuccuacgaccccaaguucgagaagcagcucggccaggugaugcuccuggucuuaugcgcgggccagcuccuguugaugcgcacgacaugggccuucugcgaagugcucacccuggcgaccgguccgauacugacgcucugggagggcaaccccggccgguucuggaacaccaccaucgccguaagcaccgcgaacaucuuccgcggguccuaccucgccggcgccggguuagcguucagccucauuaagaacgcccaaacgccucggcgcgguaccgggaccaccggagagaccuugggggagaaguggaagcggcaguuaaacucgcucgaccgcaaggaguucgaagaguacaagcggagcgggauccuggagguggaucgcacagaagccaaguccgcccuuaaagacggcagcaagaucaaacacgccgugucccggggguccaguaagauccgcuggaucguagaacggggcauggucaagcccaagggaaaggucguggaucuuggaugcggccgcggcgguuggagcuauuacauggcaacgcugaaaaacgucacggaagugaagggguauacgaagggagguccgggucaugaggagccaauccccauggccaccuauggguggaaccuagugaagcuccacuccggaguggacguguucuacaagccgacggagcaggucgacacccugcugugcgacauaggcgagagcagcuccaaccccaccaucgaagaggggcgcacccuccggguccugaagauggucgagcccugguuaaguuccaagcccgaguucugcaucaagguguuaaaucccuacaugccuacggucaucgaggaacuggagaaguuacagcgcaagcacgggggcaaccuggugcggugccccuuaagccgcaacuccacccaugagauguacugggucuccggggccucgggcaauaucgugagcuccgugaacaccaccagcaagaugcugcugaaccgguucacgacgagacaccggaagcccaccuacgaaaaggaugucgaccucggggccggcacgcgcuccguaagcacggagaccgagaagccggacaugacaaucaucgggcgacggcugcagcgacugcaagaggagcacaaggagaccuggcacuacgaccaggagaacccguaccgcacgugggcauaccacggcuccuacgaggccccuucgaccggcuccgcauccuccauggugaacggggucgugaagcuccugaccaagcccugggaugugaucccgauggucacccagcucgccaugacggacacgacgcccuucggccagcagcgggucuucaaggaaaagguggauacccgcacaccgcagccuaagccgggaacccggauggucaugacuaccacggcaaacuggcugugggcacuucuggguaagaagaagaaucccagacucugcaccaaggaggaguucaucucgaagguacgguccaaugccgccaucggcgccguuuuccaagaggagcagggcuggacuagcgccagcgaggcggucaacgacucacgcuucugggagcugguggacaaggagcgggcacuccaucaggagggcaagugcgaaucgugcguguacaacaugauggggaagcgcgagaagaagcucggcgaguucgggcgcgccaaaggcucacgggccaucugguacauguggcugggagcccgcuucuuggaguucgaggcgcucgguuuccugaacgaagaccacugguucggccgcgagaacagcugguccggagucgagggugaggggcugcaucgcuuaggauacauacuggaggagaucgacaagaaagacggcgaccugauguacgcugaugacacagcuggcugggacacgcgcaucaccgaggaugaccugcagaacgaggaacucauuaccgagcaaauggcuccccaccauaagaucuuggcgaaagcaaucuucaaguuaaccuaccaaaacaagguggugaagguccugcgccccaccccgagaggggcugugauggauaucaucagccgaaaagaccagagggguuccggccagguagggacguauggucugaacaccuucacaaacauggagguucagcucauccgccagauggaggccgagggcgugaucacccaggacgauaugcagaaccccaaggggcugaaggagcggguggagaagugguuacgcgagugcggcgucgaccggcucaagcgcauggcaaucucgggggacgacugcgugguaaagccucuggaugagcgguuuggcacuucccuccuguuccuaaacgacauggggaagguccgcaaggacaucccccaaugggagccuucaaagggcuggaagaacuggcaggaaguacccuucugcucacaccauuuccauaagaucuucaugaaggacggccguucgcuugucguccccugccgcaaccaagacgagcucaucgggcgggcacgcauuucccagggagcuggguggagccuucgcgaaacagccugccugggcaaggccuacgcacaaauguggucccuaauguacuuccaccggagagaccugcggcuggcgagcauggcuauaugcuccgccguuccaaccgagugguuuccaaccagccgcaccacauggucuauccacgcccaucaccaguggaugacaacggaggacaugcuaaaagucuggaaccgggucuggaucgaggacaacccgaacaugacggacaagacgccgauccacuccugggaagacauccccuaucuggggaagcgcgaggaccuguggugcggcagccucauaggccuguccagucgggcaaccugggcgaaaaauauccacacggccauaacccagguacgaaaccucauagggaaggaggaguacguggacuacaugccggucaugaagcgcuacuccgcccccagcgaguccgagggcgugcucuga

SEQ ID NO: 26268 - RNA, 9867 nt, Artificial Sequence
  derived and/or modified CDS sequence (opt11) from DENV-4__FJ639742__SS-prME
agcaccaugacucugcucugucugauccccacggccauggccuuccaccucucaacccgcgacggcgaaccgcucaugaucguugcgaaacacgaacggggucgcccuuuacuguucaagaccacugaagguaucaacaagugcacgcucauugcuauggaccugggggaaaugugcgaagacacgguuaccuauaaauguccccugcucgucaacaccgaacccgaagauaucgacugcuggugcaaccuuacgagcaccugggugauguacggaacuugcacccaguccggggaacggcgccgugagaagaggagcgucgcguuaacuccgcauuccggcaugggacucgagacgagggccgagacuuggaugagcuccgagggggccuggaagcacgcgcagcgcguagagagcuggaucuugcguaaccccggcuucgcccugcucgccgguuucauggcguacaugguggggcagaccgggauucagagaacggucuucuucgugcugaugaugcugguggcucccuccuacggcaugcggugcgucggaguuggaaaccgagacuucguggagggcgucagcgggggcgccuggguagaccucguguuggagcacggcgggugcgucacuaccauggcccaagggaagccaacgcuggacuucgagcucacgaaaaccacagccaaggagguggcacugcugcgaaccuacugcaucgaagcgcucaucaguaacaucacgaccgccacccguugcccgacccagggggaacccuaccugaaagaagaacaggaccagcaguacaucugccggcgcgacgucgucgaccgcggcuggggaaacggcugcggccuauuugggaagggugggguagugacgugugcuaaguucagcugcaguggcaagaucaccgguaaccuaguccaaauagagaaccuggaguacacagucgugguuacagugcauaauggugacacucacgccgucgguaacgacaccucgaaccacggggugaccgcgacgauuaccccacgcuccccaagcguggagguuaaguugccggauuauggcgagcucacccuggacugcgagccccggagcggaaucgacuucaacgagaugauccucaugaagaugaagaagaagacguggcuugugcacaagcagugguuccuagacuuaccccucccuuggacagcaggcgccgacaccagcgaagugcauuggaauuauaaggagcgcauggucacuuuuaaggugccacacgccaagcggcaagacguaaccguucuggggucccaggagggcgccaugcauagcgcccuggcaggcgccaccgaagucgauagcggggacggcaaccacauguucgccgggcaucucaagugcaaggugagaauggagaagcucaggauuaaagguauguccuacaccaugugcagcggcaaguucuccauugacaaggagauggccgagacgcagcacgggaccaccgucgugaaggugaaguacgagggcgccggggcgccauguaagguucccaucgagauuagggacgugaacaaagagaagguggucggccgcgugauaucaagcaccccauuagcggagaacacgaacucaguaacaaauauugagcucgagccgcccuucggagacaguuacauugucaucggcguaggcaacagcgcccugacccugcacugguuccggaaaggguccagcaucgggaagauguucgaguccaccuaccgcggggccaagcggauggcgauccucggagaaacugccugggauuuugggagcguaggcggcuuauucaccucccuggggaaggccguccaucagguguucggcucggucuacaccacuauguucgggggcgucucauggaugauccgcauacucaucggguuccuggugcuguggauugguacgaacagcaggaacaccuccauggccaugaccugcaucgccgucggcgggaucacacuguuucucggcuucacgguacaggcggacaugggguguguggugagcuggaguggucgcgagcuaaagugugggagcggcaucuucgucguggacaacgugcacacauggaccgagcaguacaaguuccagccagagagccccgcccggcuagccucugccauucucaacgcccauaaagacggcgucugugguauccgcagcacaacgagguuggaaaacgugauguggaagcagaucaccaaugaguuaaauuauguucuuugggagggcgggcacgaccugaccguaguggccggcgacgugaaaggcguucugaccaaggggaaacgcgcccugacaccgcccgucuccgaccugaaguauucguggaagaccuggggcaaggccaaaaucuuuacccccgaggcccggaacuccacguuucugauagacgggcccgacacgucugaaugcccgaacgagcgccgggcuuggaacuccuuggagguugaggacuauggauuugggauguuuaccaccaacaucuggaugaaauuucgcgaggguagcuccgaggucugcgaucacagacugaugucugcggccaucaaggaccagaaggcggugcaugccgacaugggcuacuggaucgaauccagcaagaaucagaccuggcaaaucgagcgcgcgucccugaucgaggugaagacgugccucuggccgaagacccauacccuguggagcaacgggguccucgagucccagaugcucauccccaaaagcuacgccggcccauucucccagcacaacuaccggcagggguacgccacccagaccguaggccccuggcaccuggggaaacuggagaucgacuuuggcgaaugccccggcacgaccgugacuauccaggaggacugcgaccaccgcgggcccucccugcguaccacgaccgccagcggcaaacuugucacccaguggugcugccggucgugcacgaugccgccccuccgcuuccucggggaggacggcugcugguacgggauggaaauccggccgcugucggagaaggaggagaauauggugaagucccaggucacggcaggccaaggcacaagcgaaacauuuagcauggggcugcuaugucugacccuguuuguggaggagugccuccgacgaagagugacgcggaagcacaugauccuggcagucgugaucacccugugcgccaucauccucggcggccuuacguggauggaccugcuccgagcccugaucaugcugggugacacaaugagcggccggaucgggggccagacgcaccuggccaucauggccguguuuaagaugucccccggguauguccuaggcguuuuccugagaaagcucaccagccgggaaaccgcgcugauggugauaggcauggccaugaccacgaccuuauccaucccgcacgacuugauggaacugaucgacggaauaagccuggggcuaauccugcugaagaucguuacgcaguuugacaacacccaaguggggacguuggcccugucccugaccuucauucgcucaaccaugagucucgugauggccuggcggaccaucauggcuguccuguucguagucacucugaucccccucugucgcaccagcugucugcaaaagcagucccacuggguagaaaucaccgcgcugauucucggugcccaggccuuacccguguaccuaaugaccuugaugaagggggccagccggcgcuccuggccacucaacgaggguaucauggcgguggggcuggucucacuccugggcuccgccuugcugaagaacgacgugccucuagcaggccccaugguggccgggggccugcuguuagccgcguacguaaugagcgggagcuccgccgaccugagccucgagaaggccgcuagcgugcagugggacgagauggccgacaucacuggcagcucccccauuaucgaggugaaacaggacgaggaugggagcuucuccauccgggaugucgaggagacuaacaugaucacccugcuggugaaacuagcuuuaauuaccgugagcggacuguacccccuugccaucccggucacgaugacccugugguauauguggcaagugaagacccaacguucuggcgcacuaugggacgugcccagccccgcugccacgcagaaggcggcccucuccgaggggguauaccggaucaugcaaaggggccuguucgguaagacccaggugggcgucgggauacauauggagggagucuuucacacgauguggcacgugacccgcgggagcgugaucugccacgagaccggacgccucgagcccuccugggccgacguccgcaacgauaugaucagcuacgggggcggcuggcggcucggcgacaagugggacaaggaggaggacgugcaaguguuagcaaucgagccggggaagaaccccaagcacguucagaccaagcccggucuguucaaaacgcucaccggggaaaucggcgcagugacccuggauuuuaaaccggggaccucuggcagcccgaucauuaauagaaaaggcaaggugaucgggcuguacggcaacggggucguaacgaaauccggcgacuacgugucagcgauuacccaagcugagcggauuggggagccugauuacgagguagacgaagacaucuuccgcaagaaacggcucaccauaauggaccugcacccgggcgccgguaagaccaaacgcauacugcccucuaucguacgggaggcccuuaagcgcagacuccgcacgcugaucuuggcgcccacacgggugguagccgccgaaauggaggaggcccucagggggcuccccauucgguaccagacccccgccguaaagagcgagcacacuggccgcgagaucguggaccugaugugccacgcgacguuuacuacccggcugcuuagcuccacccgcguccccaacuacaaccugaucguaauggacgaggcccacuucacggaccccuccuccgucgccgcgaggggcuacaucucgacgcgcguggagaugggcgaggccgcggcgaucuucaugaccgcgacgccucccggggccaccgacccguucccgcaguccaauucgcccaucgaggauauagagcgggaaauccccgagcgcucguggaacacgggcuucgauuggaucaccgacuaucaggguaagacggugugguucgucccgagcaucaaggccgggaacgauaucgcuaacugccuccgcaaaagcggcaagaaagucauacaacugagccguaagacuuucgacaccgaauaccccaaaaccaagcugaccgauugggauuucguggucacgaccgacauaucggagaugggggccaacuuccgcgccggccgcguuauagaccccagacggugccucaagcccgugauccugaccgacgggccggagcgcguaauccuggccggccccauccccgugaccccagcuucggccgcccagaggcgcggccggauagggcgcaacccggcccaggaggacgaccaguacguguucuccggcgacccccucaagaacgacgaggaccacgcccacuggaccgaggcgaagaugcugcuggacaacaucuauacgccggaagguaucaucccuaccuuguucggcccggagcgggaaaagacccaggccauagacggcgaauuucgucugcguggggaacagcggaagacguucguggaguuaaugcggcgcggagaccucccuguguggcucagcuacaagguggccuccgccgggaucagcuacaaggaucgggaauggugcuucacuggcgagcgcaacaaccagauccuggaggaaaacauggaagucgagaucuggacccgagagggggagaagaagaaacuucgccccagaugguuagacgcccgcguguacgccgaccccauggcccuaaaggacuuuaaagaguucgccuccgggcgcaagagcaucacgcucgacauccugacagagaucgcaucccuuccgacguaccuuucaagccgagccaaacuugcucucgacaacaucgugaugcuccacaccaccgagcgcggaggacgggcguaccagcacgcccugaaugagcugccugagagcuuagaaacccugaugcugguugcccuucugggcgcgaugacagccgguaucuuccuguucuucaugcaaggcaagggcaucggcaaguuaaguaugggccugaucacaaucgccguggcguccgggcugcucuggguggccgagauucagccccaauggaucgcugccucgaucaucuuagaguucuucuuaaugguccucuuaaucccagagcccgaaaagcagcgcaccccucaggacaaccagcugauuuaugugauccucacuaucuugacgauaaucggccucaucgccgccaacgaaaugggucucaucgagaagacgaagaccgacuucggcuuuuaccaggugaaaaccgagacgaccauucucgaugucgaucugcggcccgcguccgcguggacccuauacgccguggccaccacgauccugaccccgaugcuccgccacacgaucgagaacacuagcgccaacuugucccuggccgcgaucgcaaaccaggccgccgugcugauggggcucggcaagggcuggccccugcaccggauggaccuggguguccccuuguuggccauggguuguuauagccaggugaaccccacgacucugaccgcgucccugguuaugcugcucguccauuacgccaucauagguccgggccuccaggccaaggccacccgcgaagcgcagaagcggacggcagcggguaucaugaagaacccuaccguggacgggaucacagugaucgaccuugagcccaucuccuacgaucccaaguucgagaagcagcugggucaggucaugcuccugguacugugugccggucagcuccuauugaugcgcaccacaugggccuuuugcgaggugcucacccuggcuaccgggcccauccuaacccucugggaggguaaucccggccgguucuggaacacgaccauagccgucuccaccgcaaacaucuuccgcggaagcuaccuugcaggggccggguuagccuuuucccuuaucaagaacgcccagacgccccggagggggacgggcaccaccggggagacccugggggagaaguggaagcggcaguugaacagccucgaccgcaaggaguucgaggaguacaagagaaguggcauccuggagguggaccgcaccgaggcuaagagcgcccugaaggacggguccaagauaaagcaugccgucagccggggcaguagcaagauccgcuggaucgucgagcgcgggauggugaagcccaaaggcaagguugucgaccucgggugcggucggggcggcugguccuauuacauggcgacgcucaagaacgugacggaggugaagggcuacaccaagggaggcccggggcacgaggagcccaucccaauggccaccuauggcuggaaucucgucaaacuccacuccggcguggacgucuucuacaagcccacagagcagguugacacacugcugugugacaucggggagagcuccucgaacccgacgauagaggagggccgcacccuccgggugcugaagaugguggagcccuggcuguccagcaagcccgaguucugcaucaaaguccuuaaccccuacaugccgacggugaucgaggaguuagagaaacugcagcgcaagcacgguggcaaccugguucggugcccccucagucgcaacagcacccaugagauguacugggucuccggcgcgucggggaacaucgugucgagcgucaacaccaccuccaaaaugcugcugaaccgauucacgacacgccaccggaagccaaccuacgaaaaggacguggacuugggggcugggacgaggagcguguccaccgagaccgagaaaccagacaugacuaucauugggcggcgccuacagcggcugcaagaggagcacaaggagaccuggcacuacgaccaggagaacccguaccgaacgugggcguaccacgggagcuaugaggcccccuccaccgggucugccagcagcauggucaacggcguuguuaagcuccugacuaagcccugggacgucaucccgauggugacccagcuggccaugacggacaccaccccauucgggcagcaacggguguucaaggagaaagucgacacucgcacaccacagccuaagccgggcacccgaauggugaugaccaccacggccaacuggcucugggcgcugcugggaaagaagaagaacccucgccuaugcaccagagaggaguucaucaguaaggugcgcuccaacgccgccaucggcgccguuuuccaggaggagcaggguuggaccagcgccuccgaagcugugaacgacagccgguucugggagcuugucgacaaggagcgcgcacugcaccaggagggcaagugcgaauccugugucuacaacaugaugggcaagcgcgagaaaaagcucggggaguucggacgggccaagggaagccgcgcaaucugguauauguggcugggcgccagauuccuugaguucgaggcgcucggauuccugaacgaggaccacugguucggccgcgagaacuccuggagcggcguagaaggggagggcuuacaccgguugggguacauacuggaggagaucgacaagaaggacggagaccugauguacgccgacgacacggccggcugggauacucgcaucacugaggaugacuuacagaaugaggagcugaucacagagcagauggcuccccaucacaagauccuggcgaaggcaaucuucaaacucaccuaccagaacaagguggucaaggugcugcggcccaccccgcggggagccguuauggacaucaucucccggaaggaccaacgcggaucagggcaggucggcacguacgggcucaacaccuucaccaacauggaggugcaauuaauucggcagauggaggcugagggcgugauaacccaggacgacaugcagaacccaaagggccugaaagagcgcguggagaaguggcugcgggagugcgggguggaccgcuuaaaacggauggcuauuuccggagacgauugcguggucaagccacuggacgagagguucggcacgucucuuuuauuccugaacgauauggguaaggugcggaaggacauuccccaaugggaaccguccaagggguggaagaacuggcaagaaguaccuuucuguucacaccauuuccacaagauuuucaugaaggaugggcgcucccuggucguccccugccggaaccaggacgaacuuaucggccgcgcgcgcaucagccagggagcgggcuggucccugagggagaccgcuugccuggggaaggccuacgcccaaauguggagccucauguacuuccaucgccgggaccuucgucuggcguccauggccauuugcuccgcagugcccacagaaugguucccgacaagccgcacgaccuggucgauccaugcccaccaccaauggaugaccacugaggacaugcucaaggucuggaaccgcguguggauugaggacaacccaaacaugaucgauaagacgcccguccauucaugggaggacauaccuuaccuggggaagcgggaggaccuguggugcgggucccucaucggcuuaagcucccgcgcaaccugggcuaagaacauccauaccgccaucacccagguccggaaccuaaucggaaaggaggaguacguugacuacaugccggugaugaagcgcuauagcgcgcccagugagagcgaggggguccucuga

SEQ ID NO: 26269 - RNA, 9867 nt, Artificial Sequence
  derived and/or modified CDS sequence (opt11) from DENV-4__FJ639745__SS-prME
agcaccaugacccugcucugccugauccccacugccauggccuuccaccugagcacccgggacggcgaaccgcucaugauuguggcgaagcacgagcgggggcgcccgcugcuguucaaaaccacagaggguauuaacaagugcacguuaaucgccauggacuuaggggagaugugcgaggacacagucacauacaagugcccgcuguuggugaacaccgaacccgaggacaucgacugcuggugcaaccuuacgagcaccugggugauguacggcaccugcacccaguccggcgagcggcgccgggagaagcgcuccgucgcccugacuccacacuccggcaugggacucgagaccagggccgaaaccuggaugagcuccgaaggagccuggaagcacgcgcagcgcguggagagcuggauccuccgaaacccaggauucgcgcugcucgccggguucauggccuacaugaucggccagaccgggauccaacgcacaguguuuuucgugcugaugaugcucguggcccccuccuacgguaugcggugcgugggggucgggaaccgggacuuugucgagggcgucagcgggggcgcaugggucgaccugguguuagagcacggcgggugugugacuaccauggcccaaggcaagccaacccuagacuucgagcucacgaagaccacagccaaagagguagcacugcugcggacguauugcaucgaagcgcuuaucuccaacaucacgaccgccaccagauguccgacucagggggagccuuaccuuaaggaagagcaagaccagcaguacaucuguaggcgcgaugugguagaccggggcugggggaacggaugcgguuuauucgguaagggcggagucgugacgugcgccaaguuuagcuguuccggcaagaucaccgggaaccucguccagaucgaaaaccuagaguauacagucguggugaccguucacaauggcgacacgcacgccguuggcaaugacaccagcaaccacggggucacggccacgaucacacccagaucccccuccguggaagugaagcucccagacuacggcgaauuaacgcuggauugcgagcccagguccgggaucgacuuuaacgagaugauccugaugaagaugaaaaagaagaccuggcucguccacaaacaaugguucuuagaucugccccuccccuggaccgcgggagcugacaccagcgaggugcacuggaacuauaaggagcguauggucaccuucaaggucccucacgcuaagcggcaggacgugaccguccucgggucccaggagggcgccaugcauagugcccuggccggcgcaacugaagucgacagcggggacgguaaccauauguucgccgggcaccucaagugcaagguacguauggagaagcugcgcaucaagggcaugucauacaccaugugcagcgguaaguucagcauugacaaggagauggcugagacgcagcacgggaccaccguggucaaggugaaguacgagggagcuggggcgccgugcaaggugccaauagagauccgggacgugaacaaagagaagguggugggccgggugaucagcuccacccccuuagcagaaaauacgaacucugugaccaacaucgagcucgagccgcccuucggggacuccuacaucgugaucggcgucgguaacagcgccuuaacccugcacugguuccggaagggguccucaaucggcaagauguucgaguccaccuaccgcggggcuaaacggauggcgauccucggcgagacugccugggacuucgggagcgugggcggccuguucaccuccuuagggaaagcggugcaccaggucuucggcucaguguacaccacuauguucgggggcguguccuggaugauacgcauccucaucgggcugcugguucuguggaucggcacaaauagccgcaacaccuccauggccaugaccugcauugccguuggcggcaucacccucuuccuggguuucacggugcaagcugacauggguugcguuguaucuuggucgggcagagagcuuaagugcgggagcggcaucuucguggucgacaacgugcacacauggaccgagcaguacaaguuucagccagagucccccgcccggcucgccagcgccauacugaacgcacacaaggacggcguaugcggaaucagaagcaccacucggcuugagaaugucauguggaagcagaucaccaacgagcuuaacuacgugcugugggagggcgggcaugaccugacuguagucgcuggcgacgugaaaggugugcuaaccaaggggaagcgcgccuuaacaccgcccgucagcgaucugaaauauucuuggaaaaccuggggcaaggccaagaucuucacccccgaggccagaaauaguacauuccucaucgacgggcccgacacgagcgagugcccgaacgaacgaagagcuuggaacagucuggaaguggaagacuacggcuuugggauguucaccacuaacaucuggaugaaauuucgcgaaggcagcuccgaggugugcgaccaccgguuaaugagcgcggccaucaaggaccagaaggcgguccaugcagauaugggcuauuggauagaguccagcaagaaucagaccuggcagaucgagcgcgccagccucaucgaggugaagacguguuuauggccaaaaacgcauacccuguggucaaacggggugcuugaaucccaaaugcugauucccaagucguacgccggcccauuuucccagcauaacuaccggcagggauaugcgacccagaccgugggccccuggcacuugggcaagcucgagaucgacuucggcgagugccccggcacgacuguaaccauccaggaggauugcgaccacagagggccaagccucaggacgacaaccgcaagcggcaagcuagugacccaguggugcugccgguccuguacgaugccgccacugcgauuccucggggaggacggcugcugguacgggauggagauacggccucugagcgagaaggaggagaacauggucaaaucccaggugacggcaggucagggcaccagcgaaaccuucagcauggggcugcuuugucuuacccucuucgucgaggagugccugcgccggcgcguaacgcgcaagcacaugauccuggccguggugauaacgcucugcgccauaauccugggcgggcugacauggauggaccucuuacgcgcccugaucaugcucggugacacuauguccggccggaucgggggccagacgcaccuggccaucauggccguguuuaagaugucccccggguacgugcugggugucuuucuccgcaaguugaccagccgggagacugcgcugaugguaaucgggauggccaugaccacgacccucuccauaccccacgaucugauggagcugaucgacgguaucagccuaggccugauccuacucaagaucgugacccaguucgacaauacccaggucgggacccuggcccugagucucaccuucauccgcagcaccaugucccugguaauggccuggcggaccauaauggccguacuguucguggugacucucauuccccugugccgcaccucuugucugcagaaacaaucucacuggguggagaucaccgcgcucauacugggcgcccaggcacugcccguuuaccucaugacccugaugaagggagcgucccgucgcuccuggccgcugaacgagggcauuauggcggucgggcucgugagccugcugggauccgcccuucucaaaaaugacgucccccuggccggcccgaugguagccggagggcuccugcuggccgcguauguaaugagcgggagcucggccgaccucagucuggaaaaggccgccaacguccagugggacgagauggccgacaucacgggcuccagccccauaaucgagguaaagcaggacgaggacggguccuucucuauccgagacguggaggagaccaacaugauaaccuuacucguuaagcuggcucuaaucaccguaucuggucucuacccccuggccauuccugugacgaugacccugugguacauguggcaggucaaaacccaacgcucgggcgcccucugggacgugcccucacccgcugccacccagaaggcggcccugagcgagggcguguaccggaucaugcagcgcggccuguucgggaagacccaagucggcgugggaauccacauggagggcguguuccacacgauguggcacgucacccgggguuccguuaucugccacgagaccgggcgccucgagcccagcugggccgacgugcgcaacgacaugauauccuacggcgggggcuggcggcugggcgacaaaugggacaaggaggaagacguucagguccuggccaucgagccggguaagaaccccaagcacguucagaccaagcccggccucuucaagacgcuaaccggggagaucggcgccguuacccuggacuucaagccagggaccagcggcuccccgauaauaaacaggaagggcaaggucaucgggcucuacggcaaugggguggucacgaagucgggcgacuacguuucugccaucacccaggcugagcguaucggggagcccgauuacgaaguggacgaggauauauuucgaaagaagcggcugaccaucauggaccugcacccaggcgccgggaagaccaaacguauccugccuagcaucgugagggaagcccucaaacgccggcugcgcacacugauccucgcgcccacccgggugguggccgcggaaauggaagaggcccugcgcgggcugccaauccguuaccagaccccugccguaaaguccgaacacaccggccgcgaaaucguggaccucaugugccacgcgacguucaccacccggcuguuaucgagcacuagagugcccaauuacaaccuaaucgucauggacgaagcccacuucacagaccccucaagcguggccgcacggggguacauuagcacucgcguugagaugggcgaggccgcggccaucuucaugacggccaccccacccggggccacggacccguuuccccagagcaacucccccaucgaagacaucgagcgggaaauaccggagcggagcuggaacaccggguuugacuggaucaccgauuaccagggcaaaaccguuugguucgugccaagcauaaaggccgggaacgacaucgcgaacugccuucgcaagagcgggaagaaaguuauccagcugagucgcaagacuuucgacacagaguaccccaaaacgaagcucacugauugggacuucguugugacgaccgacauaucugagaugggggcuaacuuccgcgccggucgggucauagacccccgccggugccugaagcccgugauccuuaccgacgggccggagcgcgugauccucgccggcccgaucccugucaccccggcguccgcugcucagcggcgcggccggaucgggaggaacccagcacaggaggaugaccaguauguguucuccggagauccccuuaagaaugacgaggaccacgcgcacuggacggaggcgaaaaugcugcucgacaacauauacacccccgaggggaucauccccacacucuucggcccggagagggagaagacucaggccaucgacggcgaguuccgccuacggggggaacagcgcaagacguuuguggagcucaugagacgcggcgaccugcccgucuggcuguccuauaagguugcgagcgcagggaucuccuacaaggaucgggagugguguuucaccggcgagcgcaacaaccagauccucgaggagaauauggagguggagaucuggacccgggagggggagaagaaaaagcugcgcccccgguggcucgacgccagagucuacgccgaccccauggcgcuuaaggauuucaaggaguucgccagcggucgcaaauccaucacccuggauauccugaccgagauugccucgcuuccaacguaccugucuagccgggcuaaacuggcgcucgacaauaucgugaugcugcacaccaccgagcgcggcgggcgggccuaccagcacgcccuuaaugagcucccugagucgcucgagacuuuaaugcucguggcccugcuaggcgcgaugaccgccgggauauuccuguucuucaugcagggcaaagggauagggaagcuguccaugggccugaucaccaucgccgucgccagcggguugcuguggguagccgagauccaaccccaguggaucgcggcguccauuauacuggaguucuuucugauggugcugcuaaucccggagcccgaaaagcagcguaccccccaggacaaccagcucaucuaugucauacugacgauccuaacgaucaucggccucaucgcggccaacgagauggggcugaucgagaagaccaaaacggauuucggcuucuaccagguaaagaccgagacgaccauucuggacguagacuugcggccugccagcgcguggacccuguacgccguugcgaccacgauuuugaccccaauguugcgccauacaauagagaacaccuccgccaaucuaucacuagccgcgaucgcgaaccaagccgccgugcucaugggccuaggcaagggauggccccuacaccggauggaccuuggggucccauugcuggccaugggcugcuacucacaggucaacccuacgacacuaaccgcauccuuagugaugcugcuaguccacuacgccaucaucgguccgggccugcaagccaaagcuacucgggaggcccagaagcgaaccgccgccggcauuaugaagaaccccaccgucgacgggauaaccgugaucgaccuggagcccauuucguacgaucccaaauucgagaagcaacucggccaggugaugcuucuuguccucugugccggucagcugcuacucaugcguacgacgugggccuuuugcgaggugcugacccuggcuacgggcccgauccugacgcucugggaggggaaccccggccgguucuggaacacgacuaucgccguuucaacggccaacauuuuccguggcuccuaccuugccggagccggccucgcguucucucugauuaagaaugcccaaacccccagacgggggacgggaaccacgggggagacccugggcgagaaguggaagcggcaguuaaauucccuggaccgaaaggaauucgaggaauacaaacggagcggcauccuggaggucgacagaaccgaggccaaguccgcccucaaggacgggagcaagaucaagcacgccgugucccggggcagcuccaagauccgcuggaucguggagagggggauggucaagcccaaggggaagguuguggaccuggggugcggccggggcggguggagcuauuacauggcgacacugaagaacgucaccgaaguaaaaggcuauaccaaaggggggccuggccacgaggagcccaucccaauggccacuuauggcuggaaucucgugaagcugcacagcggggucgacguguucuacaagccuacggagcaaguggacacccuguuaugcgacauuggggaguccagcuccaacccgaccauugaggagggccgcacccuccggguccuaaagaugguggagcccuggcugagcuccaaacccgaguuuugcauaaaggugcuaaaccccuacaugccgaccgucauagaggagcuugagaaacugcagcgaaagcacggcgggaaccuggucagaugucccuuaagcagaaacuccacucaugagauguacugggucagcggagcauccggaaacaucgucagcuccgugaacaccacaagcaagaugcuacucaaccgguuuacgacccgccaccggaaacccaccuacgagaaggacgucgaccugggcgcgggcacccguuccgugagcacugagaccgagaagcccgacaugaccaucaucggccgaagguuacagcggcuacaggaagagcacaaggagaccuggcacuacgaccaagagaacccguaccgaacgugggcguaucauggguccuacgaggcucccagcaccggcuccgccagcuccauggugaacggcgucguuaagcuacuaaccaaacccugggaugugaucccgauggucacccaacucgccaugacggacaccacacccuucgggcagcagcgcguuuucaaagagaagguagacaccaggacgccccagcccaaaccgggcacccggauggucaugaccacaacggcaaacugguuaugggcauuacucggcaagaagaaaaacccccgccuauguacccgugaagaguucaucucuaaagugcgcucaaacgcagccaucggcgcaguguuccaggaggagcagggguggacuuccgccagcgaggcuguaaacgacucccgguucugggaguuaguggacaaggagcgcgcccuccaccaggagggcaaaugugagagcugcguguacaacaugauggggaagcgcgaaaagaagcugggggaguucggccgugccaaggguagccgcgccaucugguacauguggcugggcgcccgguuccucgaguuugaggcgcugggcuuucugaacgaggaucacugguucggccgcgaaaacagcugguccggggucgaaggggaggggcuccaccggcuggguuacauccuggaggagaucgacaagaaggauggcgaccucauguaugccgacgacacagccggcugggacacucgcaucaccgaggacgaucuacagaacgaggagcugauuaccgagcagauggccccucaccauaagauccuagcgaaggcaaucuuuaaguuaacuuaccaaaacaaggugguaaagguccugcggcccaccccgcgcggggccgugauggacaucaucucucggaaggaccaacggggcuccggacagguaggcacguacgggcucaacaccuucacaaacauggagguccagcugauccggcagauggaggccgagggcgucaucacccaagacgacaugcagaaccccaagggccugaaggagcgaguggagaaauggcuccgggagugcggcgucgauaggcugaagcggauggccaucagcggcgaugacugcgucguaaagccccuugaugagcgcuucgcaacuucccuccuauuccugaaugacauggggaagguucggaaggauaucccccagugggaaccgucgaaaggcuggaaaaacuggcaggaagugcccuucugcucccaccacuuccacaagauuuucaugaaggacgggcgcagccucgugguacccugccggaaccaggacgagcucaucggccgcgcccggaucucccagggagccggguggagccugcgagagaccgccugccucggcaaggccuacgcccagauguggucccuuauguacuuccaccgccgggaccugcgccucgcuagcauggccaucugcagcgccgugcccaccgagugguucccgacgucccggacgacauggagcauccaugcccaccaucaguggaugaccacggaggacaugcugaaaguguggaaccgcgucuggaucgaggacaaccccaacaugauagacaagacgccaguacacuccugggaggacauucccuaccuggggaagagagaggaccuuugguguggcagccugauugggcuuuccagucgcgcgacaugggcgaagaacauccacacugcgaucacucaggugcggaaccugaucggcaaagaggaguacgucgacuacaugccggugaugaagcgcuacuccgcgcccagcgaguccgaaggagugcuguga

SEQ ID NO: 26270 - RNA, 9867 nt, Artificial Sequence
  derived and/or modified CDS sequence (opt11) from DENV-4__FJ850095__SS-prME
agcaccaucacccugcucugccugauccccacgguuauggcauuccacuuauccacccgcgacggggaaccgcucaugaucgucgcuaagcacgaaagggggcguccucuacuguucaagaccaccgagggcauaaauaagugcacgcucauugcgauggaccugggggaaaugugcgaagacaccgucaccuacaaguguccccugcuggucaauaccgagccggaggauauugacugcuggugcaauuuaacgagcaccugggucauguacggcacuuguacccaguccggggaacggcggcgggagaaacggagcgucgcccugacuccucacuccggcauggggcuagagacccgggccgagacguggaugagcuccgaaggggccuggaagcaugcgcagcggguugaaagcuggaucuuacgaaacccgggcuuugcgcugcucgccggcuucauggcguacaugaucggucagaccgggauccagcgcacgguuuucuuugugcucaugaugcugguggcccccuccuacgggaugcgaugcguuggcguggggaaccgcgacuuuguggagggugucuccggaggggccuggguggaccucgugcuggagcauggcgggugcgucacgaccauggcccaggggaagcccacccuggauuucgagcucacgaagaccaccgcgaaagagguggcucugcugcggacuuauugcauagaggcccucauauccaacaucacaacugcgacgcgaugcccgacccagggggaacccuaccucaaggaggaacaggaucaacaauacaucugccggcgugacguggucgacagagguugggggaacggcuguggcuuauuugggaagggcgggguugugacgugugcgaaguucagcugcagcggcaagaucacggguaaccugguccagaucgagaaccuggaguacaccgugguggucacugugcacaacggcgauacccacgccgucgguaacgacaccagcaaucacggggugaccgccaccauuacgccucgcuccccgucgguggaggugaaacugccggacuacggggagcucacgcuggacugcgagcccagguccgggaucgauuucaacgaaaugauauuaaugaaaaugaagaagaagacauggcucguacacaagcagugguuccuggaccucccacuaccguggaccaccggcgccgacacgagcgaggugcauuggaacuacaaagaacgcauggucaccuuuaaggugccacacgcgaagcgacaagacgugacaguucuagggucccaggaaggcgcuaugcacagcgcccuggccggcgccacagagguugacagcggagacggcaaccacauguucgcggggcaccucaagugcaagguccgcauggagaagcugcgcauaaagggcauguccuacacaaugugcucagguaaguucuccaucgacaaggagauggcggagacccagcacgggacgaccgucguaaaggugaaguacgaaggugccggggcccccugcaagguucccaucgaaauacgggaugugaauaaggagaaggugguaggccgcguaauaagcgccacgccucuggcggaaaacaccaacucuguuacgaacaucgagcucgagccaccuuucggcgacaguuacaucgucaucggcguaggaaacuccgcccugacccugcacugguuccggaaggguagcuccauaggcaagauguucgaaucgacguaccguggggcuaaacggauggcuauuuuaggugaaaccgccugggacuucggguccgugggcggcuuauucacuagccuggggaaggccguccaccagguguucggcuccguguacaccacuauguucgguggcgucagcuggaugauccguaucuuaauagguuuccucgugcuguggaucgggacgaacucgcggaauaccagcauggccaugacgugcaucgccgugggcgggaucaccuuauuccucgguuuuaccguccaggcagauaugggaugcgugguuuccuggagcggccgugaacugaagugcggcuccggcaucuucgucguagacaacgugcacaccuggaccgaacaguacaaauuccagcccgaaagccccgcgcgguuggccagcgccauccucaacgcccacaaggacggggucugugguauccgcuccacgacucgccuugagaacgugauguggaagcagaucaccaacgagcugaacuacguccucugggagggcggacacgaccugaccgucgucgcuggggacgucaagggugugcugacaaagggaaagcgcgcgcucaccccucccgccagcgaccugaaguacuccuggaagaccuggggcaaagcuaaaaucuucacccccgaggcccggaacagcacauuccugaucgacgggcccgauacauccgagugcccgaacgagcgccgugccuggaacucguuugagguggaggauuacggcuucgggauguucacaacaaacaucuggaugaaguucagggagggguccagcgaggugugugaccaccggcucauguccgcugcgaucaaggaccagaaggccguccacgcugacaugggcuacuggaucgaaagcuccaagaaccagacauggcaaaucgaacgugcgagccucaucgaggugaagaccugccuguggcccaagacacacacucucugguccaacggggugcuggagagccagaugcugauccccaaguccuacgccgguccguucagccagcacaacuaccggcagggguacgccacacaaacggugggaccauggcaucucgggaaacuggagauagacuucggugagugcccuggcaccaccgugaccauccaggaggacugcgaccaccgcgggcccuccuugcgcacaaccaccgccagcggcaaguuggugacccaauggugcugccggagcugcacuaugccgccccugcgcuuccugggagaggacgguuguugguaugggauggagaucagaccccucuccgagaaggaggagaacaugguuaagucccaggugacggccggucaaggaaccucagagaccuucagcauggggcuccugugccuaacucuauucguggaggagugccugcgcagacgcgucacccgcaagcacaugaucuuagcgguggucaucacccuaugcgccaucauccugggcggacucaccuggauggaccugcuucgcgcccucaucaugcuuggggacacgaugagcggccgaaucgggggccagacccaccuggcgaucauggccgucuucaagaugucccccggauacgugcucggcgucuuccugcgcaagcugacaucucgggagaccgcgcucauggugaucgggauggccaugacgaccacccugucgauuccgcacgaucugauggagcucauagacggcaucagcuugggccugauccuccugaagaucgugacccaguucgacaacacgcaggucgggacacucgcacucagucugaccuucauccgcuccacgaugagccuggugauggccuggcggacgaucauggccguacucuucgucgucacccugaucccccugugccgcacuucgugccuccagaagcagagccauuggguggagaucacagcgcuuauccugggcgcccaggcccuccccgucuaccugaugacgcuuaugaagggggccucccggcggucauggccccucaaugagggcaucauggcugugggguuaguuucccugcucggcagcgcucugcugaagaaugauguaccgcucgccggccccaugguagcuggcggccugcugcuugcggcauacgugaugagcgggagcuccgccgaccucucccuggaaaaggcugccaacguacagugggacgaaauggccgacaucaccggcagcagucccaucaucgaggugaagcaggacgaggacgguuccuucagcauccgcgacguggaggagaccaauaugauuacccuccuggucaagcuggcccucauuacgguuuccggucucuacccccuggccaucccugucaccaugacccucugguacauguggcaggucaagacucagagauccggcgcccugugggacguuccgagccccgccgcgacacagaaggcggcuuuauccgagggcguguacagaaucaugcagcgcggccucuucgggaagacgcaggucgguguggggauccacauggaaggcguguuccacaccauguggcacgucacccggggcagcgugaucugccacgagaccgggcgccucgagcccuccugggccgacgugcgcaacgacaugaucagcuacggagggggcuggcggcugggcgacaagugggauaaggaggaggacguacagguucucgccaucgagccggguaagaaccccaagcacgugcaaaccaagcccggccuguucaagacccugaccggggagaucggggccgucacacucgacuucaaaccaggcacguccgguagccccaucaucaaccgcaaggguaaagugaucggguuguacggcaacgggguggugaccaaauccggcgauuacgucagcgcgaucacccaggccgagcggaucggggagccagacuacgagguggacgaggacauuuuucgcaaaaagcgucugaccauuauggaccugcacccgggggcgggcaagaccaagcgaauccugccguccaucguccgggaggcccugaagcgcaggcugagaacccucauccuagcgccaacccgggugguagccgccgagauggaggaggcccugcgcgggcuccccaucagguaccagacccccgcaguuaagagcgagcacacgggccgcgaaauuguggaccugaugugccaugcgaccuucaccacccggcucuuguccucgacgcgcgugccgaacuauaaucuaauugucauggacgaggcacacuucacggacccaaguucgguggccgcccggggguauauuagcacacgggucgagaugggcgaggccgcagcgaucuucaugaccgcgacgccacccggggcaaccgacccguucccccaguccaacagccccauagaggacaucgaaagagagauccccgagcgcucuuggaacaccggcuuugacuggaucaccgacuaccagggcaagacggugugguucgugccgagcaucaaagccgggaacgacauagcuaacugucugcgcaagucuggaaagaagguuauccagcucucucguaagaccuucgacaccgaguaccccaagacgaagcugacggacugggacuuuguggugaccacugacaucuccgagaugggggccaauuuccgcgccggccggguaaucgaccccagacggugccugaagcccgugauccucaccgacgggccggagcgugugauccuggcaggccccauccccgucacgccggcgagcgcugcccagcgccggggccgcaucgguaggaacccggcccaggaggacgaucaguacguuuucucaggcgacccccugaagaaugacgaggaccacgcccauuggaccgaggcuaagauguuguuagacaacaucuauaccccugaggggaucauccccacccuguucggaccagagagagagaagacgcaggccaucgacggcgaguucaggcuccguggggagcagcgcaagaccuucguggagcugaugcggcgcggcgaccuuccagucuggcucucuuacaagguugccucagcuggaaucagcuacaaggaucgggaguggugcuucaccggagagcguaacaaucaaauccuggaggagaacauggagguugagauuuggaccagagaaggggagaagaagaaauuacgccccaaauggcucgacgcccgggucuaugcggacccgauggcccugaaggacuucaaagaguucgccagcggccgaaagaguaucacccuggacauucucaccgaaaucgcuucccugcccaccuaccugaguucccgcgcuaaguuggcccuggacaacaucgugaugcugcacaccacagagcggggcgggcgugcauaucagcacgcccucaacgaacugcccgagagccuggagacgcucaugcugguggcccugcugggcgcaaugaccgccgggaucuuccuguucuucaugcaaggcaaagggauaggcaagcugagcaugggccucauuacuaucgccgucgccagugggcugcuguggguggccgagauccagccucaguggauugccgccagcaucaucuuggaguucuuccugauggugcugcucauccccgagcccgagaaacagcggacaccccaggacaaucagcugaucuacgucauacuaacuauccucaccaucauuggccugaucgcugcuaacgagaugggucugaucgagaagaccaagaccgauuucggcuuuuaucagguaaagacggagacaaccauccuggauguggaccugcgccccgcuagcgcguggacucuguacgccgucgcuacgaccauccucaccccgaugcugcggcacaccauugaaaacaccagcgccaaccugucacuugcggcgaucgccaaccaggccgcggugcuuauggggcucggaaaaggcuggccccuccacagaauggaccugggggugcccuuguuggcgaugggcugcuacucucagguuaauccaacgacccugaccgccucucuggugaugcuccuggugcacuacgcaauaaucgguccgggucugcaggcgaaggccaccagagaagcccagaagcggaccgccgccggcauuaugaaaaauccaaccgucgacgggaucaccgugauagaccucgagcccaucagcuacgacccuaaauuugagaagcaguugggccaagugaugcugcucgugcugugugccggucagcugcucuugaugcgaacgaccugggccuucugcgaggugcugaccuuggcaaccgggccgauccugacguuaugggaggggaaccccggccgcuucuggaacaccaccaucgccgugagcacagcaaacaucuuccggggcuccuaccucgcuggggccggacuggccuuuucccugauuaagaacgcccaaacgccccggcgggggaccgguaccacuggggaaacccuaggcgagaaauggaagagacagcuaaacagccuggaccggaaggaguucgaggaauacaagagauccggcauccucgaaguagaccggacggaggccaagagcgcauuaaaggacggauccaagaucaagcacgccgugagccgcggguccaguaagauccgguggaucguugagcgagggauggugaagcccaagggcaaggugguggaccugggaugcggccgugguggaugguccuacuacauggcgaccuugaagaacgugaccgaggugaagggcuacacgaaagggggcccuggacaugaggagccuauccccauggccacguacggcuggaaccuagugaagcugcauaguggcgucgacguauuuuacaagcccaccgaacagguggacacccuacugugcgacaucggggagagcuccagcaacccgaccaucgaggagggccggacgcugcgcguccucaagaugguggagcccuggcucuccagcaagccggaguuuugcaucaaggugcugaaccccuacaugccgaccgugaucgaggagcuggagaagcuccagcggaagcacggagguaaccuggugaggugcccccuguccagaaauucgacccacgaaauguacuggguaaguggugcuuccggcaacaucguauccagcgugaacacuacguccaagaugcucuuaaaccgcuucacgaccaggcaccgcaagcccaccuacgagaaagacgucgacuuaggagccgggacgcggagcguuuccaccgagacugaaaagcccgacaugacgaucaucgggcgcaggcuccagcgccuacaggaggagcacaaggagacguggcacuacgaccaggagaacccguauagaaccugggcguaccacgggucguacgaagccccauccaccggcagugccagcagcaugguuaacggggucgugaagcugcuaaccaaacccugggacguuaucccaaugguuacgcagcuggccaugaccgacaccacccccuucggacagcagcgcguauucaaggagaagguugacacgcggacaccccagccaaagccgggaacccgcaugguuaugacaacgaccgccaacuggcugugggcgcuccucgggaagaagaagaaccccaggcuguguacccgcgaggaguuuaucuccaaggugcggucaaacgccgcaaucggcgccguguuucaagaagaacaaggcuggaccagcgccuccgaggcggucaacgacagccgcuucugggagcucguggacaaggagcgggcccugcaccaggaaggcaaaugcgagucaugcguguacaacaugaugggaaagcgcgaaaagaagcugggggaguucggcagggccaaggggucccgggccaucugguauauguggcucggagcgcgcuuccuugaguucgaggcgcugggguuccucaacgaggaccacugguuuggccgggagaacuccuggagcggugucgagggagagggccugcaccgacugggguacauccucgaggaaaucgacaagaaggacggcgaucugauguacgccgacgauacggccggcugggauaccaggaucacugaggacgaccugcagaacgaagaacucaucaccgagcaaauggccccucaccacaagaucuuagcuaaggcgaucuuuaagcugaccuaucagaacaagguggugaagguccuucgccccacgccgagaggggccgugauggacauuauuagccgcaaggaccagcggggcagcggacaggugggcaccuacggccugaacacuuucaccaacauggaaguccagcuuauccgccagauggaggcugagggcgucaucacacaggacgacaugcagaaccccaagggccucaaggaacgaguggagaaguggcugcgcgagugcggggucgaucggcugaagcgcauggcuaucuccggcgacgacugcgucgugaagccgcucgacgagcgguucgggacgagccuucuguuccuaaacgacaugggcaaggucagaaaggacaucccccagugggagccgaguaagggguggaagaacuggcaggaagugcccuucugcagccaccacuuccacaagaucuucaugaaagacggccgcucccuggugguacccugccgcaaccaggacgagcugaucggcagggcgcgcaucagccagggggccggauggucacuccgcgagacagccugccuggggaaggccuacgcccagauguggagccugauguacuuccaccggcgcgaccuacggcucgcguccauggccaucuguucagccguccccaccgagugguucccgacgagccgcaccaccuggaguauacacgcccaccaccaauggaugaccacagaggauauguugaagguguggaaccgggucuggaucgaggacaaccccaacaugaucgacaagaccccuguccacaguugggaggacauccccuaucucggcaaacgcgaagauuuguggugcggaucccugauugguuugucgucacgggccaccugggcgaagaacauccacacagcaauaacacaggugagaaaucugauuggcaaggaagaauacguugauuauaugccgguuaugaagcgguacagcgcccccucugaaagugaaggaguucuguga

SEQ ID NO: 26271 - RNA, 9867 nt, Artificial Sequence
  derived and/or modified CDS sequence (opt11) from DENV-4__FJ639748__SS-prME
ucaacuaugacucuacuaugccucauuccaaccgcaauggcguuucaccuaucgacucgggauggugaaccucugaugaucguggcaaaacacgaacggggcagaccgcugcuguucaaaaccacugaagggauaaauaaaugcacccuaaucgcaauggaucuaggggaaaugugcgaagauaccguuacauauaaauguccacugcuaguaaacaccgaaccagaggauaucgacuguuggugcaaccuaaccagcacauggguuauguaugggacgugcacacaaucgggcgagcggcgccgagaaaaacgcagcguugcacucaccccucacucagggaugggcuuagaaacaagggcggagacguggaugagcucagagggugcauggaaacacgcacaaaggguugaaagcuggauccucaggaacccaggguucgcacuucuggcggguuuuauggcuuauaugauugggcaaacaggcauucagcgaacgguauucuuuguacuaaugauguuggucgcccccucauacggaaugagaugugugggcgucggcaacagagacuucguagaaggcgugagcggcggagcaugggucgaucuaguacuagagcacgggggcugcgucaccacgauggcccaaggcaaaccgacauuggacuuugaacucacgaagacaacugccaaggaaguagcacuucugcgaacuuacugcauagaggcccuaauaagcaacauaaccacagcaacgcggugucccacgcaaggagaaccuuaccugaaggaagaacaagaccagcaguacaucugccgacgagacgucguggaccgaggaugggguaauggauguggucucuucggcaaaggcggagucgucacaugcgcgaaguuuagcugcagugggaagauaacugggaaccugguccagaucgagaaucuagaauacaccguagucgugacuguucacaauggagacacacacgcaguugggaaugacacaucuaaccacgguguaaccgcgacaauaaccccgaggucacccucuguagaagugcagcucccagauuauggggaauuaacucuggacugcgaaccccggagcggcauagacuucaacgagaugauucucaugaagaugaaaaagaagaccuggcugguacacaaacagugguuuuuggaccugccccucccauggacugcgggggccgauaccagcgaaguacauuggaacuacaaggagcgaauggugaccuucaaagucccccacgccaaacgacaggacgucacgguacuaggaucucaagagggagcuaugcauuccgcccuggcaggcgcaaccgaaguagacucgggagacgggaaccauauguuugccgggcaucuaaaaugcaagguccgcauggaaaaauuacgaauaaaaggcaugagcuacaccaugugcagugguaaguucuccauugauaaggagauggccgaaacgcaacacggaacuacaguagucaaggucaaauaugagggugcgggcgcgcccugcaagguuccaauagaaauccgggacgucaacaaggagaaaguagucgggcgaguaaucuccagcaccccauuagcagagaacacuaauucggugaccaacauagaguuggaaccuccauucggagauagcuauauuguuaucggcguaggaaauucugcucuaacuuuacacugguucaggaagggaucauccauaggaaaaauguucgaaagcacguaccgcggcgcaaagagaauggccauacucggcgaaacagccugggacuucggaagcgucgguggccuguuuaccucguuggggaaagcgguucaucaaguguucggauccguuuacaccacgauguuuggcgggguaucguggaugauaaggauucucauagggcucuuagucuuauggaucggcacgaacagcaggaacacgagcauggcaaugacuugcaucgcgguaggcggcauuacccuguuccugggauucacaguccaggcggacguagggugcgucgugagcuggagcgggagagagcuaaagugugggagugggaucuucguggucgauaauguacauacauggacagaacaauauaaauuccaaccggagucccccgccagacuugcauccgcgauucuaaaugcccacaaagacggcguaugcgguauacggucgacgaccaggcuagagaaugugauguggaagcagaucacaaacgaacuaaacuacgugcuaugggagggcggacaugacuugacagugguggccggagacgugaaaggaguccuuacaaaagggaaaagggcgcuaacacccccaguaagcgacuugaaauauucguggaagaccugggggaaagcaaagauauucaccccugaagcccgcaauagcacguuccuaaucgaugggccggacacgagcgaaugcccuaacgaacguagagcauggaacagccuagagguggaagacuauggguucggcauguuuacaacaaacaucuggaugaaguuucgagaggggagcuccgaagucugcgaucaccggcuaaugagcgcagcaaucaaggaccaaaaggcaguacacgcggacaugggcuacuggaucgaguccucgaagaaccaaaccuggcaaauugaaagagcuucauugaucgaagucaaaaccugucuauggccuaagacccacacccuauggagcaauggaguacuagaaucccaaaugcugaucccgaaaagcuacgcagguccauucagccaacacaacuaccgccaaggguaugccacacaaacgguagguccauggcaccugggaaaacuggagauagauuuuggggaaugccccggaacaacuguaaccauacaagaggacugugaccaccggggccccagccuucgaacgaccacagcaucaggaaagcuagugacacaauggugcugucgcagcugcacgaugccgccccuccgauucuuaggagaggacggaugcugguacggcauggaaauaaggccccuauccgagaaggaggaaaacaugguaaaaagccaagugaccgcgggccaagggacguccgaaaccuucucaaugggucuauuaugccucacgcuauucgucgaagaaugccuccgacgacgggucacacgaaaacauaugauccuagccguggugauuacacucugcgcgaucauacuugguggccuaaccuggauggaccuacuucgcgcccuaaucaugcucggggacacaaugagcggaagaaucgguggacagacacaccucgccaucauggcuguauucaagaugucaccaggguacguccuagggguauucuugaggaaguugaccagccgagaaacagcuuuaauggucaucggaauggccaugacgaccacgcuaucaauaccucaugaucuaauggagcuaauagacgggauauccuuagggcucauacugcuaaaaauaguaacucaguucgauaauacacagguaggaacccucgcacugagccugaccuucauccgcagcaccaugucgcuggucauggcauggcgaacaauaauggcuguacucuucgugguaacguugauuccccucugcaggacgagcugccugcaaaagcaaucacacuggguugaaauaacagcccuaauccuaggugcacaagcgcuucccguauaccucaugacucugaugaaaggugccagcagaaggucguggccucuuaacgaggguaucauggcagucgggcuuguuucccuccugggaagcgcacuauuaaagaacgacgucccccuagccggcccgaugguagccgggggacuccuacuggcggcuuacgugaugagcggaagcucagccgaucuaagccuggagaaggcugccaacgugcaaugggacgaaauggcggacaucacuggaagcucgccgauaaucgaaguaaaacaggacgaagacgggaguuucucgauacgagacgucgaagaaacaaacaugauuacauugcuagugaaacucgcucucaucacgguaucaggucucuaucccuuggcgauacccguaacuaugacccuaugguacauguggcaaguaaagacgcaacggaguggcgcauuaugggacguaccgagcccugccgcgacacaaaaagccgcgcuguccgaaggaguuuaccggauaaugcagcgcggucucuucgggaaaacccaagucggggugggcauucauauggagggaguauuccacacaauguggcacguaacaagaggcagugucaucugccaugagacaggccgacucgaacccucgugggccgaugucagaaacgacaugauuagcuacggaggaggguggaggcuaggagacaaaugggacaaagaagaggacguacaaguccucgcgaucgagccaggcaagaauccaaaacauguacaaaccaaaccaggccuuuucaaaacacuaacaggugagauuggcgccgucacacuagacuuuaaacccggaacuucgggaagccccauaauaaaucggaaagggaagguaaucgggcucuacgguaacggggucgugacaaaaagcggugacuaugucuccgcaaucacccaagcagagagaauuggagagcccgacuacgaaguagacgaagacaucuuccggaagaaacgccuaaccauaauggaccuacacccuggggccggaaaaacaaaaagaauccugcccucgaucgugcgggaagcccucaaaagaagauuacggacacuaauacucgcacccacgcgaguagucgcagcagaaauggaggaggcccuuagaggacucccgauccgguaccaaacccccgccguaaaaagcgaacauacuggacgagagauaguagaccuaaugugccacgcgacuuuuaccacacgucucuuauccucuacccgggucccuaacuauaaucuaauaguuauggacgaagcccacuucaccgaccccagcagcguagccgcuagaggguacauaagcacacgcguggaaaugggagaagcugcagcaaucuuuaugaccgcgacgcccccaggcgcaacggaucccuucccucaauccaacucaccgauagaagacaucgagagggaaauaccagaacgcucauggaauacgggcuucgacuggauuaccgauuaucaaggaaaaacagucugguucguaccguccauaaaagccgggaaugacauagcgaacugucuacgcaaaagcgguaagaaaguaauccaacuaucucguaaaaccuucgacaccgaguacccaaaaacaaaacucaccgacugggauuucguggugacaacugacauuucugaaaugggagcuaacuucagagcugggagaguaaucgacccgcggaggugccuuaagcccguaauccuaacugacggcccagaacgugucauacuggcuggaccuauccccgugaccccagcgagcgcagcacagcgacggggcagaauuggccguaacccagcccaagaagaugaucaauacguguucagcggcgacccacuaaagaacgacgaagaccacgcacauuggacagaagccaaaaugcuacuggacaacauauacacacccgagggaauaauaccaacacuuuucggcccagagcgcgaaaagacacaagcuauagacggggaguucagacuucgcggggagcagagaaaaacuuucguugagcucaugcggcggggcgaccucccaguuuggcuaagcuacaagguagcaagcgcagguauaaguuacaaggacagggaguggugcuucaccggagagagaaauaaccagauacuugaagaaaauauggagguagaaaucuggacuagggagggagaaaagaagaaacuucgcccccgauggcuggaugcgcgcguauaugcagacccaauggcacuaaaagauuucaaagaguucgccagcggccgaaaguccauuacgcucgauauacugacagagauagcuagcuugcccaccuaccuaaguagccgcgccaaacuagcacuggacaacaucgucauguuacauaccacggaaagaggcgggagagcauaccagcacgccuuaaacgaacuaccggaguccuuggaaacccuuaugcugguggcacugcucggcgcgaugaccgcaggcauauuccucuuuuucaugcaaggcaagggcauaggcaagcuaucgauggggcugauaacaauagcagucgccucggggcuauuauggguagccgaaauccaaccccaguggaucgccgcgagcauaauccuggaguucuuccugaugguacugcuuauccccgagccugaaaagcaacgaacaccccaggacaaccagcuaaucuaugugauacuaacgauacucacgauuauaggacuaauugcggcgaacgaaaugggcuuaaucgagaaaacuaagaccgacuuuggguuuuaucaagugaagacagaaacgacgauucuagacguagauuuacggcccgcuagcgcguggacauuauacgcaguugcuaccacuauccuuacucccaugcugcgccacacgaucgaaaacacaagcgccaaccuuagccuagcugcuauugcaaaccaagcagccguccuaaugggacucggcaaaggauggccccuacaccgcauggacuugggaguaccccuccuugcaauggggugcuacagccaaguaaacccaacgacucugaccgccagucuugucaugcuguugguacacuacgcaauaauuggaccaggacugcaggcgaaggcaacucgagaggcccagaaacguaccgcagcgggaauuaugaaaaaucccaccguggacggcaucacggucaucgauuuggagccgauaagcuacgaccccaaauucgaaaagcagcuaggccaaguaaugcuccuaguucucugcgcaggccaacuacuccugaugcguaccaccugggcauuuugcgagguacuaacgcuggccaccggcccaauauuaacacuaugggagggaaaccccggucgguuuuggaacacaacgauagcgguaagcacggcaaacaucuuccgggggucauaccucgccggcgcaggacuggcguucagccuaaucaaaaacgcacaaacaccccguagaggaaccgggaccacgggggagacccuaggugaaaaguggaaacgacaauugaacagccuagaucggaaggaauuugaagaauacaaacggagugggauucuagagguugaccgaacagaggcaaagucggcacugaaagacggaagcaagauaaaacacgcaguaucccgcggcucgagcaagauccgguggaucguggagaggggaauggugaaacccaagggcaaaguuguggaccuggggugcggacggggaggcuggucauauuauauggcgacccugaaaaacgucaccgaggucaaaggauacacuaaaggcgguccuggacacgaagaacccaucccaauggccacguauggcuggaaccugguaaaguuacacuccggaguggauguauucuacaaaccaacggaacaggucgacacacuccugugugauaucggagaauccucaagcaaucccacaauagaggaaggaagaacgcuccgggugcucaaaaugguagagccguggcuaagcagcaagccggaguucugcauaaagguacuaaacccauacaugccaacaguaauugaagaacucgagaaauuacaaagaaagcacgggggaaacuuagugcgguguccccuaagccgcaacagcacacaugagauguacugggucagcggugccagcggaaacauaguuucaucagugaacaccacaaguaagaugcuacucaacagguucacaacgagacaucguaaaccaacauacgaaaaagaugucgaccuaggcgccggcacacggagugugaguacggaaaccgagaagcccgauaugacaauaaucggccggcgccuacagcgacuccaggaggaacacaaagaaacguggcacuacgaucaagaaaauccuuaccggaccugggcauaccauggcagcuacgaagcccccagcacaggcagcgccagcucgauggucaacggcgucgugaagcuccugacaaagccgugggacguuaucccgaugguaacacagcuggcaaugacagauaccaccccauucggacaacaaagaguauucaaggaaaaaguagacacgaggacaccacaguccaaaccgggcacgcggaugguaaugacaacaacagcuaacuggcuaugggcacuacucggcaagaagaagaauccccgauuauguacacgagaagaguucaucagcaaaguaaggaguaacgccgcaauaggcgcggucuuucaggaagaacaaggcuggacgucagcgucggaggccgucaacgacucgcgcuuuugggaacuggucgacaaggagcgagcccuacaccaagagggcaaaugcgaaucaugcguguacaacaugaugggcaaacgugagaagaaacuaggugaguucggacgcgcgaaagggucacgagccauaugguacauguggcuaggugccagauuccucgaauuugaagcacugggcuuucucaaugaggaccacugguucgggcgggagaacucguggaguggggucgagggcgagggucuacaccgcuuaggcuacauucuagaggaaauugacaagaaagacggagaccucauguaugccgacgacacggcaggcugggacacgagaaucacugaggacgaccuacaaaacgaagaacucauaacagaacaaauggcgccgcaccauaaaauccuggcaaaagcaauuuuuaaacucacguaccagaauaaggucgugaaaguccucagaccgacacccaggggagcggugauggacaucauaucccggaaggaccaacggggcucagggcagguagggacauacggccugaauacauuuacaaacauggaggugcagcucauaagacagauggaagcagaaggggucauaacacaagacgacaugcaaaacccaaaaggccugaaggaacgagucgaaaaguggcuacgcgaauguggcguagacagacuaaaacgaauggccauaagcggagacgacugcguaguuaagccguuagacgaacgauucgcaacgucuuugcuguuuuugaacgacaugggcaaaguacgaaaagauauaccccaaugggaacccuccaagggcuggaagaacuggcaggaggugccuuuuugcagucaccacuuccacaaaauauuuaugaaggacgggagaagccuaguggucccaugcagaaaccaagacgaacucaucggcagggcacguaucagucaaggcgccggauggucacuacgagaaacggcgugccucggaaaagcguacgcucagauguggagcuugauguacuuucaccggcgagacuuacgacuagcaaguauggcaauaugcucagcuguaccaaccgaaugguuuccgacuagccgaaccacaugguccauacaugcacaucaccaguggaugacuacagaggacaugcuaaagguuuggaacagaguauggauagaggauaaucccaacaugauagacaaaaccccagugcacucaugggaggacauaccauacuuagggaagcgugaggaccuguggugcggaagucugauaggauuaagcagcagagcaacaugggccaaaaauauccauacagccauaacgcaaguccgaaacuuaaucggaaaggaggaguacguagacuauaugccagugaugaagcgcuauagcgcgccuagcgagaaugaaggaguacuuuaa

SEQ ID NO: 26272 - RNA, 9867 nt, Artificial Sequence
  derived and/or modified CDS sequence (opt11) from DENV-4__FJ639764__SS-prME
agcaccauuacgcugcucugccugaucccgaccgugauggcauuucaccuauccacccgcgacggcgagccccuuaugauugucgcgaagcacgagcgggggcgcccccugcuguucaagaccaccgagggcacgaacaagugcacccucaucgcgauggaccugggugagaugugcgaggauaccgugaccuacaaaugcccccugcucgugaacacggagccugaagacaucgacugcuggugcaaucugaccagcaccugggugauguacgguaccuguacgcaguccggagagcggcgccgggagaagcgcagcguggcccugaccccgcacuccggcaugggccucgaaacccgggccgagaccuggaugaguuccgagggggccuggaagcacgcccagcgcguggagagcuggauccugcggaaccccggguucgcacugcucgccggguucauggccuacaugaucggccaaacggggauccagcgcaccguguucuucgugcugaugaugcugguugcccccuccuauggcaugcggugcgucggcguggggaaccgcgacuucguggagggcgugagcggaggcgcguggguggaccucgugcuggagcacggcgggugcgucaccaccauggcccagggcaagcccaccuuggacuucgaacuuaccaagaccaccgccaaggagguggcccugcugagaacauacugcauugaagcccucauauccaacauuaccacagcgacgcgcugcccgacgcagggggagccauaccuaaaggaggagcaggaccagcaguacaucugccggcgugacgugguggaccggggcugggggaacgguugcgggcuguucgggaagggugggguggugaccugcgcgaaguucagcugcuccggcaagaucaccggcaaucucguccagaucgagaaccuggaguacaccgugguggucacgguacacaacggcgacacccacgcagucggcaacgacacuagcaaccacggggugaccgcgacuaucacgccccgguccccaagcguggaggucaagcugccggacuacggcgagcucacucuggacugcgagccccgguccgguaucgacuucaacgagaugauccugaugaagaugaagaagaagaccugguuagugcauaagcaaugguuccuggaccugccccuccccuggacggccggcgcggacaccagcgaggugcacuggaacuacaaggagcgcauggucacguucaaggugccgcacgccaagcggcaggacgugaccguccuggggucacaggagggcgcgaugcacagcgcccuugccggcgcgacugagguggacagcggggacggcaaccauauguucgccggccaccuuaagugcaaggugcgcauggaaaagcugcgcaucaagggcauguccuacacgaugugcagcgguaaguucucaaucgauaaggagauggcggaaacccagcacgggaccaccgucgugaaggucaaauacgagggcgccggggccccauguaagguccccaucgagauccgugacgugaacaaggaaaaggugguugggcgcguuauuagcuccacgccccuggcggagaacaccaacagcgucacaaacaucgagcucgagccgccguucggggacuccuacaucgucaucggcgugggaaacagcgcccugacccugcacugguuucggaagggguccagcaucggcaagauguucgaauccacguaccgaggggccaagcggauggcgauccucggcgagacagcgugggacuucgggagcgugggugggcuuuucaccagccuggggaaggccguccaucagguuuucggaagcguguacaccacgauguucgggggcgucuccuggaugauccgcaucuugaucggcuuccuggugcucuggauaggcaccaacagccggaauaccuccauggccaugaccugcaucgccgugggcgggauaacgcuguuucucggauucacaguccaagccgacauggggugcguggugagcuggagcggucgcgaguugaagugugggagcggaaucuucgucguggacaacgugcacaccuggauugagcaguacaaguuucagcccgagagccccgcgcggcuggccuccgccauccucaacgcgcacaaggacggugucugcgggauccgcagcaccacgcggcuggagaacgugauguggaagcagaucaccaacgagcugaauuacguguugugggagggcggacaugaccugaccgucguugccggggacgugaagggcguccugaccaaggggaagcgcacgcucaccccgcccguguccgaucugaaguacagcuggaagaccuggggcaaggcgaagauuuucacccccgaggcccggaacuccaccuuccugaucgacgggcccgacaccagcgagugccccaacgagcgaagggccuggaacucccucgaaguagaagacuacggauucgggauguucaccaccaauaucuggaugaaguuccgcgagggcagcucggaggucugcgaccaucggcugaugucagcugccaucaaggaccagaaggcggugcacgccgacaugggcuacuggaucgaguccucgaagaaccagacguggcagaucgaacgagccucccugauugagguuaagaccugccucuggccuaagacccacacccuguggagcaacgggguccuggagucccagaugcucauaccaaagagcuaugcgggcccguucagccagcacaauuaccgccagggguacgcuacccaaacggugggccccuggcaccuggggaagcuggagaucgacuucggcgaaugccccggcaccaccgugaccauacaagaggacugugaucaccgcgggcccagccuccgcacuaccaccgccagcggcaagcuggucacccaguggugcugccgguccugcacgaugccgccccugcgcuuccucggggaggacggcugcugguauggaauggagauacggccucuaagcgagaaagaggagaacauggugaagucccaggucaccgccggccagggcaccucagagaccuucuccauggggcugcucugccugacucuguucguggaggagugccugcgccggcgcgugacccggaagcauaugauccuggcagucgugaucacccugugcgcuaucauucucggcgggcugaccuggauggaccugcuuagggcgcuuauaaugcugggcgacacgaugaguggccggaucgggggccagacccaccucgccaucauggccguguucaagaugucccccggguacguccucgguguguuccugcgccggcucaccagcagggagaccgcccugauggugaucggcauggccaugacgaccacccuguccaucccgcacgaccucauggagcugaucgacggcauaagccugggucucauccuguugaagaucguuacccaguuugacaacacucagguggggacccucgcgcugucccuuaccuucauccggagcaccaugucccucgugauggccuggcgcacgaucauggccguccuguucguggugacccugaucccccucugccggaccucgugccugcagaagcagucccauugggucgaaaucaccgcccugaucuuaggcgcccaggcgcugcccguguaccugaugacgcucaugaagggggccagccgccgguccuggccucuuaacgagggcaucauggccguuggacuggucucgcuguugggcuccgcccugcucaagaacgacgugccgcuggcgggccccaugguggccgggggucugcuccuggccgcuuacgucaugagcgggagcuccgcggaccuuagccucgagaaggcggccaacgugcagugggacgagauggccgacauuaccggcucgagucccaucaucgaggugaagcaggacgaggacggguccuucagcauccgagacgucgaggagaccaacaugaucacccugcuugugaagcucgcccugaucacggugucgggccuguacccccuggccaucccggucaccaugacccugugguacauguggcaggucaagacccaacguagcggcgcgcugugggacgugcccuccccggccgccacccagaaggccgcucuaucggagggcgucuaccgcauaaugcagcggggccuguucggcaagacccaggugggcgugggcauccacauggagggcgucuuccacaccauguggcacgugacccgcggcuccguaaucugccacgagaccgggcggcuggagcccagcugggcggacguccggaacgacaugaucuccuacggcggcgguuggcggcuaggcgacaagugggauaaagaggaggacguccaggugcuggccgucgagccggggaagaaccccaagcacgugcagacgaaacccggccuguucaaaaccaucaccggggagaucggcgccgugacccucgacuucaagcccgggacgagcggcucccccauuaucaauaggaaggguaaggucauugggcuguacggcaacgggguggucacuaagagcggcgacuacgucucagccauuacccaagcugagaggaucggcgagcccgacuacgagguggaugaagacaucuuccggaagaagcgccugaccaucauggaccuccaccccggcgcgggcaagacgaagcggauccugccgucuaucgugcgcgaggcccuaaagcggcgccugcggaccuuaaucuuagcccccacccgcgucguggccgcggagauggaggaggcccugcgcgggcuccccauccgcuaccagacccccgcaguuaaguccgagcauacgggccgggagauugucgaccugaugugccacgccaccuucaccacccgucugcucagcagcacgcgggugccaaacuauaaccugaucgucauggacgaagcccacuucacugaccccuccagcgucgcugcccgcggguacaucuccacccggguggagaugggcgaggccgccgccaucuucaugaccgcuacgccccccggggcaaccgacccguucccccagagcaauucccccauugaggacaucgagcgcgagauccccgagaggagcuggaacaccggauucgauuggaucaccgacuaccagggaaagacggucugguucgugccguccaucaaggccggcaacgacaucgccaacugccugcgcaagagcggcaaaaaggugauccaacucucccgcaagaccuuugacaccgaguaccccaagaccaagcugacggacugggacuucgucguuaccaccgacaucagcgagaugggggccaacuuccgggcuggccguguuauagacccccggagaugccugaagcccgucauccugaccgaugguccggagcgggucauccucgcgggccccaucccugugacgcccgccuccgccgcgcagcgcagaggccgcauuggacguaacccugcccaagaggacgaccaguacguguucagcggggacccccugaagaacgacgaggaccaugcccacuggaccgaggccaagaugcuccuggacaacaucuacacccccgaagggaucauccccacccuguucggccccgagcgcgaaaagacgcaggcaaucgacggcgaguuccgacugcgcggggagcagcguaagaccuucguggaacugaugcgccggggcgaucugcccguguggcucuccuacaagguugcgagcgcugguauuucuuacaaggaucgcgaguggugcuuuaccggcgagcggaacaaccagauucuggaggagaacauggagguggagauauggacccgggagggugagaagaagaagcuacggccccgcuggcuagacgcccgcguguacgcagacccgauggcccugaaggacuucaaggaguucgcgagcggccguaaauccauaacccuugacauccucacggagaucgccagcuugccgaccuaucuguccagucgcgccaaguuagcccuggacaacaucgucaugcuacacaccaccgagcggggcgggcgcgccuaccagcacgcguuaaaugagcugcccgagagccuggagacguugaugcuuguggcccuacucggcgccaugaccgccgggaucuuucuguucuucaugcagggcaaggggaucgggaaacuguccaugggccuaaucaccaucgcaguggcgagcggguugcugugggucgccgagauccagccccaguggaucgccgccuccaucauccucgaauuuuuccugauggugcugcuuaucccggagcccgaaaagcagcggacuccgcaggacaaccagcugaucuacgugauccugacgauccucacaaucaucggccugaucgcggccaacgaaauggggcuuaucgagaagaccaagaccgacuucggcuuuuaccaggucaagacagagaccaccauccucgacgucgaccuacgccccgccagcgcuuggacccuauaugccguggcgaccaccauccucaccccgaugcugcggcacaccauugagaauacguccgcaaaccugagcuuggccgccaucgccaaccaggcggccgugcugaugggacugggcaagggcuggccccuccaccgcauggaccuggggguaccccuuuuagcgauggggugcuacucgcagguaaaccccaccacccugaccgccucgcuggucauguuacuggugcacuacgccaucaucgggccuggccugcaagcgaaggccacgcgggaggcccaaaaacguaccgccgcgggcaucaugaagaacccgaccguugacgggaucaccgucauagauuuggaacccaucuccuaugacccaaaauuugagaagcagcuaggccaggugaugcugcuagugcugugcgccgggcagcugcuccugaugcggacuaccugggccuucugcgagguacugacgcucgccaccggcccgauccuaacgcugugggagggcaaccccggucgcuucuggaacaccaccaucgccgugagcaccgcuaacaucuuccguggguccuaccucgccggagccggcuuggccuucucucugaucaagaacgcacagaccccccgccggggcaccgggaccacuggggaaaccuugggcgaaaaguggaagcgccagcugaacucucuggaccggaaggaauucgaggaguacaagcgcagcggaauccucgagguggaccggacggaggcuaaauccgcccugaaagacgggagcaagaucaagcacgccguaucccgcggcagcuccaagauccgcuggauuguggagcgggggauggugaagcccaagggcaaggucguggaccuggggugcggccggggcggguggagcuacuauauggccacccucaagaacgugaccgaggucaagggcuacaccaagggcgggccggggcaugaggagcccauccccauggccacguacggcuggaaccuggugaagcugcacucaggcguggaugucuucuacaagccgaccgagcagguggacacucuccugugcgacaucggggaguccagcuccaacccuaccaucgaggagggccggacacugcgcgugcucaagauggucgagcccuggcugagcuccaaacccgaauuuugcaucaaggugcucaaccccuacaugccgaccgucaucgaggaacuggagaaacuacagcggaagcacggaggcaaucuggugcgcugcccgcugagcagaaauuccacccacgagauguacugggugagcggagcgucagggaacaucgucucguccgugaacaccacuagcaagaugcuacugaaccgcuucaccacccggcaccgcaagccaacguacgagaaggacguggaccugggcgccgggacgcgguccgucagcaccgagaccgaaaaacccgacaugaccaucaucgggagacggcuccagcgccugcaggaggagcacaaggagacguggcauuacgaccaggagaacccguaccggaccugggccuaccacggguccuacgaggcccccagcacuggcuccgcaagcuccauggucaacggcguggugaagcuacucaccaagcccugggacgugauccccauggugacgcagcuggccaugaccgacacuacccccuucggucagcagcgcgucuucaaggagaagguggacacgcggacgccccagcccaagccgggcacccggauggugaugaccacgaccgcuaauuggcugugggcccuccuggggaagaagaagaacccccggcugugcacgcgcgaggaguucaucagcaagguacggagcaacgccgcgaucggcgccguuuuccaggaggagcagggauggaccuccgccagcgaggccgugaacgacucccgcuucugggagcucgucgacaaggaacgcgcccugcaccaggagggcaagugcgagagcuguguguacaacaugaugggcaagcgggagaagaagcugggggaguucggccgcgcaaagggaucccgggccaucugguacauguggcucggcgcccgcuuccuggaguucgaggcccugggguuucucaacgaggaccacugguucggccgagagaacaguugguccggcguggagggugagggccugcaccgccugggguacauccucgaggaaaucgacaagaaggacggcgaccugauguaugccgacgacacggcgggcugggacacacggauaacagaggacgaccugcagaacgaggagcucaucaccgagcagauggcgccccaccacaagauccuggccaaggccaucuucaagcugaccuaccagaacaaggucgucaaggugcuccgccccacgccgcgcggggccguaauggacaucaucagccgcaaggaccagcgggguaguggccagguaggcaccuacggacugaacaccuucacaaacauggaggugcagcugaucaggcagauggaggccgagggugucaucacucaggacgacaugcagaaccccaagggccucaaagagcggguugaaaaguggcugagggagugcgggguggaccgguuaaagcgcauggccaucagcggcgacgacugcgucgugaagccgcucgaugaacgguuugggaccucccugcuguuucucaacgacaugggcaaggugcgcaaagacaucccacaaugggagccgagcaagggguggaagaauuggcaggaagucccguucugcucacaccauuuccacaagaucuucaugaaggacggacggucucugguggugccgugccgcaaccaggacgaacugaucggccgcgcccgaaucucccagggagccggcuggagccuccgcgaaacggcaugccuggggaaggccuacgcccagauguggucccugauguacuuccaucggcgcgaccuccggcuggccagcauggccaucuguagugcgguccccacugagugguucccaacgucccgcaccacuuggagcauccacgcccaccaccaguggaugaccacggaggauaugcugaagguguggaaccggguguggaucgaggacaaccccaacaugaucgacaagaccccgguccacucgugggaggacauucccuacuugggcaagcgggaggaucuguggugcgggagccugaucggccucucgaguagggcaaccugggccaagaauauccauaccgccaucacccaggugcgcaaccugaucggcaaagaggaauacguggacuacaugccggucaugaagcgcuacucagcgcccagcgagucugagggggugcuguga

SEQ ID NO: 26273 - RNA, 9867 nt, Artificial Sequence
  derived and/or modified CDS sequence (opt11) from DENV-4__FJ639773__SS-prME
agcaccaucacccugcucugcuugauccccacggugauggccuuccaccuguccacaagagacggcgagccucucaugaucgucgcaaagcacgagcgggggcgcccccugcuguucaaaaccaccgagggcaucaacaagugcacgcuaaucgcgauggaccugggggagaugugcgaagacacugugaccuacaagugcccccugcucgugaacaccgagcccgaggauauagacuguuggugcaaccugacgucgaccugggucauguacggcaccugcacgcagagcggugagcggcgccgggagaagcgcagcguagcccugacgccgcacuccggaaugggccucgagacccgggcggagaccuggaugucguccgagggggccuggaagcacgcccagcgcguggaaagcuggaucuugcggaaccccggcuucgcgcugcucgccgguuucauggccuauaugaucggccagacuggaauccagaggaccgucuucuucgugcuaaugaugcucguggcccccuccuauggcaugagaugcgucggcguggggaaccgagacuucguggagggcgucagcgggggcgcguggguggaucucgugcuggagcacggagggugcgucaccaccauggcccagggcaagcccacccuggacuucgagcucacgaagaccacggccaaggagguggcccugcuccggaccuacugcauugaggcccuaaucuccaacaucacgaccgcgacccggugccccacccagggggagcccuaccugaaggaggagcaggaccagcaguacaucugccggagagacgugguggaccggggcugggggaacggaugcggcuuauucggaaaggguggggugguuaccugcgccaaguuuagcugcuccggcaagaucaccgggaacuugguacagaucgagaaccuugaguacacagugguggucaccgugcacaauggcgacacucacgccgucgguaacgacaccuccaaccacggagugaccgccacuaucacuccccgaucccccagcguggaggucaagcuaccggacuacggggagcucacccuagauugcgagccgcgguccggaaucgacuucaacgagaugauccugaugaagaugaagaaaaagaccuggcucguccacaagcaaugguucuuagaccugcccuugcccuggacaaccggggccgacacgagcgaggugcacuggaauuacaaggagcgaauggucaccuucaaagugccgcacgcgaagcggcaggacgugaccguccuggggucccaggagggcgcuaugcacagcgcccucgcuggcgccacugaagucgacucgggggacggcaaccacauguuugcggggcacuugaagugcaaaguaaggauggagagacugcgaauaaagggcauguccuacacaaugugcagcggcaaguucucaaucgacaaagaaauggccgagacccagcaugggacgacagucgugaaagugaaguacgaaggcgcgggggccccgugcaagguacccaucgaaauccgagacgugaacaaggagaagguggucggcagagugaucucugccacgccccuggccgagaacaccaacagugugaccaacaucgagcuugaacccccuuucggggacagcuauaucgucaucggcgugggcaacuccgcgcugacccugcacugguuccgcaagggaagcucaaucggcaagauguuugagagcacguaccgcggggccaaacgcauggccauccucggcgagaccgcgugggacuuuggaucagugggcggccuauucaccagccuggggaaggccguccaucaggucuucggcuccguguauaccacgauguuugggggggucagcuggaugauccggauccucaucggguuccuugugcuguggauagguaccaacucccgcaacaccagcauggccaugaccugcaucgccgugggcgggaucacgcuguuccucggcuucacggugcaggccgacauggguugcguggugagcuggagcggacgggagcugaagugcggaaguggcaucuucguaguagacaacgugcacaccuggaccgaacaguacaaguuccagcccgagagccccgcccgccuggccuccgccauccuaaacgcgcacaaggauggugucugcgggauccggagcacgacacgccuugagaacgugauguggaagcagaucaccaaugagcugaacuacguguugugggagggcgggcaugacuugacggugguggcaggcgacgugaagggcguccugacuaaggggaagcgggcguuaaccccgccggccucugaccugaaauacuccuggaagaccuggggcaaggccaaaaucuucacccccgaggcccgcaacagcacauuccugaucgaugggcccgacacguccgagugcccgaacgagcggcgcgccuggaacagcuucgaggucgaggacuacggcuucgggauguuuaccaccaacaucuggaugaaauuccgggagggcaguagcgaagugugcgaccaccgccucaugucggcggccaucaaggaucagaaggccguccacgccgauaugggauacuggaucgagagcuccaaaaaccagacguggcagauagagcgggcgagccugaucgaggugaagaccugccuguggcccaagacccacacccucugguccaacggggugcuagagagccagauguugaucccuaaguccuacgccggcccguuuagccagcacaacuaccgccagggguacgcuacccaaacggucggccccuggcauuuggguaagcuggagaucgacuucggcgagugccccggcaccaccguaaccauccaggaggacugcgaccaccgagggccgucccugcggacgacaacugccucgggcaagcucgugacccaguggugcuguaggaguugcacgaugccgccccugcgguuccugggggaggacggcuguugguacgggauggaaauccgcccccucuccgaaaaggaggagaacauggucaagagccagguuaccgccggccagggcaccuccgaaaccuuuagcauggggcugcuuugccucacguuauucgucgaggagugccugagaagaagggugacccgcaagcacaugauccucgcuguggugaucacccugugcgccaucauccugggcggguugaccuggauggaucuccugcgggcccucaucaugcugggagacacgauguccggucgcauugggggccagacccaccuggccaucauggccguguuuaagaugagccccggguacgugcucggcgucuuccugcgaaagcuaacuucccgcgagaccgcgcucaugguaaucgggauggccaugacgaccacccugagcaucccgcacgaccucauggagcucaucgauggcauaucccugggccuaauccuacugaagaucgugacccaauucgauaacacgcaggucgggacccuggcccucagccugaccuucauacgguccaccaugagccuggugauggcauggcguacgaucauggccguccucuucgucgugacccugaucccccugugccggaccuccugucuccagaagcagagccacuggguggagaucacggcgcugauucugggugcccaggcccucccagucuaccugaugacgcugaugaagggggcgucucgccggagcuggccccucaacgagggcaucauggcgguggggcuggugucccugcugggaagcgcccugcugaaaaaugacgucccgcucgccgggccaaugguggccgggggccuucuguuggccgcguauguuauguccgggagcucugccgaccugucccuggagaaagccgccaacgugcagugggacgagauggccgacaucaccgguaguagucccauuaucgaggugaagcaggacgaggaugggaguuuuuccauacgcgacguagaggagaccaauaugaucacccuccuggucaagcuggcgcucaucacggugaguggccuguacccccuggcuauaccggugaccaugacccucugguacauguggcaagucaagacgcagcggucaggcgcccuuugggacgugccuuccccagccacaacgcagaaggccgcgcugucagaggggguguaccgcaucaugcagcggggccuguucgggaagacacagguggggguggggauccauauggaaggcguguuccacaccauguggcacgucacccgaggcagcgugaucugccacgagacggggaggcuggagcccuccugggccgauguacggaaugacaugaucaguuacggcggggguuggcgccugggcgacaagugggacaaggaagaagacguccaggugcucgcaaucgaaccggggaagaaccccaaacacguacagaccaagcccggcuuauucaaaacccugaccggggagaucggcgccgucacgcucgacuucaagcccgggaccucuggcagcccaauaauuaaccggaagggcaagguuaucgggcucuacggcaacgggguuguaaccaaguccggcgacuacguguccgcgauuacccaggcggagagaauuggggagcccgauuacgagguggacgaggacaucuuccggaagaagcgccugacgaucauggaccuccaccccggcgcuggcaaaaccaagcggauccugccguccaucgucagggaagccuugaagcggcgccugcggacucucauccucgcccccacccgcguggucgcugccgagauggaggaggcccugcgggggcuccccauaagauaccagacccccgccgucaaaagcgagcacacgggccgugagaucguagaccugaugugccacgcuaccuucaccacgaggcugcucuccagcacccgggugccgaacuacaaccuaaucgucauggacgaggcgcauuucaccgaccccagcucaguggccgcccgcggguacaucuccacccgggucgagaugggcgaagccgccgcgaucuucaugacggccaccccccccggggcuaccgacccguucccccaguccaacucucccauugaagacaucgaacgcgagauccccgagcgcucauggaauaccggcuucgacuggauaaccgauuaccagggcaagaccgugugguucguaccgucgaucaaggccgggaacgacaucgccaauugccugcguaaauccgguaagaaggucauccagcucucacgcaaaaccuuugacacugaguaccccaagacgaaguugaccgacugggacuucgugguaaccaccgacauuuccgagaugggggcgaacuuccgggcgggccgcgucaucgauccccgacguugccugaaacccgugauccuuacggacggcccggaacgggugauccuggccggccccauuccugugacccccgccagcgccgcccagagacgggggagaauugggcggaacccagcccaggaagacgaccaguacguguucuccggcgacccccugaagaacgacgaggaucaugcccauuggaccgaggccaagaugcuucuggacaacaucuacacccccgaggggaucauccccacguuguucggcccagaacgcgagaagacccaagcgaucgacggcgaguuccggcuucgcggggagcagcggaagaccuucguggagcugaugcgccggggggaccugcccgucuggcucagcuacaaggucgcuagugccgggauaagcuacaaggaucgcgaguggugcuucaccggcgaacggaacaaccagauccuggaggagaacauggagguggagaucuggacgcgcgagggcgagaagaagaagcugcggccuaaguggcucgacgcccgcgucuacgccgaccccauggcgcuaaaagacuucaaagaguucgcauccggcaggaaaagcauuacguuggacauccuaaccgagaucgccucccugccgaccuaccugagcucccgggccaagcucgcccuggacaacaucgugaugcugcacaccacggagcgcggagggcgggcguaucagcacgcccugaacgagcugccugagagcuuggagacauuaaugcugguugcccugcucggagccaugaccgcgggcauauuccuguucuucaugcaaggcaaggggaucggcaagcugagcaugggacucaucaccaucgcggucgcaagugggcugcuguggguggccgagauccagccccaguggaucgccgcgagcaucauccucgaauucuuccugauggugcugcucauuccggagcccgagaagcagcgcacgccccaggacaaccaguugaucuacguaauucugaccauccucaccauuaucggccugaucgccgccaacgagaugggucugaucgaaaagacaaagaccgacuucggcuucuaccaggagaaaaccgagacgaccauccucgacguggaccugcggccugccuccgccuggacgcuguacgccguggccaccaccauccucaccccgaugcugcgacacacgaucgaaaacaccagcgccaacuugagucucgccgcuaucgcgaaccaggcagccguccugaugggacuggguaaaggcuggccccuccaccggauggaccucggugugccgcugcuagccaugggcugcuacucgcaagugaaccccacgacucugacugcgucucucgucaugcuccugguccacuacgcgaucauugggccggggcugcaggcaaaagccacccgcgaggcccagaagcggaccgcggccggaaucaugaagaaccccaccguagacgguaucacggucaucgaucuugagcccaucagcuaugaccccaaguucgagaagcaacugggccagguuaugcugcuugugcugugcgccgggcagcugcuccugaugcgcaccacuugggccuucugugagguccugacccucgcaaccggcccgaucuuaacccugugggaggggaaccccggccgguuuuggaauaccaccaucgcgguuuccacggccaauauauucaggggcagcuaccucgccggggccggccuggccuucucccugaucaagaacgcgcagacaccccggcgcgggaccggcaccaccggggagacguugggcgagaaguggaagcgucagcucaacagccuggaccgcaaggaguucgaagaguauaagcgguccggaauccucgagguggaucgcaccgaagccaagagcgcauugaaggacggguccaagaucaagcaugccgucagccggggcuccagcaaaauccgcuggaucguggagcgcgggauggugaagccuaagggaaaggucgucgaccuggggugcggucggggcgggugguccuacuacauggccacccucaagaaugugaccgaggucaaaggcuacaccaagggugguccggggcacgaggaacccauacccauggcgaccuacggcuggaaccuggugaagcugcacagcggagucgauguguucuacaagcccaccgagcagguggacacccuccuaugcgacauaggggagagcuccagcaacccaacgauagaggagggccgcaccuugcggguuuuaaagauggucgaaccguggcucagcagcaagcccgaguucugcauuaagguguugaaccccuacaugccgaccguuaucgaggaguuagagaagcuccagaggaagcacgguggcaaccugguccgcugcccccugucccgcaauucaacccacgagauguacuggguguccggggccagugggaacaucguaagcaguguaaauaccaccuccaagaugcuccuaaacagauuuaccacucgccaccggaagcccacguacgagaaggacguggaccugggcgccgggacgcgcagcgucuccacagagaccgagaagcccgacaugacgaucaucggccgacgcuuacagcgccuacaggaggagcauaaggagacuuggcacuacgaccaggaaaacccguaccgaaccugggccuaccauggguccuacgaggcgcccuccaccggcagcgccuccuccauggucaacggcguggucaagcugcucacgaaacccugggacgugaucccgaugguaacccagcuggccaugaccgacaccacgccauucgggcagcaacgaguguucaaggagaagguagacacccgcaccccccagccuaagccgggcacccggauggucaugaccaccaccgccaacuggcugugggcccuucuggggaagaagaaaaacccccgccuguguacccgggaggaguucauuuccaagguccgcagcaaugcggccaucggcgccguguuccaagaggagcaaggguggacgagcgccuccgaagcagucaacgacagccgguuuugggagcucgucgacaaggagcgcgcuuugcaccaggagggcaagugcgagucaugcguguacaacaugauggggaagagggagaagaaacugggagaguucggccgggccaaggguucacgcgccauuugguacauguggcucggcgcccgguuucuggaguuugaggcccugggguucuuaaacgaggaccacugguucgguagggagaacuccuggagcggcguggagggggagggccuucaucgguuaggguacauacucgaggagauagacaaaaaggacggcgaccucauguacgcggaugacacugccggcugggauacucgcaucaccgaagaugaucugcagaacgaggagcucaucaccgaacagauggcuccccaucacaagauccuugcuaaggcgaucuucaagcugacguaucagaacaaggucgugaagguccuccggcccaccccgcgcggggccgucauggacaucaucucccggaaggaccagcgaggcagcgggcaagugggcaccuacggcuugaacaccuucacgaacauggaggugcaacugauccggcagauggaggccgagggcgucaucacgcaggacgacaugcaaaaccccaaaggccuaaaggagcgcguggagaaguggcugcgggaaugcggugucgauagacugaagcggauggccauaagcggagacgacugugucgucaaaccccuggaugagcgcuucgguacgagccugcuguuccucaacgauaugggcaaaguacggaaggacaucccccaaugggagccgaguaagggguggaagaacuggcaagaaguccccuucugcucacaccacuuccacaagaucuucaugaaggacggccgcagucugguggugcccugccggaaccaagacgagcugauaggccgcgcccgcaucucccagggggcgggcuggucccuccgggagacugccugucuggguaaggccuacgcccagauguggagccuaauguacuuccaccgccgagacuugcgcuuggccaguauggcuaucugcagugccgugcccacggagugguucccuaccucgcggaccaccuggucuauacacgcccaccaccaguggaugacaacugaggacaugcugaagguguggaaucgcguguggaucgaggacaaccccaacaugaucgacaagacucccgugcauagcugggaggacauccccuaccucgguaagagggaagaccuguggugcggcuccuuaaucggucucagcucgcgcgccaccugggccaagaacauccacacggcgaucacccaggugcggaaccugaucgggaaagaggaguacguggacuacaugccgguaaugaagcgauacagcgcccccuccgagagcgagggggugcuguga

SEQ ID NO: 26274 - RNA, 9867 nt, Artificial Sequence
  derived and/or modified CDS sequence (opt11) from DENV-4__FJ882580__SS-prME
ucaaccaucaccuuacucugccugauccccacugugauggccuuucaccuguccacccgcgacggcgaaccgcuaaugaucgucgccaagcacgaacgggggcgcccccugcuguucaagaccaccgaaggcauaaauaagugcacgcucaucgcuauggaccuaggcgaaaugugugaagauaccgugacuuacaagugcccccugcucguuaacaccgagcccgaggacaucgacugcuggugcaaccugacgagcaccugggucauguacggcacgugcacccaguccggggagcggcgacgggagaagcgcagcguugcucugacuccgcauuccggcaugggucucgagacgagggccgagaccuggaugagcuccgagggcgccuggaagcaugcccagcgcguggagagcuggauccugcgaaaccccggguuugcucugcucgccggguucauggccuacaugaucggccagacggggauacagaggacgguuuucuucgugcugaugaugcuuguggcccccagcuacggcaugcggugugucggggugggcaaucgagacuucguggagggcgucucaggcggggcguggguggaucucgugcuggagcacggcgggugcguuacgaccauggcccagggcaagccgacguuggacuucgaacucaccaagaccaccgccaaggagguggcucuccugcggaccuacugcaucgaggcccucaucuccaacaucacgaccgcgacccgcugcccgacccagggggagcccuaccugaaggaggagcaggaucagcaauacaucugccggcgcgauguggucgaccggggcugggggaacggaugcggccuauucgggaagggcgggguggucacgugcgcgaaguucucuugcuccggcaagaucaccgggaaccuaguccaaaucgagaaccuggaguauaccguggucgucaccgugcauaacggcgauacgcacgccguaggaaacgacacgagcaaccacggggugacagcgaccauaacaccccgcucccccagcgucgaggucaaacuuccggacuauggcgagcucacccuggacugcgagccccggagugggauagauuucaacgagaugaucuuaaugaagaugaagaagaagacuuggcucgugcacaagcagugguuccuggacuugccccuccccuggaccaccggcgccgacacgagcgaagugcacuggaacuacaaggagcgcauggugaccuucaaggucccucaugcgaagaggcaggaugugacagugcuagggucccaggagggugccaugcacucagcccuggcaggcgcuaccgaaguggacagcggagacgggaaccauauguucgcgggucauuuaaagugcaaggugcgcauggagaagcugcgcaucaagggcauguccuauacgauguguagcggcaaguucuccaucgauaaggagauggccgaaacacagcacgggaccaccgucgugaaagugaaguacgaaggcgccggggcgcccugcaagguccccaucgagauacgggacgugaauaaggagcgcguggucggccgggugaucagcgccacgccccuggcggagaacaccaauuccguaaccaacaucgagcucgagccgccguucggggacagcuacaucgucaucggcgucgguaauuccgccuugacccugcacugguuccgcaaggggagcuccaucgguaagauguucgagagcacguacagaggggccaagcgcauggccauucucggcgagaccgcgugggacuucgggucggugggaggccuauuuaccagcuuggggaaggcaguccaccagguuuuuggaucgguguauaccacuauguucggaggggucagcuggaugauccggauccucaucggguuucuggugcuguggaucggcaccaauucccgcaacacuuccauggccaugaccugcauugcuguaggagggaucacacucuuccucggauuuacuguucaggccgauauggggugcguaguguccuggagcggccgcgaacugaagugcgggucgggaaucuucgucguggacaacgugcacaccuggaccgagcaguacaaguuccaacccgagagcccggcgcgacuggccagcgccauucugaacgcgcauaaggauggcguaugcggaaucaggucaacgacccgccuggaaaacgugauguggaagcagaucaccaacgaacugaauuacgugcuuugggagggcgggcaugaccugacaaucgucgcaggcgacgugaagggugugcugacgaaggggaagcgggcguugaccccgcccgcaagcgacuuaaaguacuccuggaaaaccuggggaaaggcgaagauauucacgccagaggcgcgaaacagcacguuccugaucgacgggcccgacacguccgagugcccgaacgagcgccgcgccuggaacuccuucgagguggaggacuacggcuucgggauguucaccacaaacauuuggaugaaauuucgggagggcuccagcgagguaugcgaccaccgccucauguccgcggcaaucaaagaccagaaagccgugcacgccgacaugggcuauuggauagagagcuccaagaaucagacguggcagaucgagcgcgcgagccuaauagaagucaagaccugccuguggcccaaaacacacacccucugguccaacggggugcuggagagccagaugcugaucccuaaguccuaugccggcccauuuagucagcacaauuaccgccagggauaugccacacagaccgugggccccuggcaccucgggaagcuagagauagacuuuggcgagugccccggcaccaccgucaccauacaggagaacugcgaccaccgcgggccaagccugcggacgaccacugccagugggaagcucguuacccaguggugcugucgcuccugcaccaugccgccccuccgguuucugggggaggacggcugcugguacgggauggagauacgaccucucuccgagaaagaggagaacauggugaagagucaggucaccgccggccaggggacgagcgagaccuucucuauggggcugcuaugccuaacgcuguucguggaggagugccugaggcgccgggucacacgcaagcacaugauccuagcuguagugaucacccugugugccaucauccugggcggucucaccuggauggauuuacugcgggcccuaaucauguuaggcgauacgaugucgggacgcaucggcggccagacucaccucgccaucauggccguauucaaaaugucucccggguaugugcuagggguuuuccugcggaaacugacaucgcgcgaaacugcgcucauggugaucggaauggccaugacuaccacuuugucaaucccgcacgaccugauggagcucaucgacggcaucucccugggccugauccuccugaagaucgucacccaguucgacaacacacagguggggacccuggcucucagccugaccuucauucgaucuaccaugagccuggugauggccuggcgcacgaucauggcaguacucuucguggucacccugauuccccugugccggaccuccugccuccagaaacaaagccacuggguugagaucacugcgcucauccugggcgcccaggcccuacccguguaccugaugaccuugaugaagggagccucccgccggagcuggccgcucaacgagggcauuauggcggucgggcugguuucacugcucggaucggcccugcugaaaaacgacgugccccucgcuggucccauggucgccgggggcuuguuacucgcggccuaugugaugagugguagcuccgcggaccugucccuugagaaggccgcaaacgugcagugggacgaaauggccgacaucaccgggagcucccccauaauagaggucaagcaagacgaggacgggucauucucuaucagggacguugaggagaccaacaugaucacuuugcuggugaagcuggccuuaaucacugugagcggccucuauccccuugcgaucccgauaaccaugacccucugguauauguggcaagugaaaacccagcgguccggcgcccugugggacguuccuagucccgccgccacccaaaaggcggcccugucggagggggucuaccguaucaugcagcggggccuuuucgggaagacgcaaguggggguggggauccacauggagggcgucuuccacaccauguggcacgugaccagggggagcguaaucugccacgagacugggcgccuggagcccuccugggcugacguccggaacgacaugaucagcuacggcggaggguggcgccucggcgacaagugggacaaggaggaggaugugcaagugcucgccaucgagccgggaaagaaccccaagcacguccaaacgaagcccggcuuauucaagacccugaccggggagauaggcgccgucaccuuagacuuuaagcccgggacauccggaucgccgaucaucaaccggaagggcaagguaaucgggcuguacggcaacggggucgugaccaaguccggggacuaugugucugcaaucacgcaggccgagcgcaucggggagcccgauuacgaggucgaugaggacaucuuccggaaaaagcgccuaaccaucauggacuugcaccccggcgccggcaagaccaaaagaauccuuccuuccauuguccgcgaagcacugaagcggcgccugcggaccuuaaucuuggcgcccacccgagugguagccgccgagauggaagaggcccugcgggggcuuccuauccgcuaccaaaccccugccguaaagagcgaacacacgggccgggagaucguggaucugaugugucacgcuaccuucaccacccgccuucuauccagcacgcgggucccuaacuacaauuugaucgugauggacgaagcccauuucaccgaccccagcuccguagcagcccgggguuacaucagcacccggguggagaugggggaggccgcggccaucuucaugacagccacuccacccggggcaaccgauccguucccccagucgaacagccccaucgaggacauugagcgcgagauccccgagcgcucauggaauaccggcuuugacuggaucaccgacuaccagggcaagacggugugguucgucccuagcaucaaggccgggaacgacaucgcgaacugucugagaaagagcggaaagaaggugauucagcucagucgcaagaccuuugacaccgaauaccccaagacuaagcugacggauugggauuucgucguaacgaccgauaucuccgagaugggggcgaauuuccgugccggccgcgugaucgacccccggcgcugccugaagcccgugauccucacagauggaccggagcgggucauccucgccggccccauaccugugacgcccgcgagcgccgcccagcgcagagggcgaaucgggcggaauccggcacaagaggacgaccaguacguguucucaggugauccccuuaagaacgacgaggaccaugcccacuggaccgaggcaaagaugcuccuggauaauaucuauaccccggaagggauuauaccgacccuguucggcccagagcgcgagaagacgcaggccaucgacggcgaguuccgccuccgcggggagcagcggaagaccuucguggaauuaaugcgccggggcgauuugcccgucugguugagcuacaagguagcaagugccggaaucagcuauaaagaccgcgaguggugcuucaccggcgagagaaacaaccagauacuggaggagaauauggagguugagaucuggacccgcgagggcgagaagaagaagcugcggccgaaguggcucgacgcgcgcguguacgcggacccgauggcucugaaggacuucaaagaguucgccucaggccgcaagucgauuacccuugauauccucacggagaucgcuucccugccgaccuaucugucgagccgggcuaaacuagcgcuggacaacauagugauguuacacaccacagagcgcggcgggcgggcuuaccaacaugcccucaacgagcugcccgagagccuggagacgcucaugcugguagcccuguugggagcgaugaccgccgggauauuucuguucuucaugcaaggcaaggggauaggcaaacuuucuaugggccucaucaccaucgccguggccuccgggcugcuguggguggccgagauccagccccaguggaucgcggccucgaucauccucgaguucuuccugauggugcugcugaucccggagcccgagaagcagcgcacaccccaagacaaccagcuuauuuacgugauccugacgauccucacaaucaucggacuuaucgcggccaaugagauggggcugaucgagaagaccaagacggacuuuggcuucuaucagguuaagacggagacgaccauccucgaugucgacuugcggcccgccuccgcguggacccuuuacgccguggccacgacaauacucaccccgaugcugcggcacacaaucgagaauacguccgcuaaccugucguuggccgcgauagccaaccaagcggccgugcugauggggcuaggcaagggcuggccccuccaccggauggacuuaggcgucccccugcucgccaugggcugcuauucacaggugaaccccaccacccugaccgcgucccuggucauguuacugguccauuacgccauuaucgggcccggccugcaagccaaggcuacgcgcgaggcccaaaagaggacagccgccggcauuaugaagaauccaaccguggacgguauuacagugauagaccucgagcccaucagcuacgaccccaaguuugagaagcaauugggccaggucauguuacuugugcucugugcuggacaacugcuccugaugcguacuacaugggccuuuugcgagguacugacccucgcuaccggcccgauccuuacccugugggaggggaaccccggcagguucuggaacacgaccauugccgucuccaccgccaacaucuuccgcggaagcuaucucgccggggccggccuggcguucuccuuaauaaagaacgcacagacgccccggcgcggaaccggcaccaccggagagacgcucggggagaaauggaagcggcagcugaacagccuugaccgcaaggaguucgaggaguacaagcgcuccggcauccuagagguagaccgaacggaagccaagagcgccuuaaaggacggguccaagaucaagcacgccgugagcagaggauccagcaagauccgauggauagucgagcgcggaauggugaagccuaagggcaagguggucgauuuggggugcggucguggugguugguccuacuacauggcgacgcucaagaaugugaccgaggugaaaggcuacaccaaagggggcccagggcacgaggagcccauccccauggcaacguacgguuggaaccuggucaaacuucacagcggcgucgauguguucuauaagccuaccgagcagguugacacccucuuaugcgacaucggggagagcuccucaaaucccacgauagaggagggccggacucuucgggugcucaagaugguggagcccuggcuguccagcaagcccgaguucugcauaaaggucuuaaaccccuacaugccaacugugaucgaggagcuagaaaaauuacagcgcaagcacgguggaaacuuagugcggugcccccucucccgcaacagcacccacgagauguacugggucuccggcgccucagguaacaucgugaguucaguuaacaccacguccaagaugcuccugaacagguucacgaccaggcaccgaaagcccaccuacgaaaaggacgucgaccugggcgccgggacgcgcagcguguccaccgaaaccgaaaagccugacaugaccaucauaggccggcgccuccagcgacuacaggaggagcacaaggaaacguggcauuacgaccaggagaauccguacaggaccugggcguaucaugggagcuacgaagcccccuccaccggcagcgccaguagcaugguaaauggcguagugaaacuguuaaccaaacccugggacguaaucccgaugguuacgcaacuggccaugaccgacaccacgcccuucgggcagcaacgaguguucaaggagaaggucgauacgcgcacaccccaacccaagcccggaacccgcauggucaugaccacgaccgccaauuggcuaugggcgcuccuagggaagaagaaaaauccccgcuuaugcacccgggaagaguucauuuccaaggugcgcuccaacgccgccaucggcgccguauuccaggaggagcagggguggaccagcgcuuccgaggcagugaacgacagccgguucugggagcucguugacaaggagcgcgcccugcaccaggaagguaagugugaguccugcgucuauaacaugaugggcaagcgugagaagaagcugggugaguucggccgggccaagggcagccgcgccaucugguauauguggcucggcgcccgguuccuggaguucgaggcguuaggguuccucaaugaggaccacugguucggccgcgagaacaguuggagcggcguggagggggaggggcugcauagacucggauauaucuuagaagagaucgacaagaaggacggugaccugauguacgccgacgacacggccggaugggacacacgcaucaccgaggaugaccugcagaacgaggagcucauuacugagcagauggcaccccaccacaagauccuggcgaaggccaucuucaaacugaccuaccagaauaagguggucaaggugcuccggcccacgccgcgcggggccgugauggacauaauaucccggaaggaccagcgcggcagcggacaggucgguaccuaugggcugaacaccuucaccaacauggaggugcagcugauacggcaaauggaggccgagggcgugaucacgcaagacgauaugcagaaucccaagggccucaaggagcgcgucgagaaguggcugcgggagugcgggguggauaggcuaaagcggauggcgaucucuggcgaugacugcgucgucaagccccucgaugaacgcuucgggaccagccugcuauuccucaacgauaugggcaaagugcggaaagacaucccgcagugggagccgagcaagggguggaagaacuggcaggaggugccauucugcagccaccacuuccacaagaucuucaugaaggacggacggucacuggucgugcccugcagaaaucaggacgagcugauuggcagggcgcgcauaagccagggggcuggcuggagccuaagagagaccgcgugccuggggaaggcuuacgcccaaauguggucgcugauguauuuccaccgccgggaccuccgccuggcguccauggcaauaugcagcgcugugcccacggagugguucccgacgagccguaccacuugguccauccaugcccaccaccaguggaugaccaccgaggauauguuaaaaguuuggaaccgcguuuggauagaggacaaccccaacaugaucgacaagacacccgugcacagcugggaggacauccccuaucuaggcaaacgggaggacuuauggugcggguccuuaauuggccucagcucucgcgccaccugggcuaagaacauucacaccgccauaacgcagguccggaacuuaaucggcaaagaggaguacguggacuacaugccggugaugaaacgguacagcgccccgucggaauccgaagggguucuguga

SEQ ID NO: 26275 - RNA, 9867 nt, Artificial Sequence
  derived and/or modified CDS sequence (opt11) from DENV-4__FJ882581__SS-prME
ucgaccauuacucuucuaugcuugauccccacggugauggccuuucaucucucgacccgagauggcgaaccgcucaugaucgucgccaagcacgaacggggccgcccacuccucuucaaaaccaccgagggcaucaacaagugcacgcucaucgcgauggaccugggggaaaugugcgaagacaccgucaccuacaagugcccccugcucguuaacacggagcccgaggacaucgauuguuggugcaaucugacgagcaccugggucauguacggaaccugcacccaguccggggagcggcgccgugagaagcggagcguggcccugacgccgcacucgggcaugggccucgagacccgggcggagaccuggaugagcagugagggggccuggaagcacgcucagaggguugagucuuggauccugcggaaccccggcuucgcgcugcucgccggguucauggcuuacaugaucggucagaccgggauacagcggacggucuucuucgugcugaugaugcugguggcccccuccuacggcaugcgcugcgucggcguggguaacagggacuucguggagggcgucagcgguggcgcguggguugaccucgugcuggagcauggcgggugcgucacuaccauggcccagggcaaacccacccuggacuuugagcucacgaagaccaccgcgaaggagguggcccugcugcggaccuacugcaucgaagcgcucaucuccaacaucacuaccgccacccgcugcccgacccagggggaacccuaucugaaagaggagcaggaccaacaguacaucugccgucgagauguggucgaccggggcugggggaacggcugcggccuguucgggaagggcgggguugugaccugcgcuaaguucuccugcuccggcaagaucaccgguaacuuaguccagaucgagaaccuggaguacaccgucgucguaaccgugcacaacggcgauacgcacgccgucggcaacgacacaagcaaccacggugugaccgcgaccaucacaccccggucccccuccguggaggucaagcugcccgacuacggcgagcucacccuggacugcgagccccggagugggaucgacuucaacgagaugauccugaugaaaaugaagaagaagacuuggcucgugcacaagcagugguuuuuggacuugccccucccuuggacaaccggcgcagacacuagcgaggugcacuggaacuacaaagaacggauggucaccuuuaaggugccgcacgcgaagcggcaggacgugaccgugcuggggagccaggagggcgcaaugcacagcgcccuggccggcgccaccgaaguggacaguggggacggcaaccauauguucgcggggcaucuuaagugcaagguucgcauggagaagcuccgcaucaagggcauguccuauacgaugugcagcggcaaguucuccaucgacaaggagauggccgagacccagcacgggaccacgguggugaaggucaaguacgagggcgcgggggcacccugcaaaguccccaucgagauacgggacgugaacaaggagaagguagucggccgcgugaucagcgccacgccccuggcggagaacaccaauuccgugaccaacaucgagcucgaaccgcccuucggugacaguuacaucgucaucggcgugggcaacucagcccugacccugcacugguuccggaaggggagcuccaucggcaagauguucgagagcacauacagaggggcgaagcggauggcaauccucggcgagaccgcgugggauuucgggaguguaggcggccuguucacuagccuggggaaggcaguucaccaaguguucggcagcgucuacacgacaauguuuggaggggucagcuggaugauacgcauccucaucggguuccuggugcuguggaucgggacaaacuccaggaauaccagcauggccaugaccugcauagccgugggcgggauaacgcuguuccucggcuucaccguccaggcagacaugggcugcgugguguccuggaauggccgcgagcucaagugcgggucuggcaucuuuguugucgacaacguccacacguggaccgagcaguacaaguuccagcccgagucccccgcucggcuggccagcgccaucuugaacgcccacaaggacgggguuugcgggauccguagcacgacccggcuggaaaacgugauguggaagcagaucacgaacgagcugaacuacguguugugggagggcgggcacgaccugaccgugguggccggcgacgugaagggcguccugacgaaggggaagcgggcucucaccccgccagccuccgaccugaaguacagcuggaagaccuggggcaaggccaagaucuucacccccgaggcccggaacuccaccuuccugaucgacgggccagacacgagcgagugcccgaaugagcggcgggccuggaacuccuucgaagucgaagacuacggguucgggauguucacuacaaacaucuggaugaaguuccgggaggggagcuccgaggugugcgaccaucggcucaugagcgccgccauaaaggaccagaaggccguccacgccgacaugggcuacuggauagaguccagcaagaaccagacguggcagaucgagagagcgucacugauagaggucaagaccugccuguggcccaagacccauacccucuggagcaacggggugcuggagucccagaugcugauacccaagagcuacgccggaccguucucacaacacaacuaccgucagggguacgcuacgcaaaccguuggccccuggcaccuaggaaagcuggagaucgacuucggcgagugcccuggaaccacagugacaauccaagagaauugcgaccaucgcgggccaagucugcgcacgaccaccgcguccggcaagcucgugacccaguggugcugccggucuugcacgaugccaccccugcgauucuugggugaggacggcugcugguaugggauggagauccgaccccucuccgagaaggaggaaaacauggucaaaagccaggugaccgccgggcaaggcaccuccgagaccuuuuccauggggcugcuuugccucacgcuguucguugaggagugucugcgccgucgcgugacgcgaaagcacaugauccucgcuguggucaucacccugugcgccaucauacuuggcggguuaaccuggauggaccugcugcgcgcucugauaaugcugggcgacacgaugagcggccggaucgggggccagacccaucuggccaucauggccgucuucaagaugucccccggguacgugcucggagucuuuuugcgcaagcugacuagccgggagaccgcgcucauggugaucgggauggcgaugacgaccacguuauccaucccgcacgacuugauggaguugaucgacggcaucagccuggggcugauccuccugaagaucgugacccaguucgacaauacgcaggucggcacccuggcccucagucugaccuucauacgcuccacaaugucgcuggugauggccuggcgcacgaucauggccgugcuguuuguugugacccugaucccccugugccgcacuagcugcuuacagaaacagucucacugggucgaaaucacggcgcugauccuaggcgcccaggcccucccggucuaccugaugacgcugaugaaaggagccagccggcgauccuggccccucaacgagggcaucauggcgguggggcuggugagccugcucggguccgcccugcucaaaaaugacgucccgcucgccggccccaugguggccgggggccugcugcucgccgcguacgugaugagcggguccagcgccgaccuaagccuggagaaggccgcgaacguccaaugggacgagauggccgacaucaccgguuccucuccuauaaucgaaguuaagcaggacgaagacggcuccuucagcauccgggacguggaggaaaccaacaugauuacauuacuggucaagcuggcgcucaucacgguguccggcuuauauccacuggccaucccgauaaccaugacucucugguauauguggcaagugaagacccagcgcagcggcgcccugugggacguuccaucccccgccgccacccagaaggcagcccuuagcgagggggucuaccggaucaugcagcgcggucuauucgggaagacacaggugggcgucgggauucacauggagggcguguuucacaccauguggcacgugacccggggcucggucaucugccacgagaccgggcgccuggagccaagcugggccgacgugcgcaacgacaugaucuccuacggcgggggcuggcggcugggagacaagugggacaaggaggaggacguucagguccuugccaucgagccggggaagaaccccaagcacguccagacgaagcccggccuguucaagacccugaccggugagaucggggccgugacacucgauuucaagcccgguacaagcggcucccccauaaucaaccgcaaggggaaggucaucgggcuguauggcaaugggguagugaccaagaguggugacuaugucuccgcgaucacccaggcggagcggaucggggaaccugacuacgagguagacgaggacaucuucagaaagaagcggcugaccaucauggaccuccaccccggcgccgggaagacgaaacgcauccugccgucaaucgugcgggaggcgcucaagcgccggcugcgcacccuuauccuggcucccacucgggucguggccgccgagauggaagaagcccugcgcggccuacccauccgguaccaaacccccgccgugaagucggagcauacuggccgcgagaucgucgacuugaugugucaugcuaccuucacaacccggcugcucagcuccacgcgcgugccuaacuacaaccucaucgugauggacgaagcccacuucaccgacccgagcagcgucgcagcccggggguacaucuccacccgaguggagaugggcgaggccgcggccauauucaugaccgcgacgccaccuggagccaccgacccuuucccacagagcaacucccccaucgaagacaucgaacgcgagauccccgagcgcagcuggaacaccggcuucgacuggauuacggacuaccagggcaagacagucugguucgugcccuccaucaaggccgggaacgacaucgcgaacugccugcgcaagagcggcaagaaggugauccagcucucacggaagacuuucgacaccgaguaccccaagaccaaacugacugacugggauuucgucgugacuaccgauaucagcgagaugggggccaacuuccgcgccggccgggugaucgacccccgacguugucucaagcccgucauacuuacggacgggccggagcgcgugauccuggccggccccauccccgucacacccgcgagugcggcccagcggcgcggccggaucggucgcaaccuggcccaggaggacgaccaguaugucuucucuggcgacccccucaagaaugacgaggaccacgcccacuggaccgaggcgaagaugcuauuggacaacaucuacacccccgaggggaucauccccacccucuuuggucccgagcgggaaaagacgcaggccauugacggggaguuccgccugcggggagagcagcgcaagacuuucguggaacugaugcggcgaggugauuugccgguguggcuguccuacaaggucgccagcgccgggauauccuacaaggaccgggaguggugcuucaccggcgagcgcaacaaccagauacuggaggagaacauggaaguggagaucuggacccgagagggggaaaagaagaaacuccgcccaaaguggcuggacgcacggguguacgccgacccgauggcccugaaggacuucaaggaguucgccagcgggcgcaaguccauuacccucgacauccugacggagaucgccagccugcccacauaccucucgagccgggccaagcuggcgcuggauaacaucgucaugcuccauaccaccgagcggggcggacgcgcauaccagcacgcccugaacgagcugccggaauccuuggagacgcugaugcugguggcccuccugggcgcgaugaccgccgggaucuuccuuuucuucaugcagggaaagggaauaggcaagcucagcaugggccugauaaccauugccguagcuagcgggcugcucuggguagccgagauccaaccacaguggauagcugccuccaucauccuggaguucuuccugauggugcugcugauaccugagccggagaagcagcggacaccccaggacaaccagcugaucuacgugauccucacgauccugaccaucaucggccugaucgccgcuaacgagaugggcuuaauagagaaaaccaaaaccgauuucggguucuaccagguuaagacggagaccaccauccuggacguggaccuaagaccagccagcgcuuggacccucuacgccguugccacgacuauccugacccccaugcugcggcacaccauugagaacacauccgcuaaccucagccuggccgcaaucgcaaaucaggccgcgguccucauggggcucgguaagggcuggccgcugcaccgcauggaccuagggguuccccuccuggccaugggcugcuauucccagguaaaccccaccacucuaaccgcgagccucgucaugcugcuuguucauuacgcuauaauagggccuggccuccaggccaaggcaacgcgggaggcgcagaagcgcaccgcagccggcaucaugaagaacccgaccguggaugggaucacgguaaucgaccuggagccgaucuccuacgaccccaaguuugagaagcaacugggacaggugaugcucuuggugcugugcgccgggcaacuccugcugaugcgcacgaccugggccuucugcgaaguccucacccuggcgaccggcccaauccugacacucugggaggggaacccgggccgcuucuggaacaccaccauagcggugaguaccgcuaacaucuuucggggguccuaccuggccggggccggucuggcauucagccucaucaagaacgcccagacgccccgccgggggaccgggacgaccggggagacccugggcgagaaguggaagcgccaacugaacucgcucgaccggaaggaguucgaggaguacaagcgcagcggcauacucgagguggaccguacggaggccaaguccgccuuaaaggaugggagcaagaucaagcacgccgucagcaggggcagcuccaagauccgguggaucguggagaggggcauggugaagcccaagggcaaggucguggaccucgggugcggacgcggcggguggagcuacuacauggcgacccugaagaacgugacugaggucaagggguacacaaaagggggccccgggcacgaggagcccauucccauggcaacguacggauggaacuuagucaagcugcacuccgguguagaugucuucuacaagcccaccgagcaaguugauacucugcugugcgacaucggugagucaagcucaaaucccaccaucgaggagggccggacgcuccgcgugcuuaagauggucgagccguggcugucuuccaagcccgaguucugcaucaaggugcugaaccccuauaugcccaccguuaucgaggagcuugagaagcuacagcggaagcacggcggcaaccucguccgcugcccgcucagccggaacucgacgcaugagauguacugggugagcggagccucugguaacauuguuucauccgucaacaccacgagcaagaugcugcuaaaccgcuucaccacccggcaccggaagcccaccuaugagaaggacguagaccucggcgccgggacccgguccgucaguaccgagacagagaagcccgacaugaccaucauaggccgccgccugcagcgccugcaggaggagcacaaggagacguggcacuacgaccaggagaaccccuaccggaccugggcguaccacggguccuacgaagccccgucgacaggauccgccaguucaauggugaacggaguggucaagcuccugaccaagcccugggacgugaucccuauggugacgcaacuggccaugacugauaccacgccauucggacagcaacguguuuucaaggagaagguggacacucggacaccccagcccaagccaggcacacgcauggugaugaccacuacagccaacuggcucugggcgcugcugggaaagaagaagaacccgcggcucugcaccagggaggaguucauaagcaaaguccgaaguaacgccgccauaggcgccguguuccaggaggaacagggguggaccagcgccagcgaggcggugaacgacuccagguucugggaguuggucgacaaggagcgggcccugcaccaggagggcaagugcgaauccugcguguacaacaugauggguaagcgagagaaaaagcucggggaguucggccgcgccaaagggagccgugccaucugguacaugugguugggagcccgcuuccuggaguucgaggcacuuggcuuucugaacgaggaucacugguucggccgggagaacagcuggagcggcguagagggggaaggccuccaccgccucggguacauccuggaggagauagacaagaaggacggcgaccugauguacgccgacgacacggccggcugggacacccggaucaccgaagacgacuugcagaacgaggagcugaucaccgagcagauggcuccccaccacaagaucuuggcgaaggccauuuucaaguugaccuaccagaauaaggucgugaaggugcugcgccccacgccccggggagccgucauggacaucauuagccgaaaggaccagcggggcuccgggcagguaggaaccuauggucucaauaccuucaccaacauggaagugcagcucauccggcagauggaggccgagggcgucaucacgcaagacgacaugcagaacccgaagggccugaaggagcggguggagaaguggcugcgcgagugcgggguggaccgguugaagcgcauggccaucagcggcgacgacugcgucgugaaaccccuggacgagcguuucgggaccucccuccuguuccugaacgacaugggcaaagugcgcaaggauaucccgcagugggagcccagcaagggauggaagaacuggcaggaggucccguucugcucccaucacuuccacaaaaucuucaugaaggacggccggagcuuaguggugcccuguaggaaccaggacgagcucaucggucgggcgcguaucucccagggggccggcuggagccugcgcgaaaccgccugccuggggaaggccuacgcccagauguggucccucauguacuuccaccgucgcgaccugcggcuggcaagcauggcgaucugcuccgccguccccaccgagugguuuccaacgagccgaaccaccuggagcauccacgcccaccaccaguggaugacuacggaggacaugcucaagguuuggaacagaguguggaucgaggacaauccgaauaugaucgacaagacgcccguccacuccugggaggacaucccauaccugggcaagcgcgaagaucuguggugcgggagccucaucggcuuauccucccgggccaccugggcgaagaacauccacacggccaucacucaggugagaaaccucaucggcaaagaagaguacguggacuacaugcccgucaugaagcgcuacuccgcuccgagcgaguccgagggggugcucuag

SEQ ID NO: 26276 - RNA, 9867 nt, Artificial Sequence
  derived and/or modified CDS sequence (opt11) from DENV-4__FJ882582__SS-prME
agcacuaucacccuucucugccuaauaccgacagucauggccuuccaucugagcacccgcgacggggagccgcucaugauugucgccaagcaugagcgggggcgcccucugcuguucaagaccacugagggcaucaacaaguguacuuuaaucgcgauggaccugggggagaugugcgaggacacagucacuuacaagugcccccugcucgugaauacugagcccgaggacauagacugcuggugcaaccugacgaguaccuggguuauguacgggaccuguacccaauccggggagcggcgccgggaaaagagaagcguggcccugacgccacacuccggcaugggccucgagacacgagcagagacauggaugagcuccgagggagccuggaaacacgcacagcggguggagagcuggauccugaggaaccccggauuugcgcugcuagccggauucauggccuauaugaucggacagaccgggauccagcgcacagucuucuuuguucugaugaugcugguggcccccaguuacgguaugagaugcgucgguguagggaaucgcgacuucguggagggcgucagcgggggagcguggguggaccucgugcuggaacauggcgggugugucaccaccauggcccaaggcaagcccacccuggacuucgagcuuacgaagaccacagcaaaggagguggcccuacugcggaccuauugcauugaggcccucaucucgaacaucacgaccgcuacccgcugcccgacccagggugagcccuaucugaaggaggagcaagaccagcaauacauuugccggcgcgauguaguugaccgaggcugggggaacggcugcggccuguucgggaagggcggggugguaacgugcgcaaaauucucgugcucuggcaagauuacggggaaccucguccagauugaaaauuuagaguacaccgugguugucacugugcacaacggcgacacccacgccgucggcaacgacacgagcaaccauggggugaccgccaccaucacgccccggucacccagcguggaagucaaacugccggauuauggcgagcucacccucgacugugagccaaggucuggaaucgacuucaacgagaugauccuuaugaagaugaagaagaagaccuggcucgugcacaagcagugguuucuggaccugccacuccccuggacaacgggcgccgacacgagcgaagugcacuggaauuacaaggagcgcauggucaccuucaaggugccgcacgcgaaacggcaagacguaaccguccuggggucccaggagggggccaugcacucagcccuggccggcgccaccgaagucgacagcggggacggcaaucacauguucgcuggucaucucaaaugcaagguacgcauggagaagcugcgcauuaaggggauguccuauacgaugugcagcggcaaguucucgaucgacaaggaaauggcugagacccagcacggaacuaccgucgugaaggugaaguacgagggggccggggcacccugcaaggucccgaucgaaauccgugacgugaauaaggaaaaggugguaggcaggguuaucagcgcuacgccccuggcggagaacaccaacuccgugaccaacaucgagcucgagccccccuucggcgacagcuacauugucaucgguguuggcaacucugccuugacgcugcacugguuucggaaggggucuuccaucggaaagauguucgagucgacguaucguggggccaagcggauggccauccucggcgaaaccgcgugggacuucgggagcguuggugggcuguuuacgagccugggaaaggccguccaucagguguuuggcuccguuuauacaacgauguucgggggcgucagcuggaugaucagaauccucaucggguuucuagugcuauggaucggcaccaacucccggaacaccagcauggccaugaccugcaucgccgugggggggauaacucuguuccucggauuuaccguccaggccgacauggggugcgugguguccuggaacggacgcgagcuaaagugugggagcgguaucuucgucguggauaacgugcacaccuggaccgagcaauacaaguuccaaccagagucuccggcacggcuggccucggccauccucaacgcccacaaggacggcgucugcgggaucaggagcacgacccggcuagagaacguuauguggaagcaaaucacaaacgaacugaacuacgugcucugggagggcgggcaugaccugacggucguggccggcgacgugaagggcguccucacgaaagggaagcgcgcccucacgccgcccgcauccgaccuuaaguacagcuggaagaccuggggcaaggccaagaucuucacucccgaggcacgaaacaguacguuccugaucgacgggcccgacacaagcgaaugcccgaacgagagacgggcuuggaauuccuucgagguagaggacuacggcuucgggauguucacuacaaauaucuggaugaaguuccgugaggguuccuccgaagugugcgaccaccggcugaugagcgcggccaucaaggaccagaaagccguucaugccgacaugggguauuggaucgaauccagcaagaaccaaacguggcagauagaacgcgcgucccugaucgaagugaagaccugucuguggcccaagacccacacccuguggucaaacggggugcucgagucccagaugcuuauccccaagucguaugccggcccauucucccagcacaacuaccggcagggguaugccacccaaacugucggccccuggcaccucgggaagcuggaaauugauuucggcgagugucccggcaccaccgugaccauucaggagaauugcgaccaucgcggucccucgcuacgcacgaccacggccucgggcaaauugguaacgcaguggugcugccggagcugcacuaugccgcccuuacgcuuccugggggaggauggcugcugguacgggauggagaucagaccccucagcgagaaggaggagaacaugguuaaaucucaggugaccgcggggcaggguaccagcgaaacauucucuauggggcuguugugucucacgcuuuuugucgaggaaugccugcggcgacgcguuacgagaaagcauaugauccuugcggugguuaucacccuuugcgccaucauccugggcgggcucaccuggauggaccugcugcgcgcccucaucaugcugggcgacacuaugucaggucggaucgggggccagacccaccuggccaucauggccguauucaagaugucaccaggguaugugcucggaguuuuccugaggaagcugaccagcagggaaacggcgcucauggugaucgggauggccaugacgaccacccuguccaucccccacgaccugauggagcucaucgacggcaucagccugggccugauucuccugaagauuguuacccaauucgacaacacgcaggucgggacccuggcccucucccugaccuuuauccgcaguaccaugucccugguuauggcauggcggaccaucauggccguacucuucguugugacccugaucccccuaugccgcaccagcugccuccaaaagcagucacauuggguggagaucacagcgcugauacucggcgcccaagcccuccccgucuaccuuaugacgcugaugaagggggccagucgccgcuccuggccacucaacgagggcauaauggcgguugggcugguuagccugcucggcuccgcccugcugaagaacgacgucccucucgcuggcccaaugguggccggcggucuccugcucgccgcuuacgucauguccgggucaagcgcugaccugagccuggagaaggcagccaacguccagugggacgagauggcagauaucaccgggucgagccccaucaucgaggugaagcaggaugaggacggguccuucucgauccgggacguggaggagaccaacaugaucacgcuccuggucaagcuggcauugauuacgguguccggcuuauacccccuggccauaccgauaacuaugacccucugguacauguggcaggugaagacacagcgcagcggugcccugugggacgucccaucccccgccgccacacaaaaggcggcccugucagaaggggucuaucggaucaugcagcgcggccucuucgggaagacgcaggugggugucgggauccacauggagggcguguuccauaccauguggcacguuacgcggggcuccguaaucugccacgaaacagggcggcuggagccuagcugggcugauguacgcaacgacaugaucagcuauggcggcggcuggcggcugggcgacaagugggacaaagaggaagacgugcagguccucgcuaucgagccggguaagaaccccaaacacgugcagacgaagccgggccuguucaagacccugaccggggagauaggcgccgugacccucgacuucaagcccgggacguccggcuccccaauuaucaaccgcaagggcaaggucauuggucuuuacggaaacggcgucgugaccaagucgggcgacuaugucuccgcgaucacccaagcggagaggaucggggaacccgacuacgagguggacgaagacaucuuccguaaaaagcgccugaccaucauggaccuccacccaggcgccgguaagacgaaaaggauccugccgagcauaguucgggaggcccugaagaggcggcugcgcacucuuaucuuagcgccgacccggguugucgcugccgagauggaggaggcucuacgcgggcucccaauccgguaccagacccccgccguuaaauccgaacacacgggccgcgagaucgucgaucugaugugccacgcgaccuucaccacccggcugcucucauccacccgcguaccgaauuacaaccuuaucgugauggacgaggcgcacuucacggacccgagcagcgucgccgcccggggguacauauccacccgaguggagaugggcgaggccgccgccaucuucaugaccgcuacgccccccggcgccaccgacccguuuccccagagcaacagccccaucgaggacaucgagcgggagaucccggagcgcagcuggaauaccggauuugacuggaucacugauuaccaggggaaaacggucugguucgucccuuccaucaaggcggggaaugacaucgcgaacugccugcgcaaaaguggcaagaagguuauccagcuaucaagaaaaaccuucgacaccgaguaucccaagaccaagcugacggacugggacuucguagucaccacggacaucuccgagaugggggcgaacuuccgcgcaggcaggguuaucgacccacgccggugcuuaaaacccgucauccucaccgacgggccggaacgcgugauccuggcaggccccauacccgucacgcccgcguccgccgcccaacggcgcggccggaucggucgcaaccuggcucaggaggacgaucaguacgucuucagcggcgacccgcucaagaacgaugaggaccacgcacacuggaccgaggcgaaaaugcugcuggacaauaucuacacucccgaggggaucauucccacccuuuucggcccagagcgggagaagacgcaggccaucgacggcgaguuccggcugcggggcgagcagcgcaagacauucguugagcugaugcggaggggcgaucucccgguauggcuguccuacaagguggcaagcgccgggaucuccuacaaggacagggaguggugcuucaccggugagcgcaacaaccagaucuuagaggagaacauggaaguagagauuuggacccgagagggggagaaaaagaagcuccgccccaaguggcuggaugcccggguguacgcagaucccauggcucugaaggacuuuaaggaguucgccagcggcaggaaguccauuacucucgacauccugacggagaucgccucuuuacccaccuaccucucaagccgcgccaagcuggcgcuggacaacaucgucaugcuacacaccaccgagcggggcgggcgcgccuaucagcacgcccucaacgagcugcccgagucccucgagacgcugaugcugguggcccuccugggcgcaaugacggccgggaucuuccuguucuucaugcagggcaagggaaucgggaagcucagcaugggucugaucaccaucgcaguggccagcgggcuuuuauggguggccgagauacagccccaauggaucgccgcgaguauaauccuugaguucuucuugauggugcuccugauccccgagccggaaaaacagcggaccccccaggacaaccagcugaucuacgugauccucacgauccugacuaucaucggauuaaucgcggccaaugagauggggcucaucgagaaaacgaagaccgacuucggcuucuaccagguaaagacagaaacgaccauccuugacguggaccugcgcccagcaagcgcguggacccuauaugcuguggcgacgacgauccugaccccaaugcugcggcacaccaucgaaaacacguccgcaaaccucagccuggccgcgauugccaaucaggccgccguccugaugggccucggcaaggguuggcccuuacaccgcauggaccugggggugccccuccuggccaugggcuguuacucacaggugaaccccaccacccuaacggcgagccucgucaugcuuuugguacauuacgcuaucaucggacccggacuccaggccaaggccaccagagaggcacagaagcgcaccgccgccggcaucaugaagaacccgaccguggacgggaucaccgucauugaccuggagcccauuucguacgaucccaaguucgaaaagcagcugggccaggucaugcuacugguccugugcgcggggcagcuccuguuaaugcggacgaccugggcauuuugugaagucuugacguuagcgaccggcccuauccugacauuaugggaggggaacccgggacgguuuuggaacaccaccaucgccgugagcaccgcaaacauuuuccggggcucuuaccuggccggggcaggucuggcguucagccucauuaaaaaugcccagacgccccgccggggaaccggcacgaccggggaaacccugggcgaaaaguggaaacgccaacugaacucccucgaccggaaggaguucgaggaauauaagcgcucaggcauccuggagguggaccggacagaggccaaguccgcccugaaggacgggagcaagaucaaacacgcaguaucccgcggaagcuccaagaucagguggauaguggagcgcgggauggucaagcccaaggggaagguaguggaccuugguuguggccgcggcggguggagcuacuacauggcuaccuuaaagaacgucacagaggugaagggcuacaccaaggggggccccgggcacgaggagccgauccccauggccacguacggguggaaccuggugaagcuccauuccgggguugaugucuucuacaagcccaccgagcagguggacacccuccugugcgacaucggggaaucaagcuccaaccccaccauugaggaaggccggacccucagaguuuugaagaugguagagccguggcugucauccaagcccgaauucugcaucaaggugcugaaccccuauaugcccaccgucauagaagagcucgagaagcugcagcggaagcacggaggcaaccugguucgcuguccgcucagccggaacuccacacacgagauguauugggugagcggcgccuccggaaacaucgucagcagcgugaacaccacgaguaagaugcugcugaaccguuucaccacccggcaucgcaaacccaccuacgagaaggacguggaccucggcgcuggaacucggagcgucaguaccgagaccgagaagcccgacaugaccaucaucggccgccggcugcagcggcugcaggaggagcauaaggagacuuggcacuacgaccaggagaaccccuaccggacgugggcguaccauggguccuaugaggccccgagcaccggcagugccaguucgauggugaaugggguugucaagcuccucaccaagccaugggacgugaucccaauggugacgcagcuggccaugaccgauaccaccccauucggucagcagcgcgucuucaaggagaagguggacacgcggaccccccagcccaagcccggcacgcgcaugguuaugaccacgacagccaacuggcucugggcuuuguuggggaagaagaagaacccgcggcucugcacccgcgaagaguuuaucagcaaaguccgguccaaugcagccaucggcgccguguuccaggaggagcaaggguggaccucggccagcgaggcggugaacgacucccgcuucugggaacuggucgacaaagagcgggcccugcaccaagagggcaagugcgaaucgugcguguacaacaugaugggcaagcgcgagaagaagcuuggggaguucggucgcgccaaggggucccgggccaucugguacauguggcugggcgcccgcuuccuggaguucgaggcauuaggguuccugaacgaggaccacugguucggucgggaaaacagcuggagcggcguggagggggaggggcugcaccgccucggguacauucuggaagagaucgauaagaaggacggcgaucugauguacgcugacgacacggcggggugggacacucggaucacugaagacgaccuccagaaugaagaguuaaucaccgagcagauggccccccaccacaagauccuagcgaaagccaucuucaagcucaccuaccagaacaaggugguaaaggugcugcggccuacgcccagaggcgccgucauggacaucaucucgcgcaaggaucaacggggcagcggucaggugggcacguacgggcugaacaccuucaccaacauggagguacagcucauccgacagauggaggcggagggaguuauaacgcaagacgacaugcaaaacccgaagggacugaaggagcguguggagaagugguugcgcgagugcgggguggacagacuaaagcgcauggccaucagcggugacgauugcgucgugaagccacuggacgaacgguuugggaccucccuacucuuccugaacgacaugggcaagguacgcaaggacaucccacagugggagcccagcaagggguggaagaacuggcaagaggucccguucugcucccaccauuuccacaagaucuucaugaaagacggccggagcuuaguugucccaugccgcaaccaagacgagcuaaucggccgggcgcgaauaucccaaggggccggauggagcuugcgugagacggccuguuuagggaaggcauacgcccagauguggucccucauguauuuccaccggcgcgaucuacggcucgccagcauggccauuugcuccgccgucccaaccgagugguuucccacgagcagaaccaccuggagcauccacgcccaccaccaauggaugacaacggaggauaugcucaagguuuggaaccggguguggaucgaggauaacccaaacaugauagacaagacccccgugcauuccugggaggacauccccuaccugggcaagcgcgaggaccuguggugcgggagccucauuggccuguccagccgagccaccugggcgaagaacauccacaccgccaucacccaggugcgcaaccucaucggcaaggaggaguaugcggacuacaugcccgugaugaagcgguacucagcccccagcgaguccgaggggguccucuga

SEQ ID NO: 26277 - RNA, 9867 nt, Artificial Sequence
  derived and/or modified CDS sequence (opt11) from DENV-4__FJ882584__SS-prME
ucgaccauuacccugcucugccuaauccccacggugauggccuuccaccugucaaccagagacggugagccgcugaugaucguagcuaagcaugagcgggggcgccccuuacuuuucaagaccaccgaagggaucaauaagugcacgcugaucgcgauggaccugggagagaugugcgaggauacagugaccuacaagugcccucuguuagugaacacagagcccgaggacauugacuguuggugcaaccugacgucuaccugggucauguaugguaccugcacccaguccggggagcggcgccgggagaagcgcagcguggcacugacgccccacagcggcaugggccuggaaacccgggccgaaacguggaugagcuccgaaggggccuggaagcacgcucaacguguggagaguuggauccuaagaaaccccggcuucgcgcugcuagccggguucauggccuauaugaucgggcagaccgggauccagagaaccguuuucuucguccugaugaugcugguggcucccaguuacggcaugcggugugucggcguagggaaccgcgacuucgucgaaggcgucucuggaggcgcguggguggaccucgucuuagagcacggcgguugcgugacuaccauggcacagggcaagcccacccuggacuucgaauugacuaagaccaccgccaaggagguggcccuguuacggacguacugcaucgaagcauccaucuccaacaucacgaccgcgacccgcugcccgacccagggggagcccuacuugaaagaggagcaggaccaacaguauaucugccggcgcgacgugguggaccggggaugggguaacggguguggccuguucgggaaaggcgggguaguaacgugcgccaaauucuccugcagcggcaaaaucaccgggaaccuggugcagaucgagaaccuagaauacaccguggugguaacugugcauaacggugacacacacgcagucggcaaugacaccuccaaccauggcguaacggccaccaucacgccaagaaguccgucaguggaggucaaacuuccggauuauggggagcugacccucgauugcgagccacguuccgggaucgacuuuaaugagaugauccuuaugaagaugaagaaaaagaccuggcugguucacaagcagugguuccuggaccugccccugcccuggacuacaggggcagauacguccgaggugcacuggaacuacaaagagcgcauggucaccuucaaggugccccaugcaaagcgucaagacgugacaguccucggcucacaagagggcgccaugcacucugcacuggccggcgccacggagguggacaguggcgacggcaaucacauguuugcggggcaccucaaaugcaagguacgcauggagaagcuccgcauuaaaggcaugagcuacacgauguguaguggaaaguucagcauagacaaggagauggcggaaacccagcaugggaccacgguugugaaggugaaguaugaaggggccggggcccccuguaagguccccauagagauacgagacgugaacaaggagaagguggucggccgcgugauuuccgccacaccuuuggccgaaaauaccaacagcguuacaaacaucgaacuagagcccccuuucggggacagcuacaucgugauuggggugggcaacagcgcccuuacccugcauugguuucggaaggguucgagcaucgggaagauguucgaguccacguacagaggggccaaacguauggccauccugggcgagaccgcgugggauuucgguucaguaggcggucucuucaccucccucgggaaggccgugcaccagguguucggcucgguuuauacgacaauguucggggggguauccuggaugauacgcauccugaucggguuccucgugcuguggaucggcaccaauagccgcaacacuuccauggcgaugacuugcaucgcugucggcggcaucacgcuguuucugggauucaccguucaggcagauaugggcugcguugugucuuggucaggacgagagcucaagugcgggaguggaauauucgucguggauaacguucacaccuggaccgagcaguacaaguuccaacccgaaucucccgcccggcuagcauccgccauccugaacgcccacaaggacggugucugugggauccgaucgacaacccggcucgaaaacgugauguggaagcagaucaccaacgagcugaacuauguucugugggaagggggucacgacuuaaccguggucgccggcgacgucaagggaguccugacuaaaggcaagcgcgcgcugacaccgccugcguccgaccucaaguauaguuggaaaaccuggggcaaagccaagaucuucacccccgaggcucguaacuccacauucuuaauagacgggcccgacaccagcgagugcccgaacgagcggcgggcuuggaacaguuucgaaguggaggacuauggguucgguauguucacuacaaacaucuggaugaaguuccgcgaaggcagcuccgagguaugcgaccacagacugaugucugcggccauaaaggaccaaaaggcuguucaugccgauaugggguacuggaucgaauccagcaagaaucagaccuggcagauugagcgugcgucauugaucgaggugaaaaccugucuguggcccaagacccacacccuguggagcaacggcguacucgagucccagaugcuuauccccaagagcuacgcuggcccauucucccaacauaauuaucggcagggauacgcaacccagacggucggcccuuggcaccuggggaaacuugagauagauuucggagagugcccgggcaccaccgugaccauccaggagaacugcgaucacagagggcccagccugcgaacaacuaccgcauccggcaaauuggugacccaguggugcugccgauccugcacgaugccuccccucagauucuugggggaggacggcugcugguaugggauggagauccguccucuauccgagaaggaagaaaauauggucaagucccaggucaccgccggccagggcaccagcgagacuuucagcauggggcuccucugccugacucucuuugucgaggagugccugcgcagacgcgugacccggaagcauaugauccuggcgguggucaucacccucugcgccauaauccuuggcggccugacguggauggaccucuuacgggcccugauaaugcucggugacacaaugagcggccgcaucgguggccagacccaccuggcgaucauggcuguauucaagaugagucccggguacguguuaggcguuuuucuucgcaaacugaccucccgcgagaccgccuuaauggucauagggauggccaugacgaccacucugucuauaccgcacgaccugauggagcugaucgauggcauuagccucggucugauccugcucaagaucgugacucaguuugacaacacgcaggucgggacucucgcgcugucccucaccuucauccgcagcaccaugucccuggugauggccuggcggacgaucauggcagugcuguucgucgugacccucaucccccugugccggaccagcugccugcagaaacagagccauuggguagagauuaccgcgcucaucuuaggcgcccaggccuuaccugucuacuuaaugacgcuaaugaaaggggcuucccggcguuccuggccccugaacgagggcaucauggcggugggccucgugucacuucucggcucagcucuccugaagaaugaugucccgcuugcaggcccgaugguggccgggggccugcugcuggcagcguacguaauguccgggaguagugcagaccucucgcuagaaaaggccgccaauguccagugggacgagauggcugacaucacugguuccucccccauaauugaagugaagcaggacgaggauggguccuucucgauccgggacgucgaggaaacaaacaugaucacacuucucguaaaacuggcgcuaaucacaguguccggccucuacccccuugcgauccccaucaccaugacccugugguacauguggcaaguaaagacacagcgcagcggugcccucugggacguccccucuccagcagccacacagaaggcggccuuaagcgaggggguguacaggauuaugcaacgcggacuauucgguaagacgcaagugggcguggggauacacauggagggcguguuccacaccauguggcacgugacccgggguuccgucaucugccacgagaccgggcgacuagagcccuccugggcggaugugagaaaugacaugaucucuuacggcgggggcuggagacugggagacaaaugggacaaggaggaggacgugcagguccuggcgaucgagccggggaagaaccccaaacacguucagacgaaaccgggccuguucaagacgcuuacgggggagaucggugcugugaccuuggacuucaagcccgggacuucgggguccccgauaaucaaccgcaaaggcaaaguaaucggacucuauggcaacgggguugugacaaaaagcggugacuacgucuccgcgaucacccaggcagagcggaucggggagcccgacuaugagguggacgaggacaucuucaggaagaagagguuaaccauaauggaucuucaccccggcgccggaaagacgaagcgaauccucccaucaaucguccgggaggccuugaaacgccgccugcguacccugauccucgcgcccacacgggucguagccgccgagauggaagaggcccugagaggguuaccaauccgguaccagacucccgccgugaaguccgagcacacgggacgcgagaucguugaccucaugugucacgcgaccuucacgacccggcugcuuagcucuacgcgcgugccgaacuauaaccuuaucgucauggacgaagcccacuucaccgaccccucuaguguagccgccagggguuacaucuccacgcgaguggagaugggcgaggccgcugccaucuucaugacggccacuccgccuggggccaccgacccauucccucagagcaauucccccaucgaggacaucgaacgugagauuccagagcgcagcuggaauaccggguucgacuggaucaccgacuaucagggcaaaacggucugguucgugccguccauaaaggcugggaacgacaucgccaacugccugcgcaagagcggcaaaaaggucauacagcuaucacguaaaaccuucgacaccgaguaccccaagaccaaacucacggacugggacuuugucguaaccaccgacaucagcgagaugggagcuaacuucagagcagggagagugauugacccccgaagaugucugaagcccgucauccuaacagacggaccggagcgcgugauccucgccggucccaucccggugacgcccgcgucagccgcgcagcgucguggccggaucgggcgcaacccagcacaagaggaugaccaauacgucuucagcggcgacccccugaagaacgaugaggaccacgcacacuggacagaggcuaagaugcuacucgacaauaucuauacuccggagggcauuauuccgacccuguuuggcccggagcgcgagaaaacgcaagcaauugacggcgaguuccggcugcggggggagcagcgcaagaccuuuguggaguuaaugcggcguggagaccugcccguguggcugucguauaagguugcaagcgccgggauuuccuacaaggaucgggaaugguguuucaccggugaacguaacaaccagauccuagaagagaauauggaggucgagaucuggaccagggagggugagaaaaagaaacugcgccccaaguggcucgacgccaggguguacgcggaccccauggcgcucaaggauuucaaagaguuugcuagcggccgcaaguccauuacucucgacauccugaccgagauagcuuccuugccgacguaccuguccagccgcgcaaaauuggcgcuagacaauaucguaaugcuacacaccaccgaacggggggggcgcgccuaccagcacgcucugaacgagcuccccgagagccuggaaacucugaugcucguggcucugcugggugcgaugaccgccgggaucuuccuauucuucaugcagggcaaaggcaucggcaagcugucuaugggccugaucacuaucgcgguggccagugggcuccugugggucgcugagauucagccccaguggaucgcggccuccauaauccuggaguucuuccucauggugcugcugaucccugagccugaaaagcagcggaccccucaggacaaucagcuuaucuacgugauccugacuauccuaaccaucauaggccuuaucgccgccaacgagaugggucugaucgagaagaccaagaccgacuucggcuucuaucaaguuaagacggaaaccacaauuuuagacguagaccuccgcccggcaagcgcguggacacuuuacgccguagcaaccaccauccugacaccaauguugcgucacaccaucgagaacacuuccgcaaaccugagcuuggccgcgauagccaaccaggccgccguccuuauggggcugggcaaaggauggccgcugcaccgcauggaucucggcgugccacuucuggccauggguugcuauucgcaggucaaccccaccacccucacugcgagcuuagucaugcuccucgugcacuacgcgauaaucgggcccggccuccaggccaaggccacgcgagaggcccagaaacgcaccgcugccggcaucaugaaaaaccccacgguggacggcaucaccguuaucgaccuagagccuaucuccuacgacccaaaguuugaaaaacagcucggccaagugaugcugcugguucucugugccggacagcuacuacucaugagaacgacaugggccuuuugcgagguccugacucuggcuacgggcccaauucucacucugugggagggaaacccagguagguucuggaacaccaccauugccgugucaacagccaacauuuuccggggguccuaccuggcaggggccggccucgcguucagccuaauaaagaacgcccaaacgccccgucgggggaccgggaccacaggggagacccuaggcgagaaguggaagcgccagcucaauuccuuagaccguaaagaauucgaagaauacaagcgcagcggcauacuggaggucgaccggacggaggccaagucugcccuuaaggaugggaguaaaaucaagcacgccguaucacgcggcagcuccaagauccgguggauaguugagcgcgggauggugaaacccaagggcaaggucguggaccuggggugcggcagaggcggauggagcuacuacauggcuacccuaaagaaugugaccgaggucaagggcuacaccaaggggggcccggggcaugaggagcccauacccauggcgacguacgguuggaaucucgugaaguuacauagcggcguagacgucuuuuacaaacccacagagcagguggauaccuugcuuugugacaucggggagucgagcucgaacccgaccaucgaggaaggucgcacgcuacgcguacugaaaauggucgagccguggcucagcuccaaaccagaauuuugcauuaagguccugaaccccuacaugcccaccgugaucgaagagcuggagaagcugcaacggaagcacgggggcaaccucguccgcugcccccugagccgcaacucuacacaugagauguacugggugagcggugcauccgggaauaucgucagcuccgucaacaccacgagcaagauguugcucaaucgcuucacuacccggcaccguaaacccaccuaugagaaagacguggaccugggcgccgggacgcgguccgucagcaccgaaaccgaaaagcccgacaugaccaucaucggccgccggcuccaacgcuugcaggaggagcacaaggagacguggcauuacgaccaggagaauccguaccggaccugggcauaccacgggucauaugaggcccccuccaccgguuccgccaguuccauggugaacggcguggucaagcugcugacuaaacccugggacgucaucccgauggucacgcagcucgcaaugaccgacacgacacccuuugggcagcaacgcgucuuuaaggaaaaaguggauacgagaaccccccagccgaagccgggcacgcgcauggugaugaccacgaccgccaacuggcugugggcguuacucgggaaaaaaaaaaacccccggcugugcacccgcgaggaauucauuucgaagguccggagcaaugccgcuauaggcgccguguuccaggaggagcagggcuggaccucagcaagcgaggcgguuaacgacucgcgcuucugggagcucgucgacaaggaacgggcccuacaccaggaaggcaagugcgagagcugcguguacaacaugauggguaaaagggagaaaaagcugggagaguuugggcgcgcgaaggggucgcgggcgaucugguacaugugguugggcgcgcgcuucuuggaauucgaggcgcuaggguuccugaacgaggaccacugguucggucgagagaacaguuggucaggcguugaaggggaggggcugcaccgccugggguauauucucgaggaaaucgacaagaaagacggggaccucauguacgccgacgacaccgccgggugggacacucggaucaccgaggacgaccuacagaacgaggagcugauuaccgaacaaauggccccccaccacaagauccucgcuaaggccaucuucaaguugaccuaccagaauaagguggugaagguccugcggcccacgccgcggggcgccgucauggauaucauuagccgaaaagaccagcggggcuccggccaggugggcacguauggguugaauacuuucacaaacauggaggugcagcucauccgccagauggaggcagaaggugucaucacucaggacgacaugcagaaccccaaaggcuuaaaggagagaguugaaaaguggcuccgcgagugcggggucgacaggcugaagcgcauggccaucucaggcgacgacuguguaguuaagccacuagaugaacgguucggcaccucacuucuguuccugaacgacaugggcaagguccgcaaggacauaccacaaugggagccaagcaaaggguggaagaacuggcaggagguccccuucuguagccaccauuuccauaagaucuucaugaaagacggccggucacucguugugccuugccgaaaucaggacgagcucauuggccgggcgcgcaucucccaaggagcaggcuggucccugagagagaccgccugccuggggaaggccuaugcgcaaauguggucccuaauguacuuccaccgucgcgaucuacgucucgccagcauggcuaucugcagcgccguccccacugagugguucccaacaucacgcacaaccuggagcauccaugcccaccaccaauggaugaccacggaggacauguuaaaaguguggaacaggguguggaucgaggauaaucccaauaugaucgacaagaccccuguccacuccugggaagauauaccauaccugggcaagcgugaggaccuauggugcgggucacuuaucggccugagcagccgugcgacaugggcgaaaaauauccacacugccaucacucaggugcgcaaccucaucggcaaagaggaguacguggacuacaugcccguuaugaagcgguacagcgcgcccagcgaguccgaagggguucucuag

SEQ ID NO: 26278 - RNA, 9867 nt, Artificial Sequence
  derived and/or modified CDS sequence (opt11) from DENV-4__FJ882585__SS-prME
ucuaccaucacgcuccucugccuuauccccacugugauggcauuccaccugucgacgcgcgacggcgagccucucaugauagucgcuaagcacgagcgcgggcgcccgcugcuguuuaaaacaacggagggaaucaacaagugcacccucaucgcgauggaccugggggagaugugugaggacaccgucaccuacaaguguccgcugcuagugaauacugagcccgaggacaucgacugcuggugcaaccugacgagcacuuggguaauguacggaaccugcacacagaguggggagcggcgucgggagaagcgcaguguggcccuuacgccacacucugguaugggauuagaaacccgggccgagacguggaugagcuccgagggggccuggaaacacgcgcagcgcguugagagcuggaucuugcggaaccccggcuucgcgcugcucgcuggauucauggccuacaugaucggccagaccgggauccagcggacgguuuucuucgugcucaugaugcugguggcuccguccuacggcaugcgaugcgucggcguggggaacagggacuucguggaaggcgucagcgggggcgcguggguggaccucgugcuggagcacggcgguugugugaccaccauggcccaaggcaagcccacccuggacuucgaacucacgaaaaccacugcaaaggagguggcauuguugcgaacuuauugcaucgaggccuugaucuccaacauuacgaccgccacccgcugccccacccagggggagccauaccugaaagaagaacaggaccagcaguacaucugccgccgggacguggucgaccgggguugggggaacggcuguggucuuuucgggaagggcggcguggugacgugcgccaaguucagcugcuccggaaagaucaccgggaaccucguacagaucgagaaccuggaguacaccgugguggucacagugcauaacggcgacacgcacgccguaggaaacgacaccagcaaccacggggugacagcaaccaucacccccagguccccgagcguggaagucaaguugccggacuacggcgagcucacccuggacugugagccacgguccggcaucgacuucaacgagaugauccugaugaagaugaaaaagaaaaccuggcucgugcacaagcagugguuccuggaccugccccuccccuggacuaccggggcagacacgagcgaagugcacuggaacuacaaggaacgcaugguuaccuucaaggugccgcacgcgaagcggcaggacgucacuguacugggaucccaggagggcgcuaugcacagcgcccuggccggcgcuacagagguggacagcggggacggcaaucacauguucgcggggcaccucaagugcaaggucaggauggagaagcugcgaaucaagggaauguccuacacgaugugcagcggcaaguucuccaucgacaaggagauggccgagacucagcaugggaccacugucgugaaggugaaguacgagggcgcuggggcacccuguaagguccccaucgagauccgugacgucaauaaggagaagguaguaggccgcguuaucagcgcgacuccgcuggcggagaacacaaacuccgugaccaacauugagcuggagccacccuuuggggauagcuauauuguaaucgggguggguaacuccgcacugacccugcacugguuccggaaggggaguuccaucggcaaaauguucgagucgacguaccgcggggccaaacggauggccauauugggcgagaccgcuugggacuuugggagcgugggugggcuguuuaccucccucgguaaggccguccaccaaguguuuggcucggucuacacaaccauguucgggggcgucagcuggaugauccggauccucaucggguuucugguguuauggauugguaccaacucacggaacacgucaauggccaugaccugcauugcagugggcggcaucacgcuguuucucggguuuaccguccaggcggacauggggugcgugguguccuggagcggccgcgaacugaaaugcggguccggcaucuucgucguggauaaugugcacaccuggaccgaacaguacaaauuucaacccgagucucccgcccggcuggccagcgccauccucaacgcccacaaagacggagucugcgggauccgcucaacaacccggcuggagaacgugauguggaagcaaauuacaaacgaguuaaauuaugugcucugggaggguggucacgaucugacuguaguggccggagacgugaagggcguccugacgaaggggaagcgugcgcuuacaccgccugccucugacuuaaaguacucauggaagaccuggggcaaggccaagauuuucaccccggaggcccggaacagcacguuccuuauugacgggcccgacacgucagagugcccgaacgagcggagagcauggaacagcuucgaaguugaagacuacggcuuugggauguucacaacaaacauauggaugaaauuccgugaagguuccagcgaggugugcgaccaucggcucauguccgcggccauaaaggaccagaaggccguccacgccgacaugggguacuggauagagagcuccaagaaccagacauggcaaaucgagcgugcgagccugaucgaggucaagaccugccuguggcccaagacgcacacgcucugguccaacggggugcuggagagccagaugcuuauccccaagucauaugccggcccguucagccagcauaacuaucggcaaggguacgccacccagacaguaggucccuggcaccucgggaaacuggagaucgauuucggcgaaugccccgguaccaccguuaccauccaggaaaacugcgaccaccgggggcccucccugaggacuaccacugccagcgggaagcuagucacccaguggugcugccggagcugcacgaugccgccucugcgcuuccugggggaggacggcugcugguaugggauggagauccggccucucuccgagaaggaggagaacauggucaagagucaggucacggccggccagggcaccuccgagaccuucagcaugggccugcugugccucacccuuuuuguugaggagugccugcgccggcgcgugacccgcaagcacaugauccucgcgguagucaucacccucugcgcaaccauccugggcggucucaccuggauggaucugcugcgcgcccuaaucaugcugggcgacaccauguccggccggaucgggggccagacccaucuggccaucauggccguguucaagaugagucccggguacguucucggagucuuccugcgcaaacuuaccucccgggagacggcgcucauggugaucggcauggccaugaccacgacucucagcaucccgcacgaucugauggaguuaaucgauggcauuagccuaggucucauccuccugaagaucgugacgcaauuugauaacacccaggucggcacccuggcccucagccugaccuucauccgcuccacgaugucacugguaauggcauggcggacaaucauggccguguuauucgucguuacacugauaccccugugccguaccucaugucuccagaagcagagccauuggguggaaaucacggcucuuauccugggcgcacaagcccuaccaguuuaccugaugacccugaugaagggggccuccagacgcuccuggccacucaacgaggguaucauggcgguagggcuagucucacuguuaggcagcgcccuacugaagaacgacgugccacucgccggccccaugguggccgggggccugcuucucgcggcuuauguaauguccggcagcuccgccgaccugucccuggagaaggccgccaacgugcagugggacgagauggccgcgaucaccggcucauccccaaucaucgaagugaaacaggaugaggauggguccuucagcauccgagacgucgaggaaaccaacaugaucacccucuuagucaagcuggcgcucaucaccgugagcggccuguauccccuagccaucccgauaacaaugacuuugugguacauguggcagguuaagacccagagauccggugcgcugugggaugucccuucccccgccgcuacgcaaaaggcagcccuguccgaggggguauaucggaucaugcagcgcgguuuauucggaaagacccaagugggcgucgggauucacauggagggcguguuccauaccauguggcacgugacgcggggcagcgucaucugucacgaaacggggagacucgagcccagcugggcggacguucgcaacgauaugaucuccuacggcgggggauggcggcucggggacaagugggauaaagaagaggacgugcagguccucgccaucgagccggggaagaacccuaagcacgugcagacaaagcccggacuguucaagacgcugaccggggagaucggcgcaguaacgcucgauuucaagccgggcaccucaggaagccccaucaucaaccgcaaggguaagguaaucggacuguauggcaacgggguagugaccaaguccggcgacuacgugagcgcaaucacucaggcggagcggauaggagagcccgacuacgagguggaugaggacaucuucaggaagaaaagacugacgaucauggaccuccaccccggugccggcaagacuaaacgcaucuuaccguccaucgugagagaagcgcugaagcgccgccugaggacccucauccuggcgcccacccggguaguggccgccgaaauggaggaggcccugcgcgggcuccccauacgguaucagacgcccgcggugaaaagugagcacaccggccgggagaucguugacuugaugugucacgcgaccuucaccacgcggcugcuuaguucgaccagaguuccuaacuacaaccugaucguuauggacgaggcccacuucaccgaccccucuuccguugccgcgcguggguacaucagcacccgcguggagaugggcgaggcagccgccaucuucaugacugccaccccucccggggccaccgacccauucccccaguccaacagcccaaucgaggauaucgagcgggaaaucccagaacgcuccuggaacaccggauucgauuggaucacggacuaccaaggcaagaccguuugguucgugccgagcaucaaggccgggaacgacaucgccaacugccuccgcaaguccggcaagaaggucauucagcucucgcggaagaccuucgacaccgaauaccccaagacgaaacucacagauugggacuucguagugaccaccgacauuuccgagaugggagccaacuuccgggccggccgggugaucgacccccgacguugccugaagccugucauccucacggaugggccggaacgcgugauccuggcagggcccauucccgugacccccgccucagcggcccagcgccgcggccggaucgggcgcaacccggcccaagaggaugaccaguacgucuucucaggagacccccugaagaaugacgaggaccacgcucacuggacggaggccaagaugcuccuggacaacaucuacacgccggaggggaucaucccaacgcuguucggaccagagcgggagaagacccaggccaucgacggcgaguuccggcucagaggggaacaaaggaaaaccuucguugaacugaugcggcgcggcgaccuccccguguggcuuuccuacaaggucgcguccgccgggauaucauacaaggacagagaauggugcuucaccggggagcgcaacaaccagauacuugaggagaacauggagguggagaucuggacacgggagggggagaagaaaaagcugcgccccaaguggcuugacgcacggguguaugccgaccccauggccuuaaaggacuucaaggaguucgccuccggccgcaagaguacaaccuuagacauccucaccgaaauugccucccuuccgaccuaccugagcucccgagcgaaacucgcgcuggacaacaucgucaugcugcacacgaccgaacggggagggcgagcguaccagcaugcucucaacgagcugccugagagccuggagacccuuaugcugguggcucugcucggcgccaugaccgccgggaucuucuuguuuuucaugcagggaaaggggaucggcaagcugagcaugggacugaucacgaucgcuguggccuccggccuuuuaugggucgcggagauccagccccaguggaucgcagccaguaucauacucgaguucuuccugauggugcugcucaucccggaaccagagaaacaacgcacuccccaggauaaucaacuuaucuacguaauacuuaccaucuuaacgauuaucggccuaaucgccgccaacgagaugggacugaucgagaaaaccaagacugacuucggauucuaccaggucaagaccgaaaccacgauccuggauguggaccugcgccccgcaucggcauggacccuguacgcgguggccacuacaauccuaacgccgaugcugcggcauacuaucgagaacaccagcgccaaccugucacucgcggcuaucgccaaccaggccgccguccugauggggcugggcaagggguggccccuccaccgcauggaccugggggugccccugcuugcgaugggcuguuacagucagguuaaccccaccacgcugaccgccucccucgucaugcuccucgugcauuacgcuauuaucgggccggggcuacaggccaaggcaacccgggaggcccagaagcgcaccgcagccggcauuaugaaaaaccccacuguugacgggaucaccguuauugaucucgagcccauuagcuacgaccccaaguuugagaagcaacugggccaggugaugcuucucgugcugugcgcagggcaguugcuccuaaugcggaccaccugggcguuuugcgagguccugacccuggccaccggcccuauucugacacuaugggaggggaaccccggacgcuucuggaacaccacaaucgcugugucuaccgccaauaucuucagggguucguaucuggcuggggcgggccuggcauucucacugaucaagaacgcccagaccccacgccgggggaccggcaccacgggggaaacccucggugagaaguggaagcgccagcuuaacucauuagaccggaaggaguucgaggaguacaagcgcuccggcauccucgagguggauagaacugaagccaaguccgcccugaaggacggguccaagaucaagcacgcgguaagccgcggcagcagcaagauccgguggaucguggaacgcgggauggugaagcccaagggcaagguaguggaccugggcugcggacgcggcggguggucauauuacauggccacccugaagaacguuacggaggucaagggcuacacaaaagggggcccggggcacgaagaacccaucccuauggcaaccuauggcuggaacuuaguaaagcugcacucuggcguggacgucuucuacaagccuaccgaacagguggacacgcugcugugcgacaucggggagagcagcucgaacccgaccaucgaggaggggcgaacgcugagaguacugaagauggucgagcccuggcugaguuccaaaccagaguucugcaucaaggugcuaaacccguacaugccgaccgugaucgaggagcuugagaagcuccagcggaagcaugggggcaaccucguccguugcccacugucgcgaaauagcacgcacgagauguacugggugucuggagcaucugggaauaucgucaguucaguuaauacgaccucuaagaugcuguugaaccgcuucaccacccggcaccguaagccgaccuacgagaaggacguagaccugggcgcggggacgcgcucaguuuccaccgagaccgagaagcccgauaugacaaucaucggacgcagacuccaacgucugcaggaggagcacaaggaaacauggcacuacgaccaggaaaacccuuaccguacgugggccuaucacgggucauacgaagcccccuccacggggucggccucuucuaugguuaacggcgugguuaagcugcucaccaagcccugggacgugauaccuaugguuacucagcuggccaugacagacacgacccccuuugggcagcagagggucuucaaggaaaagguggacacccggacaccccaacccaagccgggcacgcgaauggucaugaccaccaccgcuaacuggcugugggcacugcuuggcaaaaagaaaaacccccggcugugcacgaaggaggaguucaucuccaaaguccgcucuaacgccgccauaggggcuguguuccaggaggaacagggguggaccagcgcauccgaagccguaaacgacagccguuucugggagcucguugacaaggagcgcgcccugcaccaggaaggcaagugcgaguccugcguguauaauaugaugggaaagagagagaagaaguugggugaguucgggcgcgccaaaggaucucgcgcgaucugguacauguggcucggagcgcguuuccucgaguucgaagcucugggguuccucaacgaggaucacugguuuggccgcgagaacuccuggagcggcguugagggugaaggguugcaccgacugggguauauucuggaggagaucgacaagaaagacggagacuuaauguaugcugacgacaccgccggaugggacacgcgaaucacagaggacgaucugcagaacgaggagcucauuacggagcagauggcuccccaccauaaaauacucgcgaaggccaucuucaaguuaaccuaccagaacaaggucguaaaggugcuccgaccuaccccgaggggcgcggucauggauaucaucucgcggaaagaccagcgcggcagcgggcagguuggcacguacgggcugaacacguucacuaacauggaggugcagcuuaucaggcagauggaggccgagggcgucauuacucaagacgauaugcaaaaccccaaggggcucaaggagcgcguggagaaauggcugcgagagugugggguggaccgccugaagcggauggcgaucucgggggacgacugcguagugaagccucucgaugagcgcuucgggaccagucuauuauucuuaaacgacaugggcaagguccggaaggacauuccccagugggagccgagcaagggguggaagaacuggcaagagguccccuuuugcucgcaccauuuccauaagauuuucaugaaggauggccgcucccuggugguacccugccggaaccaggacgagcugaucggccgcgcgaggaucagucagggggccggcugguccuugcgcgagacugccugccuggggaaggccuacgcccagauguggagccucauguauuuccaccgccgggaccuucgccuggccucgauggccaucugcagcgcuguacccaccgagugguucccgacaagccggacaacgugguccauccacgcccaccaccaguggaugacuacagaagacaugcugaagguguggaaccguguguggauugaggacaaccccaacaugacagacaagacgcccguccacucaugggaggacaucccauaccucggcaaacgagaggaccuauggugcgggucccugaucggccuuucuucccgcgcgaccugggccaagaacauccacaccgccauaacgcaagugcggaaccugauuggcaaggaggaguacguggacuauaugccgguuaugaagagguacucugcucccuccgagagcgagggggugcuguga

SEQ ID NO: 26279 - RNA, 9867 nt, Artificial Sequence
  derived and/or modified CDS sequence (opt11) from DENV-4__FJ882586__SS-prME
agcaccauaacccugcuaugucugauaccgacggugauggcauuccaccugucaacccgggacggggagccgcucaugauugucgccaagcaugaacgcggccgacccuugcuguucaagaccaccgagggcauuaacaagugcacucucaucgccauggacuugggggagaugugugaggacacggugaccuauaaguguccccugcucgugaacaccgagcccgaggacauugauugcuggugcaaccugacgucaaccugggucauguauggcacaugcacucagagcggggagcgacggcgggagaagcgcagcguggcacugacaccgcacucgggcaugggccucgaaacgcgggcagaaaccuggaugagcuccgagggggccuggaaacacgcccagcgggucgaaucguggauucugcgcaaccccggcuucgcucugcucgcuggguucauggccuacaugaucggucagacggguauccagcggacggucuuuuucguguuaaugaugcugguggcacccuccuacgggaugcggugcgucggcguggggaacagagauuucguggagggcgucaguggaggggcguggguggaccucguucuggagcacggcgggugcgucaccaccauggcccaggggaagcccacccucgacuucgaguuaaccaaaacaacagcuaaggagguggcacugcugcggaccuauugcauagaagcacucaucuccaacaucacgacagccacacgcugcccgacccagggggaaccauauuugaaggaggagcaagaccagcaguacaucugucggcgcgacguggucgacagaggcugggggaacggcugcggccuguuugguaagggcgggguggugacgugcgccaaguucagcugcucgggcaagauaaccgggaacuuggugcagaucgagaacuuggaguacacugugguagucaccgugcacaacggagacacgcaugccgugggcaacgauaccagcaaccacggggugaccgcaaccaucacgccucggucccccagcguggaggucaagcugccggacuacggcgagcucacccuggacugcgagccccggagcgggaucgacuucaaugagaugauccugaugaagaugaaaaagaaaaccuggcuugugcacaagcagugguuccucgaucugccccucccuuggacaacuggagccgacacgagugaggugcacuggaauuauaaggagagaauggucacguucaaagugccgcacgcgaaacggcaagacgugaccguccuagggucccaggaaggggcgaugcauagcgcguuagccggagccacugaggucgacagcggggacggcaaccacauguuugcagggcaccucaagugcaaggugcgcauggagaaacugcgcauaaaagguauguccuacacgaugugcaguggcaaguucaguauugacaaggagauggcagagacccagcacgggaccaccgucgugaagguaaaguacgagggcgccggagcgcccugcaagguucccaucgagauucgugacguuaacaaggagaagguggucggccgcgugaucuccgccacuccucuggcggagaacaccaauuccgucaccaacaucgagcucgaaccgcccuucggggacuccuacaucgucaucggcgugggcaacuccgcccucacccuacauugguuccggaagggaagcuccaucggcaagauguucgaaagcaccuaccgcggggcgaagagaauggccaucuuaggcgagacagcgugggacuucggauccgugggcggauuguuuacuucucuggggaaggccgugcaccaaguguucggcagcguguauaccacgauguucgggggcguuuccuggaugauccgcauacugaucggcuuucugguccucuggauuggcaccaacucccgaaacaccucuauggcgaugaccugcaucgcggucggcgggauuacacuuuuccucggguucaccguccaggcugauauggggugcguuguguccuggaguggccgcgaguugaagugcggcagcggcaucuuugucguagacaacgugcacacuuggaccgagcaguacaaguuccagcccgaaucucccgcgcggcuggcuagcgcuauccucaacgcccacaaggauggcgucugcgggauucguaguacgacccggcuggagaacgugauguggaagcaaaucaccaacgagcuaaacuaugucuuaugggaaggagggcaugaccuaaccgucguggcgggcgacguaaagggcguccucacgaaaggcaagcgcgcguuaaccccuccagcgagcgaccugaaguacuccuggaagaccuggggaaaagccaagaucuuuacccccgaggcucggaacagcacguuccugauugacgggcccgacacguccgagugcccuaaugagagacgggcauggaacuccuuugagguagaggacuacggcuucgggauguucaccaccaacaucuggaugaaguuucgcgagggcuccucugaggugugcgaucacagguuaaugucugcggccaucaaagaucaaaaggccguucacgcagacaugggcuacuggaucgaguccuccaagaaccagacauggcagauagaacgcgccagccugaucgagguaaagaccugccuguggcccaagacccauacccucugguccaauggggugcuggagagccaaauguuaauccccaaguccuacgcggggcccuucagccaacauaauuaucggcagggcuacgccacccagacggucggcccauggcaccucgguaaguuggaaaucgauuucggcgagugccccggcaccaccgugaccauccaggagaauugcgaucaccgcgggcccagucugcgcacaaccacggccagcggcaaacucgugacccaaugguguugucgcucaugcaccaugccgccccugcguuuccugggggaggacggcugcugguacgguauggagauccggccacugucugagaaagaggagaauauggucaagagccaggugaccgccggccagggaaccuccgaaaccuucucgaugggauuauugugucucacgcuauuugucgaggaaugccuccgcagacgagugacgcggaaacauaugauccucgcggugguaauuacccuaugugccauaauucugggcgggcucaccuggauggaucugcugcgcgcucucaucauguuaggcgacacgaugucugggcggaucgggggccagacacaccuggccaucauggccgucuucaagaugagccccggguacgugcucgggguauuccugagaaagcugaccucccgggaaaccgcguugauggugaucgggauggccaugaccacuacgcugucgauaccgcacgaccugauggaguugaucgacggcaucucccuggggcugauacuccugaagaucgugacccaguucgacaauacgcaggucggaacccuggcacucagccucaccuucaucagauccaccaugagccugguaauggcauggcguacgaucauggccguacucuuugucguaacccuuaucccccucugccgcacauccugccuccagaagcagagccacuggguagagauaaccgcacuuauccuuggagcucaggcccucccuguguaucugaugacgcugaugaagggggcuagccggcgcagcuggccguuaaacgaggggauuauggcggugggacuugugucucugcuugggagcgcacuucugaaaaacgaugugccguuagccggccccaugguagcaggagggcugcuucuggcggcguacguuaugagugggagcagcgccgaccucucccuagagaaggccgccaacguccagugggaugagauggccgacaucaccggcuccucccccaucauagaggugaagcaggacgaggacgguagcuucucuauccgggacguggaggaaacgaacaugaucacgcucuuggucaagcuggccuugauuacggugagcggcuuauauccccuggcaaucccgauaaccaugacucuaugguacauguggcaggucaaaacccagagguccggcgcccugugggacguccccaguccagccgccacccagaaggccgcacuguccgaggguguuuaccggauaaugcaacgcggauuauucgguaagacacaggugggugucggaauccacauggaggguguguuccacacaauguggcacgugacucggggcagcgucauuugccacgaaacaggucgccucgagcccuccugggccgauguacgcaacgacaugaucagcuacggcgggggcuggcggcuaggcgacaaaugggacaaggaagaagacguccagguccucgcuaucgagccggguaaaaaucccaaacacgugcagacgaagcccggacuguucaaaacucugaccggggaaauaggcgccgugacgcucgacuuuaagccuggaacgucuggcagcccuauuauaaaccgcaaaggcaaggucauagggcuguacgggaauggggucguaaccaaguccggagacuacgucagcgcgaucacccaggccgagagaauuggggagcccgacuacgaagucgacgaggacaucuuccgcaagaagcggcugaccaucauggaucuccaccccggugccggcaagacaaagaggauccugccgagcaucguccgggaagcccugaagcgccggcugcgaacccucauccuggcgcccacccgcgucguggccgcagagauggaggaagcacugcgcggacucccgauccgauaccagaccccagccguaaagucggagcacacgggucgcgaaauuguugaccugaugugucacgcgacuuucaccacuagacugcucuccucgacacgggugccgaacuacaaccugaucgugauggacgaggcucauuucaccgacccuucaucuguggccgcccggggguacauuucaacccgcguggaaaugggcgaggcggcggcaauuuucaugaccgcuacgcccccaggggcuacugacccguuuccccagaguaacaguccgaucgaagauaucgagcgggagaucccagagcgcuccuggaacaccggauucgacuggaucaccgacuaucagggcaagacggucugguucgugccgagcauuaaggccgggaaugacauagcgaacugccugcgcaaguccggcaagaaggugauccagcucagccgcaaaaccuucgacaccgaauaccccaagaccaaacugacggacugggauuucguugucaccacugacaucuccgagaugggggccaauuuccgcgccggcagggucaucgacccccgccggugccugaagccggucauccucaccgacgggccggagcgugugauacuggccggucccaucccggugacgcccgcgagcgccgcccagcggcgcggacggauagggcggaacccggcccaggaagacgaccaguaugucuucucuggugacccccucaagaacgacgaggaccacgcucauuggaccgaggccaaaaugcuccuagauaacauuuacacccccgagggcauaaucccgacauuauucggaccggagagggagaagacacaggcgaucgacggagaguuccgcuuaagaggggaacagcguaagaccuucguggagcucaugcggcgcggcgaccugcccguauggcucagcuauaagguggcauccgccggaaucagcuacaaggaccgggaauggugcuuuacaggggagcgcaacaaccagauccuggaggagaacauggagguggagaucuggacacgagagggggagaagaagaaguuacgucccaaguggcuggacgccaggguguacgcggacccuauggcccugaaggauuucaaggaguuugccucgggccgaaagagcauuacccucgauauccuuacggagaucgcauccuugccgaccuaccugucuagcagagcaaagcucgcgcuggacaacaucgucaugcugcauacuaccgagcgcggagggcgcgcuuaccagcaugcccucaacgaacugcccgaaucccuggagacgcucaugcuugucgcgcugcucggcgcgaugacagccgggaucuucuuguuuuucaugcagggcaaagggaucggcaaacugagcaugggccucaucaccaucgccguggcauccggucuccugugggucgccgagauacagccccaguggaucgcggccagcaucauucuugaguucuuucucauggugcuacucauaccggagcccgagaagcagcggacuccccaggacaaccagcugaucuaugugauccugacgauccucaccauuauuggccugaucgcugccaaugagaugggacugauugaaaagaccaagaccgacuucggcuucuaccaggucaaaacggagaccaccauccucgauguugaccugagacccgccuccgccuggacccuguacgccguggcgacgacgauccucaccccuaugcugaggcacaccauugagaauacgagcgccaaucugucccucgccgcgaucgccaaccaggcugccguccugauggggcugggcaaaggcuggccccuccaccgcauggacuugggagucccccugcuggccaugggcuguuacagucaggucaacccgaccacccucaccgcgucccuuguaaugcuccuggugcauuacgcaauaauugggccuggccuacaggcgaaggccacgagagaggcacagaagcgcaccgccgccggcaucaugaagaaccccaccguggaugggaucacuguuaucgaccucgagcccaucagcuacgaccccaaguuugaaaagcagcugggccaggugaugcuguuggugcugugugccgggcagcugcuccuaaugaggacgacgugggccuucugcgagguccugacgcucgcgaccggaccgauacugacacuaugggaggggaaucccggccguuucuggaacaccacaaucgcuguauccacugcaaacaucuuccguggcagcuaccucgccggggccggccuggcguucucccugaucaagaacgcccagacgccgcgccggggaacaggcaccaccggggagacccugggcgagaaguggaaacgccagcugaacagccuggaccggaaagaguucgaggaguacaaacgcuccggcauccucgagguggaucggacggaggcuaagucggcauugaaggacgggagcaagaucaagcacgcagucagccgcggaucgagcaaaauccgguggaucguggagcgcgggauggugaaaccuaagggcaaggucguggauuuagggugcggccgcggaggguggucuuacuacauggcgacccucaagaaugugaccgaggucaagggcuacaccaaaggagggccgggccacgaggagcccauucccauggccaccuacggcuggaaccuggugaaacugcacagcggcguggacguauucuacaagcccacagaacagguggauacucugcucugcgacaucggggagagcagcagcaacccgaccaucgaggagggcagaacacugagagugcucaagauggucgagccuuggcugucaagcaaaccagaguucugcauuaaggugcugaacccguacaugccgaccguaauagaggagcuggaaaaacugcaacggaagcacgggggcaaccugguccgcugcccccugucacggaacagcacccaugaaauguacuggguaucaggugcuuccggaaauaucgucuccagcguaaacaccacuucgaagaugcuuuugaaccgcuuuaccacccggcaccgcaagccgaccuacgagaaggauguggaucuuggcgccgggacacgauccguauccaccgagaccgagaagccugauaugaccauaaucggaaggaggcuccagcgccugcaggaggagcacaaagagacguggcacuacgaucaggaaaacccguacagaaccugggcguaccacgggagcuaugaggcccccucuaccgguagcgcuagcucaauggugaacggcguggugaagcugcucaccaagccuugggacgucauccccauggugacgcagcuggccaugacggacacuacacccuucgggcagcagcgcgucuuuaaggagaagguggacacccggacgccccagccuaagccggguacacgcauggugaugaccacgacggccaacuggcugugggcgcuccuggggaagaagaaaaauccccgguuaugcacccgcgaggaguucaucuccaagguccgguccaacgcggcgaucggcgccguguuccaggaggagcaaggguggacaagcgccuccgaggcggugaacgacagccgcuucugggagcucguagacaaggaacgagcccugcaucaagagggcaagugcgagucaugcguauauaacaugauggggaagcgcgagaagaaacuuggagaguucggcagagccaaaggaagccgggcuauaugguacauguggcucggcgcgcgcuuccuugaguucgaggcgcugggguucuugaacgaggaucauugguucggccgugagaacagcugguccggcguggagggggagggccugcaccgccugggguacauccucgaagagaucgauaagaaggacggcgaccugauguaugccgaugacacggcgggcugggacacccguauuaccgaggacgaucugcagaacgaggagcuaauuaccgagcagauggccccgcaucauaagauccuggcaaaggccaucuucaaacugaccuaucagaacaaagucgucaagguccucagacccacaccgagaggggcugucauggacaucaucucucgcaaggaucagcgggggagcgggcaaguaggcacguacgggcugaauacuuucaccaauauggaggugcagcugauccgccaaauggaggcagaaggcguuauaacacaggacgacaugcagaaccccaaaggucucaaggagcggguagagaaguggcugcgugagugugguguggaucggcugaaacgcauggccaucuccggagaugacugcguggugaagccccuagacgagcgguucgggacuuccuuauuauuccuaaaugacaugggcaaggugcgcaaagacaucccccagugggagccguccaagggguggaaaaacuggcaggaaguccccuucugcucucaccauuuucacaagaucuucaugaaggacggacggucccugguggugcccugccgcaaccaggacgaacugauaggucgggcccguaucagccagggugccggcuggucccuccgcgagacagccugcuuggggaaagccuacgcccagauguggucauugauguacuuucacaggcgcgaccuucgguuggcguccauggcaaucugcucggccguccccacugagugguucccgacgagccgaaccaccugguccauucacgcccaucaccaguggaugacaacagaggacaugcugaaaguguggaaccggguguggauugaggauaaccccaacaugauagacaagaccccggugcauucuugggaagacauccccuaucucggcaagcgcgaggaccuguggugcggguccuuaaucggcuugagcuccagggcuaccugggcgaagaacauccacacugccaucgcccaggucagaaaccucauugggaaggaggaguacguagauuacaugccugucaugaagcgcuauagugcacccuccgagagcgaagggguucuauga

SEQ ID NO: 26280 - RNA, 9867 nt, Artificial Sequence
  derived and/or modified CDS sequence (opt11) from DENV-4__JN819406__SS-prME
ucaaccaucacccuacucugucugauuccgacggugauggccuuucaccuuucgacccgcgacggggagccccucaugaucguggccaagcacgagcggggucggccccugcuguucaagaccaccgagggcaucaacaaguguacgcucaucgcgauggaccugggggagaugugcgaggacacggucaccuacaagugcccccugcucgugaacaccgaacccgaggauaucgacugcuggugcaaccugacuaguaccuggguuauguacgggaccugcacucaaucgggggagcggcgccgggagaaacgcucuguggcgcugacgccgcacuccggaaugggccucgagacccgggccgagaccuggaugagcucugagggagccuggaagcacgcgcagcgaguagagagcuggauccuucggaaucccgguuucgcgcuguuggccggguucauggccuacaugauuggccagacaggcauccagcgcacgguguuuuucgugcugaugaugcuuguugcccccucauacggcaugcggugugucggcguagguaaucgcgacuuuguggagggugucagcgggggcgccuggguggaccugguacuggagcacggcgguugcgucaccaccauggcccagggcaagccuacgcuggacuucgagcucaccaagacgaccgccaaagagguggcucugcugcggacguacugcaucgaggcccucaucuccaacaucacgaccgcuacucgcugcccgacccaaggggagccguaccuuaaggaagagcaagaccagcaguacaucugccgcagagacgugguagaucggggaugggggaacggcugcggccuguucgggaaaggggguguggugacaugcgccaaguuuagcugcuccggcaagauuaccgggaaccucguccagaucgagaaucuggaguacaccguaguggucaccguccacaacggcgacacgcacgccguuggcaacgacaccagcaaccacggggugacagccacgaucacgccgcggucccccagcguggaagugaagcugccggauuacggcgagcugacccuggacugcgaaccccgguccgggaucgauuucaacgagaugauacugaugaagaugaaaaagaaaacguggcucguccacaagcaaugguucuuggaccugccccuccccuggaccaccggggccgacacgagcgaggugcauuggaauuacaaagagcgcauggucaccuucaaagugccgcacgcgaagcggcaggacgugaccgucuugggcucccaggagggcgccaugcacagcgcccuggcgggugccaccgagguggacagcggggacggcaaucacauguucgcugggcaccucaagugcaaggugcgcauggagaagcugcgcauuaagggcauguccuacacgaugugcagcggcaaauucuccaucgacaaggagauggccgaaacccagcauggaaccaccgucgugaaggugaaguaugagggcgcaggggcccccuguaagguccccauugagauuagagacgugaacaaggagaagguagucggucgagugauuagcgcgacgccccuggcggagaacaccaacuccgugaccaacaucgagcucgagccgcccuucggggacagcuacauaguuaucggcgugggcaacucggcccugacucugcacugguuccggaaggggagcaguaucggcaagauguuugagagcacguaccgcggggccaaacgcauggccaucuuaggagagaccgcuugggacuucggguccgugggcggccuguucaccagccuggggaaagccguucaccagguguucggcuccguguauaccacgauguucggggguguuagcuggaugauccgcauccucaucggguuccuagugcuguggaucggaaccaacucccggaacaccagcauggccaugaccugcauagccgugggcgggaucacgcucuuccuagguuucacgguccaagcugauauggguugugugguguccuggagcgcgcgcgagcugaagugcggauccgggaucuucgucguggauaacguucacaccuggaccgaacaauaccaguuucagcccgagagccccgcccggcuggccagcgccauacucaacgcccacaaggacggagugugcggcauccgcuccacgaccagacuagagaacgugauguggaaacaaaucaccaacgagcugaacuacguccucugggaaggcggacaugaccugaccgucguggcgggggacguaaagggcguccugacgaaaggcaagcgggcacucaccccucccgccagcgacuuaaaguacuccuggaaaacuuggggaaaggcaaagaucuucacccccgaggcccgcaacagcacguuucucaucgauggccccgacaccagcgaaugucccaacgagcggcgggcguggaacaguuucgagguggaggacuacggguuugggauguuuaccaccaacaucuggaugaaguuccgcgagggauccucugaggugugugaccaucggcuuaugucugccgcaauuaaagaccaaaaggcaguccaugcggacaugggauacuggauugagucgucaaagaaucagacguggcagaucgaacgcgcaucgcugauagaggugaagaccugcuuauggcccaagacacauacccucuggucgaauggcguacucgagagccaaaugcugauccccaaauccuacgccggcccguuuagccaacacaacuaucgccagggcuacgcuacgcagacggucgggcccuggcaccucggcaaacuggagaucgacuucggggagugccccggcacaaccgugaccauacaggagaacugcgaccaccgcggaccgucgcuucgcacgaccaccgccuccggaaaguuagugacccaguggugcugccggucguguacgaugccaccucugcgguuccugggugaggacgggugcugguaugguauggagauccggccccucuccgagaaggaggagaacauggucaagagccaggucaccgcggggcagggcaccagugagaccuuuagcaugggacugcugugccuaacacuauucguugaagaaugccugcgacgccgcgugacccggaaacacaugauccucgccgugguaaucacuuuaugcgccauaauccucggcggguuaacguggauggaucuguuacgugcucucaucaugcugggggacacgaugucggggcggaucggcgggcagacccauuuggccaucauggcgguguucaagaugucucccggcuacguucucggggucuuccugcgcaagcugacuuccagagaaacugcgcucauggugaucggcauggccaugacgaccacucugagcaucccgcacgaccugauggagcucaucgacgggaucucucugggcuugauccuccugaagaucgugacccaguucgauaauacucaggucggcacccuggccuugagucugacuuucauccgcucgaccaugagccuugugauggccuggcggacgaucauggcgguacuguucgucgugacccugauuccgcugugccgaacuuccugccugcagaagcagagccacuggguggagaucaccgccuugauucuaggugcccaggcccucccuguauauuuaaugacucuuaugaagggugcaucccggcgcucuuggcccuugaacgaggggauaauggcagugggucuggugucccuacucgggagcgcacugcugaaaaacgaugucccucucgccggccccaugguggccggcgggcuacugcucgcggcguacgucauguccggcucgagcgccgaccugagucuggagaaagcugccaacguccagugggaugagauggccgacaucaccgggucgucaccgaucaucgaggugaagcaggacgaagacggcagcuucucgaucagggacgucgaagagaccaauaugaucaccuuacuggucaaacuggcccucaucacggugagcgggcuguauccccucgcaauaccgauaaccaugacccuuugguacauguggcaggucaagacccagagguccggcgcucugugggacguccccagcccugcugcgacccagaaggcagccuugucugagggcguguacagaaucaugcagcgcggccuauucgggaagacccagguagggguuggcauccacauggaagggguguuccacaccauguggcacguaacccggggguccgugaucugccaugagacaggacgcuuagagccauccugggccgacguacgcaacgacaugauuagcuacgguggcggcuggcgguuaggcgauaaaugggacaaggaggaggacguacagguccuagcuauugaaccgggcaaaaaccccaagcaugugcagacgaagccugggcuuuucaagacccugaccggugagaucggagcggucacccuagacuuuaagcccggcacgucugggucaccgaucaucaacaggaaaggcaagguaaucggccucuacggcaauggcguggugaccaaguccggggauuaugucucugcaaucacccaggcggagcggauuggcgagcccgacuacgaaguggaugaagacaucuucaggaaaaagcggcugaccaucauggaucuccaucccggggccggcaagaccaagcgcauccugccguccaucgugcgggaggcguugaagcgcagacugagaacccucaucuuggcccccaccagagucguggccgccgaaauggaggaggcucuccgcggccucccaaucagauaccaaacucccgcggucaagagcgaacacacggggcgcgagaucgucgaccugaugugccacgcgaccuucaccaccaggcugcuuuccagcacgcgcguuccgaacuacaaccugaucgucauggacgaggcacacuucaccgaccccaguuccgucgccgccaggggauacaucucgacucgcguggagaugggggaggcggccgccaucuucaugacggccacuccucccggagccacugacccguucccccaguccaacagcccuaucgaggacaucgagcgggagauccccgagcgauccuggaacacuggguucgacuggaucaccgauuaccagggcaagacggucugguucgugccgucgauaaaggcgggaaacgauauagccaacugccugcgcaaauccgggaagaagguuauucagcucagcagaaagaccuucgacaccgaguacccaaagacuaaacugacggacugggacuucgucgugacuacugacauuucugagaugggcgccaacuuccgcgccggucgggugaucgacccccgccgaugccuuaagccuguuauccuuaccgacggcccggagcgagugauacuggcugggcccauccccgugacgcccgccuccgccgcucaacggcgcggccggaucggccgcaauccggcccaagaagacgaucaguacgucuucuccggggacccccuaaagaacgaugaggaccaugcucacuggaccgaggccaagaugcuccuggacaacaucuacacacccgaggggaucauccccacccuuuucgggccggagcgggagaagacccaggccaucgacggcgaguuucgccuccguggcgagcagagaaaaacuuucguggagcugaugagacgcggggaccugcccguguggcucucuuacaaggucgccuccgccggaaucucguacaaggauagagaguggugcuucacaggugagcgcaacaaccagauccuggaggagaacauggaaguggaaaucuggacccgggagggcgaaaagaagaagcugcgccccaagugguuggacgcgcggguguacgcugaccccauggcuuugaaagacuucaaagaguucgccuccggucguaagagcaucacgcuggacauccuaacggagaucgccucccucccgaccuaccugucgucccgcgcaaagcucgcccuggacaacaucgucaugcugcauacgaccgagcguggcggccgcgccuaccagcacgcgcucaacgaguuacccgagagccuggagacgcucaugcugguggcguuacucggggcaaugaccgccgggaucuuccuguuuuuuaugcaggggaaggggaucgggaaacugucuaugggccucaucaccaucgccguagccagcggacugcugugggucgcggagauucagccccaguggaucgccgccagcaucauccucgaguucuuccugauggugcuguuaaucccugaacccgagaaacagcggacgccccaagacaaucagcugaucuacguuauccugacuauccucaccaucaucgggcuuaucgccgccaaugagauggguuuaaucgagaagacaaaaacagacuucggguucuaccaggucaaaacugagacgacgauccucgacguggaucugcgccccgcauccgcauggacacuguacgccguugccacgaccauucucaccccuaugcugcggcacaccaucgagaacacuagugccaaccugucccuagcggcuaucgccaaccaggccgccguccugaugggcuuagggaagggcuggccucuccaccgcauggaccugggcgugccccugcucgcgaugggcugcuacucccaggugaacccaacaaccuugaccgccucucuggucaugcuacugguacacuacgccaucaucggcccggggcugcaggcuaaagcuacgcgagaggcccagaagagaaccgccgcaggcaucaugaaaaaccccacuguggacggcaucacaguaauugaucucgagcccaucagcuacgaccccaaguuugagaaacaacugggccaagugaugcugcucgugcuaugcgccggccaacuacuccugaugagaacgaccugggcguucugcgagguccugacgcuugccaccggcccgauacuaacgcugugggagggcaaccccgggcgcuucuggaacaccaccaucgccguguccacagcgaacauuuuccggggaagcuaucuagccggcgcggggcuggccuucucucugauaaagaacgcgcagacgccccgccggggcaccgggaccaccggcgaaacccucggggaaaaguggaaaaggcagcugaacagccuggacagaaaggaguucgaggaauacaagcgcagcggcauacucgagguggaccggacugaggccaagagcgcccugaaggacggcuccaagauaaagcacgcggucagcagagguagcagcaagauacgcuggauagucgagcgcgggauggugaagcccaaggggaaagucguggaucugggaugcggucgcggcggaugguccuauuacauggcaacccucaagaacguaaccgaggucaagggguacaccaagggcgggccggggcacgaggagcccauccccauggccacguacggguggaaccugguaaagcugcacagcggcguggacguguucuacaagccaacggagcaggucgacacccuccugugcgacaucggugagagcuccagcaacccgaccauugaagagggaagaacgcugcgcguucucaagauggucgagcccuggcuguccagcaagcccgaguucugcauaaaggugcugaaccccuacaugccgaccgugauugaggagcuggaaaagcugcagagaaagcacggcgguaaccugguccgcuguccccugucacggaacucuacacacgagauguacuggguguccggcgccucggguaacaucgucuccagugugaacaccacgucaaagaugcuccugaaucguuuuaccacucggcaccguaagcccaccuacgagaaggacguggaccugggggcgggcacgcgcucugucuccaccgagaccgaaaagcccgacaugacgaucauugguagacgguugcagcgccugcaggaggaacacaaggagacguggcacuacgaccaggagaacccguaccggaccugggccuaccacggcagcuacgaagcgcccuccacaggaagcgccuccagcauggugaacgggguggucaaacuuuugacaaagcccugggacgugauuccaauggugacgcaacuggccaugaccgacaccacgcccuucggccagcagcgcgucuucaaggaaaagguggacacgcggacgccccaaccuaagccgggaacucguauggucaugaccacgaccgcuaacuggcucugggcgcuccuggggaagaagaagaaccccagacugugcacucgcgaggaguucaucuccaagguucggagcaacgcugcuauaggggcgguguuccaagaagagcagggcuggaccucggccuccgaggcggugaacgacagccgauucugggaacucgucgauaaggagcgggcccugcaccaggaggguaaaugcgagaguuguguauauaauaugauggguaagcgcgagaagaagcugggcgaguucgggcgcgccaagggcagccgggccauaugguacauguggcuaggcgcgcgguuuuuagaguucgaagccuuaggcuuccucaacgaggaccacugguucgggcgggagaacuccuggagcggaguggagggcgaagggcugcaccgacuaggcuauauccucgaggagaucgacaagaaggauggcgaccucauguacgccgacgacaccgcuggcugggacacccggaucaccgaagacgaccuucagaacgaggagcugaucaccgagcagauggcgccgcaccacaagauucuagcaaaagccaucuucaagcuuaccuaccagaacaaagucgugaagguucuccgucccacuccgcggggugccgucauggacaucaucucccgcaaggaucaaaggggaagcggccagguggggaccuacggacugaacaccuucaccaacauggaagugcaacugauccgucagauggaggccgagggggucaucacgcaggacgacaugcagaacccuaagggacucaaggaacguguggagaaauggcucagagaguguggugucgaccggcugaagcgcauggcuaucuccggggacgacugcguagugaagccgcucgacgagcgguucggcacgagccuucucuuccucaacgacauggguaagguccgcaaggacaucccucagugggagccgucaaagggcuggaagaacuggcaagagguuccuuucugcagccaccauuuccacaagaucuuuaugaaagaugggcgguccuuaguggugcccugccgcaaucaagaugagcugauaggccgggcccgcaucagccagggcgcaggauggucccuccgcgagaccgccugucugggcaaagccuaugcgcaaauguggagccuaauguauuuccacaggcgcgacuuacgccuggcguccauggcuauaugcagcgccgugcccacggagugguucccgacgagucggaccaccuggagcauccacgcccaccaccaguggaugaccacggaagacaugcugaagguguggaaccggguuuggaucgaggacaaccccaacaugauugacaagacgccgguccacuccugggaagacauccccuaucucgggaagcgcgaggaccuguggugcggcucccugaucgggcucagcuccagggccaccugggcgaagaacauacacaccgccaucacccaaguucgcaaccugauaggaaaggaggaguacguggauuacaugccagucaugaagcgguacagcgcccccuccgagagcgagggcgugcuguga

SEQ ID NO: 26281 - RNA, 9867 nt, Artificial Sequence
  derived and/or modified CDS sequence (opt11) from DENV-4__GQ199876__SS-prME
agcaccauaaccuugcucugccugauucccacugugauggccuuucaccuguccacgcgcgacggcgagccguugaugaucgucgcuaagcacgagcggggcagaccccugcuguucaagacgacggagggcaucaacaaaugcacccucaucgccauggaccugggggagaugugugaagauacggugacuuauaaaugcccccugcuagugaacaccgagcccgaggacaucgacugcuggugcaacuugacgucgaccuggguuauguacggcacuugcacccaguccggggagcggcgccgcgagaagcgcucgguggcccugacgccccacuccggcaugggccuggagacccgcgccgaaaccuggaugagcucagagggggccuggaagcacgcccagcgcguggagagcuggauccugcggaaucccggguucgcgcugcucgccggguucauggccuacaugauuggccaaaccgggauccagcgcacggucuucuucgugcugaugaugcugguggccccauccuacgggaugcggugcguuggcguagggaaccgcgauuucguggaaggcgucagcgggggcgcguggguggaccuaguacuggaacacggagggugcgucacaacgauggcucagggcaaacccacccuggacuuugaguugacgaagacaaccgcuaaggagguggcccugcuaaggaccuacuguaucgaggcgcucauuucaaacaucacgacggcgacucgcugcccgacccagggggagcccuaucuuaaggaagaacaggaccagcaguauaucugccggcgcgaugucguggaccgggggugggguaacggcugcggccuguuugguaaaggcgggguggugacgugcgcuaaguuuagcugcuccggcaagaucaccggcaaucucguccagaucgaaaaucuggaguacacugugguugucaccguucacaacggugauacgcacgccgucgguaacgacacgagcaaccacggggugaccgccaccaucacgccacgcaguccgucaguggaggucaagcugccggacuacggagagcugacauuagauugcgagccccgguccggcauagacuuuaacgagaugauccuuaugaagaugaaaaagaagacauggcucgugcacaagcagugguuccuggaccugccccuccccuggaccacuggcgccgacacgagugaagugcauuggaauuacaaggagcggauggucaccuucaaggugccgcacgcgaaacggcaggaugugacaguccuggguucacaggagggcgcuaugcauagcgcccucgccggcgcuaccgaggucgauucgggggauggcaaccacauguucgccgggcaccucaagugcaagguccgcauggagaagcugcgcaucaaaggaaugucuuacacgaugugcagcgguaaguucuccaucgacaaggagauggccgagacccagcacgggaccaccguggugaaagugaaauacgagggcgcgggggcgccaugcaaagugccgaucgagauccgggacgugaacaaggaaaagguaaucggccgggucauaagcgcgacgccgcuggcggaaaacaccaacuccgugaccaauaucgagcucgagccgcccuucggcgacagcuacauagugaucggggugggcaacucugcccugacccugcauugguuccggaagggaagcucgaucggcaagauguucgagagcacguaccgcggggcaaagcggauggccauccucggcgaaacugcuugggacuucgggucaguaggcggucuguucaccucucuggguaaagcgguccaccaggucuucggcaguguguacacaacgauguucgggggagugagcuggaugauucggauccucauuggguuuuuaguccuguggaucggcacaaauucucgaaacaccagcauggccaugaccugcauugcaguagggggaauuacacuguuccucgguuucaccgugcaagccgauauggggugugucguuuccuggaguggccgcgagcucaagugcggauccgggaucuuuguaguggauaacgugcacaccuggacagaacaguacaaguuccagccggaaagcccagcgaggcuggccagcgccauacucaacgcgcacaaggacggcgugugcgggauucgcucgacgacuagacuugagaauguaauguggaagcagauuacaaacgaauuaaauuauguacuuugggaagguggccacgaccugaccgucgucgcgggggaugugaaaggcguccugacgaaggggaaaagagcgcuaacaccgcccgccagcgacuuaaaauauuccuggaagacauggggaaaggcuaagaucuucacgccugaggcccggaacucuacguuccugaucgacgggccugacaccuccgaguguccgaacgaacgccgggccuggaacagcuucgaggucgaggacuauggcuucggcauguucacuaccaacaucuggaugaaguuccgcgagggaucgagcgaggugugcgaccacaggcucaugagugcagccaucaaagaucagaaagccguacacgccgacaugggguauuggauagagagcucgaagaaccagacguggcagauagagcgagcgagccugaucgaggugaagacuugucucuggcccaagacccacacccucugguccaacggcgugcucgaaucacagaugcugauccccaagucauacgcuggcccuuucagccagcauaacuaucggcaaggguaugcaacccagaccgugggcccguggcaccucgggaagcuggagauugacuucggcgaaugcccugggaccaccguuaccauccaagagaacugcgaucaucgggggccaucacugcggacgaccacugccagcggcaagcucgugacccaauggugcugccguagcugcacgaugccaccccugagguuuuuaggggaagacgggugcugguacgggauggagauuagaccccucagcgaaaaggaggagaacaugguaaagagccagguaaccgcgggccagggcacaagcgagacguuuagcauggggcugcuguguuuaacccuguucguggaggagugccugcgccggcgcgucacccgaaagcauaugauucucgcaguugugaucacccugugcgccaucaucuuaggcggguuaacguggauggaccugcugcgcgcccuaaucaugcugggggacacgauguccgggcggaucgggggucaaacacaccuugccaucauggccgucuucaaaaugagucccggguauguccuuggaguguuccugcgcaaacugacuucucgagaaaccgcgcucauggucaucggaauggcuaugaccaccacccugagcaucccacacgaucugauggaacucauagauggcaucucgcuuggccugauccuccugaaaaucguuacccaauucgacaacacgcaaguggggaccuuggcccucagccugaccuucauucgguccacaaugagccuggucauggcuuggcgcacgauaauggccguguuauucguagugacccugaucccccugugcagaaccagcugucuccagaaacagucgcauugggucgagauuacggcgcugauccuaggcgcccaggcgcuuccuguguaccucaugacgcuaaugaaaggagcaucccgccgcagcuggccucucaaugagggcauuauggcggucgggcuggugucccuguuaggcagcgccuuacugaaaaacgacguaccgcucgcgggcccaaugguggccggaggccugcugcuggccgcguacguaaugucuggaagcucagccgaccugucccuggagaaggcugccaauguucagugggacgagauggcggacaucaccggcucgucacccaucauugaagucaagcaggacgaggaugggaguuuuuccauccgggacguagaagagacaaacaugauaacccuauuagugaaacuugcgcucaucacagucagcggccuguauccgcucgcaaucccgaucaccaugacccucugguacauguggcagguuaaaacucaacgcucuggcgcccugugggauguuccgagcccugccgccacccaaaaggcggcccuguccgaaggcgucuacaggaucaugcagcggggucuuuucggcaagacacaggugggcguggggauccacauggaggguguguuccacaccauguggcaugugacccgggggagcgugauaugccacgagaccggacgccuggagcccucgugggccgacguucggaacgacaugauuagcuacggcgggggcuggcgacugggagacaagugggacaaggaggaggacgugcagguccucgccauagaaccggggaaaaaccccaagcacguucagacgaaacccggccuguucaaaacccugacaggagaaaucggcgccgugacccucgacuucaagcccgggacguccggcagcccgaucauuaaccgcaaaggcaaggugauugggcuauacggcaacggggucgucaccaaguccggcgacuauguaagcgccaucacccaggcagagcgcauaggggagccagacuacgaggucgacgaggauauauucaggaagaagcggcuaacuaucauggauuuacaccccggcgcaggaaagacuaagcguaucuugccguccauugugcgggaggcccucaagcgccggcugcgcacccuuauccuggcgccuacucggguuguggcugcugagauggaggaggccuugagaggguuaccggugcguuaucagacccccgccgugaaaagcgagcauacagguagagaaauugucgaccugaugugucacgcuaccuuuacaacgcggcugcuuucuagcacgcgcgucccgaacuacaaccugaucgugauggacgaggcccacuucaccgaccccagcuccguagccgcccgcggguacauuagcacgagaguugaaaugggcgaggcagcugccaucuucaugaccgcuacgccgcccggggccaccgacccguucccccaaaguaacagucccauagaggacaucgagcgagagauacccgagagauccuggaauacagguuucgacuggaucaccgacuaccaaggcaagacgguuugguucgugccgagcaucaaggccgggaacgacaucgcgaacugcuugcgcaaaagugggaagaaagucauccagcucagccggaagaccuuugacaccgaguaccccaagacgaagcucacagacugggacuuugucgugaccacugacaucuccgagaugggugccaacuuccgagcuggccgggugauugacccacggagaugccugaagccggugauccucaccgauggucccgagcgcguaauccuggcgggucccaucccaguaacgcccgcgagcgccgcccagaggcgcggacggauugggcggaauccggcucaagaagaugaucaguaugucuucuccggcgacccccugaagaacgacgaggaccacgcccacuggaccgaagcgaagaugcuccuagacaacaucuacacgcccgaggguauuauccccacccuguucggacccgaacgggaaaagacgcaagccaucgauggagaguuccgcuugcgcggggaacaacggaagaccuuuguggagcuaaugcggcgaggcgaccugcccgucuggcuuuccuauaaggucgccuccgccggcaucucguacaaagaucgggaaugguguuucaccggcgagcgaaacaaccagauccuggaggagaacauggaaguagagauauggacccgggagggcgagaagaagaaacuucgucccaaguggcucgacgcccggguguacgcggaucccauggcacugaaggacuuuaaggaguucgccuccgguagaaagagcaucacgcuggacaucuuaacggagaucgcaucacugccgaccuaccugagcagcagagccaagcucgcguuagacaacauagugaugcugcauaccaccgagcggggagggagagccuaucagcacgccuugaacgagcuaccagagucguuggagacgcucaugcugguugcccuacucggagcgaugaccgccgggauauuccuguucuuuaugcagggcaaagggaucggcaaguugaguaugggccucaucacuaucgccguagccuccgggcuccuguggguggcggagauccagccacaguggaucgcggccagcaucauucuugaguucuuccugauggugcuguuaaucccggagcccgagaaacaacggacgccacaggauaaucaacucaucuaugugauccugacgauccuuaccaucaucggccugaucgcagccaaugagauggggcugauagagaagaccaaaacggacuuuggguucuaucaagugaagacagagaccaccauacuugacguggaucuacgaccagccucagcauggacacuguacgcgguagccacaacgauucucaccccgaugcugcgucauaccaucgaaaacacgagcgccaaucucucccuugccgcgauugccaaucaggccgccguccugauggggcuggggaaaggauggccccuccaucgcauggaccugggagugccucugcucgccaugggcugcuauagccaggugaaucccaccaccuuaaccgcgagccucgucaugcuccuaguucauuacgcaauuaucgggccgggccugcaggccaaagccacgcgggaggcgcaaaagcguacugcagccggcaucaugaaaaacccgaccguggaugggaucaccgucaucgaccuugagcccaucagcuacgauccaaaguucgagaagcagcugggccaagucaugcuacucguucugugcgcuggacagcugcucuugaugcggacgaccugggcuuucugcgagguccuuacccucgcgacgggaccgauccugacgcugugggaggggaaccccgggcgguucuggaacacaaccaucgccgugagcaccgcgaacaucuuccggggcagcuauuuagcgggggccgggcuagcguucagccugauuaaaaaugcucagacgccccgccgggggaccggcaccaccggggagacgcuuggagagaaguggaagcggcaacugaauagccuggaccggaaagaguuugaggaauacaagcgcucagggauacuugagguggacagaacggaagccaaaagcgcccucaaggaugggaguaaaaucaagcacgcugucucucgcggguccucaaagauccgguggaucguggagcgcgggauggugaagcccaagggcaaggucgucgaccuggggugcggacgcggaggguggaguuacuacauggcgacccucaagaacguaaccgaggucaagggcuacacgaaagggggcccgggacaugaggagccgauaccuauggcuacguacggcuggaaccuggucaaguuacacuccggcguggacgucuucuacaagcccaccgaacagguggacacgcuccuuugugacaucggggaaagcucauccaacccgacuauagaggagggccguacgcugcgcguccucaagauggucgaacccuggcuguccuccaagcccgaguucugcauuaaagugcuaaaccccuacaugccgacugugaucgaggagcuggaaaagcuccagaggaagcacgggggcaaccucgugcgguguccucugagucggaacagcacacacgagauguauuggguguccggggccuccgggaauaucguauccagcgugaauaccacguccaagaugcuccugaaucguuucaccacucggcaccgcaagccuaccuacgagaaggacguggaucucggggcaggaacgcggagcguauccaccgagacagaaaagcccgacaugacaaucaucggccgccgacuccagcgauuacaggaggagcacaaggagacguggcauuacgaccaggagaacccguaccguacgugggcauaccacgggaguuacgaggccccuuccaccggcagugcuaguucaauggugaaugggguggucaaguugcuuacgaagccaugggacguaauuccuauggugacgcagcuggcuaugaccgacacaacgcccuucgggcagcagcgcgucuucaaggagaagguggacacuaggacaccccagcccaagccugggacccgcauggucaugaccacgaccgccaauuggcuaugggcccuccuggggaaaaagaagaauccccggcuuuguaccagagaggaguuuaucuccaaaguccggagcaacgccgccaucggcgcuguguuccaggaagaacagggguggaccagugccuccgaagcugugaacgacagcagguuuugggagcucguagauaaggagcgggcccuucaccaggaaggcaaaugugaguccugcguguauaacaugauggggaagcgagagaagaagcucggagaguuuggccgcgcuaagggcucucgagccaucugguacauguggcucggcgcacgauuccuggaguucgaggcacuuggguuucugaacgaggaccacugguuuggccgggagaacuccuggagcggcgucgaaggggaaggccugcaccgccugggguacauccuggaggagaucgauaagaaggacggagaccugauguacgccgacgauacggcaggcugggauacacggauaacagaggaugacuugcagaacgaggagcucaucacagagcagauggcuccccaucacaagauccuugcgaaagcuauuuucaagcugaccuaccaaaacaagguagugaagguguugcgacccacgccaagaggggcuguaauggacaucauaucgcgcaaggaucagcggggcagcggacaggugggcacguacgggcugaacaccuucaccaacauggaggugcagcugauccgccagauggaggccgagggcgucauaacgcaggaugacaugcagaauccuaagggacucaaagagcgaguggagaaauggcugagagaguguggggucgaccggcugaagaggauggcuauaucaggcgacgacugugucgugaaaccccuagacgagagauucgggaccagucuguuauuucucaacgacaugggcaaggugagaaaggauaucccccagugggagccaucuaaaggguggaagaacuggcaggagguccccuucuguagccaucacuuucacaagaucuucaugaaagacggucgguccuugguagugcccugccgcaaccaggaugagcucauugggcgagccaggauaagucagggggccggcuggucccuccgcgagaccgccuguuuggggaaggccuacgcccagauguggucgcucauguacuuccaucggagagaucuccggcuggcguccauggccauauguagcgcaguacccacagagugguucccaacgagccgcaccacguggucuauccacgcccaccaucaauggaugaccacugaagacauguugaagguguggaaccgaguguggaucgaggauaaucccaauaugacagacaagacccccgugcacagcugggaggacauccccuaucuagguaaacgcgaggacuuguggugcggaucgcucaucggccucaguucucgggccacgugggccaagaacauucauacugccaucacacaggugcguaaccugauagguaaggaggaauacguagauuauaugccggucaugaagcgguacuccgcucccuccgagagcgagggcguccuguga

SEQ ID NO: 26282 - RNA, 9867 nt, Artificial Sequence
  derived and/or modified CDS sequence (opt11) from DENV-4__KP723482__SS-prME
agcaccaugacccugcucugccugauccccacgguaauggccuuccaccugaguacccgggauggugagccguuaaugaucguggccaagcaugagcgggggcgcccccugcuguucaagacgacugaaggcaucaauaaguguacgcucaucgcaauggaucugggggagaugugcgaagacaccgugaccuacaaguguccccuccucguuaacaccgaacccgaggacaucgacugcugguguaaccuaaccagcaccugggugauguacggaaccuguacccaguccggggagagacgccgggagaagaggucgguggcacugacaccucacucuggaaugggccucgagacgcgugccgagacuuggaugagcuccgagggggcuuggaagcacgcccagcgcguugagagcuggauccugagaaaccccggcuuugcgcuguuggcaggguucauggccuacaugaucggacagaccgggauacagcgaaccguguucuucgugcugaugaugcucguagcccccuccuacggcaugagaugcguaggcguggggaaucgcgacuucguggaaggcgucucugguggcgcguggguggaccucguguuggagcauggggggugcgucaccaccauggcgcaagguaaacccacccuggacuucgagcucacaaaaaccacagccaaggagguggcccugcugcggaccuacugcauagaagccuccaucagcaacauuacgaccgcgacccgcugccccacccagggggaacccuaucucaaggaggaacaagaucaacaguacauaugccgccgcgacguaguggacagaggcugggguaacggcuguggccuguucgggaagggcggggucgugacuugugccaaguuucugugcuccggcaaaaucacugggaaucugguccaaaucgaaaaucuggaauacaccgugguggucaccguacacaacggcaacacacacgccgucggcaaugacaccagcaaucacgggguaaccgccaccaucacgcccagauccccaagcguggagguuaaacugcccgauuacggcgaacucacgcuggacugcgaaccccgcuccgguaucgacuucaacgagaugauccugaugaagaugaagaagaagacgugguuggugcacaagcagugguuucuggaccugccccuucccuggaccgccggcgcggauaccagcgagguucacuggaacuacaaggagcgcauggucacguucaagguaccucaugcgaagcggcaggacgugacgguccuggguucccaagaaggcgcaaugcacuccgcccuggcaggcgcgaccgagguggauagcggcgauggcaaucacauguucgccgggcaccugaaguguaagguaaggauggaaaagcugcgcaucaagggaaugucauauacaauguguuccggcaaguucucgaucgacaaggagauggcggagacgcagcacgggaccaccgucgugaaggugaaguacgagggagcuggggcucccuguaaaguccccauagagauccgggacguuaauaaggagaaggugguaggcaggauaauauccuccaccccguucgcggagaacaccaacagcgugacaaacaucgagcuggaaccucccuuuggggauuccuauaucguaaucggcguaggcgacuccgcccucacccugcacugguucagaaagggguccuccaucggcaaaauguucgaguccaccuaccgcggggccaaaaggauggcaauccugggagagacggcgugggacuucggcagcguggguggccuuuucaccucccuggggaaggccgugcaucagguuuucggcaguguguacaccacgauguucggaggggugucguggaugauccgcauccuaauuggguucuugguccuguggaucggcacgaacagccgaaacaccuccauggccaugacuugcaucgcugugggcggcaucacucuguuccugggauucaccgugcaggccgauauggggugcguuguuagcuggaacggcaaggaacucaagugcggauccggaaucuuuguugucgacaacguucauaccuggacugagcaguacaaguuccagccagagucccccgcgcggcuggcgagcgcaauccugaacgcccacaaggacggagugugcgggauccggucaaccacgagacucgaaaacgucauguggaagcaaauuacaaacgaacuaaacuacgugcuaugggaaggcgggcaugaccucaccguggucgcuggcgacgugaaaggagugcugaccaaggggaagcgggcgcugaccccucccgugaaugaccucaaguauagcuggaagacaugggggaaggccaagauuuucacccccgaggcccgcaacuccaccuuucucauagaugggcccgacacgucugaaugcccuaacgagagaagagccuggaauuucuucgaaguugaggacuacggcuuugggauguuuaccacuaacauuuggaugaaauuucgggagggauccagcgaggucugcgaccaccgccuuauguccgccgcgaucaaggaccagaaggccguccacgccgacaugggauacuggauagaguccuccaagaaccaaacuuggcagaucgagaaggccagccucaucgagguuaagacgugcuuauggccgaagacucacaccuuaugguccaacgggguccucgagucacagaugcucauaccccgguccuacgcgggaccguucagccagcacaauuaucgccagggcuacgccacccagacagcuggcccguggcaccuggggaagcucgagaucgacuuuggugaaugccccggcacgacggucacaauccaggaggacugcgaccaccgggguccgagucugagaaccacgaccgcaagcggcaagcuggugacccaauggugcugccgauccuguacuaugccgccccuccgguucuugggggaggacggcuguugguacgggauggagauucgcccguuaucggaaaaggaggaaaacauggugaagagccagguaacggccggccagggaaccucagagaccuucagcaugggucuccugugccugacucucuucguggaggagugucucagacgacgugucacgcguaagcauaugauccuggcggugguaaucaccuucugcgccaucauccucggcggccugacauggauggaucugcucagaguccugauaaugcuaggugacaccauguccggucguauaggaggucagauucaucucgccaucauggccguguucaagaugucaccuggguacguacugggcguauuccugcggaaguuaacgagucgugaaaccgcccuaauggucaucggcauggcgaugacgaccguguucagcaucccgcaugaccugauggagcucaucgacggcauuuccuugggccugaucuuacugaaaaucgucacucacuucgacaacacgcaggugggaacucuggcccucagccugaccuucauccguucgacgacgccccuaguaauggccuggcgcacaauuauggccgucuucuucguggugacauuaaucccucuaugccggacgagcugccugcagaagcagucccacugggucgagaucacugccuuaauccugggcgcgcaagcccugccaguguaccuuaugacucuaaugaagggggccucucgacgguccuggccgcugaacgagggcaucauggccguuggccucguaagccuacugggauccgcgcuccugaagaaugaugugccccuggccggucccaugguggcggggggccuccugcuugccgccuacgucaugagcgggucgagcgcugaccuuucccuggaaaaggccgcaaacgugcagugggacgagauggcagauaucacgggcuccagcccuauaaucgaggugaagcaagaugaggacggcaguuuuagcauccgcgacgucgaagagacgaauaugaucacucugcucguaaagcuggcucugaucacugugagcggacucuacccgcuggcgauccccgucacuauggcccugugguacguguggcagguuaaaacgcagcgaagcggcgcacucugggacguacccucccccagcgccacgcagaaggccacucuguccgaggggguauaucgcauaaugcagcgggguuuauucgggaagacccaggugggcgucgguauccacauggagggcguguuccacacuauguggcauguaacgcgcggcagcgucaucugucacgagacagggcggcucgagccgagcugggcggaugugcggaacgacaugaucuccuacggcggggguuggcgccugggggacaagugggacaaggaagaggacguacaaguucuggccauugaacccgggaaaaaccccaagcacgugcagacuaagcccggccuguuuaagacccugacuggagaaaucggcgccgugacucucgauuucaagccggguaccucuggcucacccaucauuaacaagaaggggaaagucaucggguuauacggcaaugguguuguaaccaagucuggggacuacgucagugcaauuacgcaggccgaacggaucggggagccagacuacgagguggacgaggauaucuuccgcaagaagaggcucaccaucauggaccugcacccgggcgcgggcaagaccaagcgcauccuucccuccaucgugcgugaggcacugaaacgcaggcuucgcacccucauccuggcacccacacggguaguggccgcugagauggaggaggccuuaagaggucugcccauucgguaccaaacaccugccgucaagucagaacacaccggucgcgagaucgucgaccuaaugugccacgccaccuucacaacucggcugcuguccucaacccgcgugcccaacuacaaucucaucgucauggaugaggcccacuucaccgaccccugcucgguggcggcccggggcuacaucucgacgcgugucgagaugggugaggccgccgcgaucuucaugaccgcgacgccccccgggagcauagacccuuucccccaguccaacucucccaucgaggacauagagcgggagaucccggagagauccuggaacacuggcuuugauuggaucacggauuaccagggcaagaccgucugguucguuccaagcaucaaggcggguaacgacauugccaacugccugcgcaaguccggcaagcgcguuauccagcuuucccgcaaaaccuucgauaccgaguauccaaagacgaaguugaccgacugggacuucgugguuaccaccgacauauccgaaaugggugccaacuucagggccggccgcgugaucgacccccgacgcugucugaagcccgucauccugacggacgggcccgagcgagugaucuuggcuggacccauuccugugacccccgccagcgcugcucagcgccguggccgcaucggacggaaccccgcccaggaggaugaccaguacguguucuccggagacccacugaagaacgacgaggaccacgcgcauuggaccgaggccaagaugcugcuagacaacaucuauacacccgaggggaucaucccgacgcuguucggucccgagcgcgagaaaacccaagccauugacggugaguuccgccuccgcggggaacagcguaagaccuucguggagcucaugagacguggcgaucugcccgugugguuaagcuauaaaguagccucagccgggauuagcuauaaggaucgcgagugguguuucaccggcgagaggaacaaucaaauccuagaggagaacauggagguggagaucuggacgcgcgagggggagaagaagaagcugcggcccaaauggcuggacgcccgcguguacgcugacccgauggcgcucaaggacuucaaggaguucgccuccgggagaaagagcaucacgcuagauaucuuaaccgagaucgcgacccuccccacguaccuguccaguaaagcuaagcuggcucuggauaacaucguaaugcuucacacuaccgagaaaggcgggcgcgccuaucagcaugccuugaacgaacucccagagucccuggagacccucaugcucguggcccugcugggcgccaugacggccggcauauuccuguucuucaugcagggcaagggcaucggcaagcugagcaugggcuugauugccaucgcgguggccucagggcuccugugggucgcggaaauccagccucaguggaucgcugcgagcaucauccucgaguucuuccucaugguccugcugauaccggagcccgagaaacagcgaacgccccaggacaaccaacucauauacguaauccugaccauccugaccaucauaggccucauagcggccaaugagauggggcuuaucgaaaagacuaaaacugacuucggcuucuaccagguuaagccggaaacgacgauccuggauguggaccuuaggcccgccagcgccuggacucuguacgccguugcgacgaccaucuugacccccaugcuucggcacaccauagaaaacacguccgccaaccugaguuuagccgccaucgccaaucaggccgccguccucauggggcugggcaagggcuggccacugcaucggauggaccucggggugccguuacuggccauggggugcuacucccaaguaaaccccaccacccucaccgccagccucgucaugcugcucguccauuacgccaucaucggacccggccuacaggcaaaggcaacacgcgaggcccagaagcggaccgcugcggggaucaugaagaaccccaccguggacgguaucaccgucaucgauuuggagccgauuucguacgaccccaaguucgaaaagcagcugggccaagugaugcugcugguguuaugcgucgggcaguugcugcucaugcgcacgaccugggcccugugugaaguacucacccucgccaccggccccgugaugacccuuugggaggggaaccccggucgguucuggaauaccaccaucgccgucagcacagccaacauauuccgaggcuccuauuuagcaggagccggccuugccuucagccugaucaagaacgcccaaacgccgaggcgcggcaccggcacgaccggggagacgcugggcgagaaguggaagagacagcucaacucacuggacagaaaggaguucgaggaguacaagcggagcggcauucuggagguggaucgcacugaggccaagagcgcgcugcgggacgggaccaagaucaaguacgcagugagucgcggcuccagcaagauccgguggauugucgagcgcggcaugaucaagccgaaaggaaaagugguagaucuggggugcggccggggcggguggagcuauuauauggccacccuaaaaaacgucaccgaggugaaaggcuacacgaagggcgggcccggccaugaggagcccaucccgauggccaccuacggguggaaccuagugaagcugcauagcggcguagacguguucuauaagcccaccgagcaaguagacacacuguuaugugacauaggggaaucuucgucgaaucccaccauagaggagggucgcaccuuacgugucuuaaagaugguggaaccauggcucucaucuaagccggaguuuugcaucaaggugcuaaaccccuacaugccgacugugaucgaagagcuugagaagcuccagcggcgccacgggggcucccuggugcggugcccccugagccgcaacuccacucacgaaauguacugggucagcggagccuccgggaacaucgugucuucagugaacacgaucucgaaaaugcugcucaacagauucacgacacggcaccggaaaccgacguacgagaaggacgucgaccugggugcaggaacgcguuccgucuccacugagaccgaaaagcccgacaugaccgugaucggccggcguuuacagcggcuccgcgaggagcacaaagagacguggcacuacgaucaggaaaaccccuaccggaccugggccuaccaugggagcuaugaggcaccgagcacggggagugccagcuccauggucaacggcguagugaaacuguuaaccaagccuugggauguuauccccaugguaacccagcucgcgaugaccgacaccacccccuuuggccagcagcgcguguucaaggagaaggucgauacucggacaccgcagcccaagcccggcacccguaugaucaugaccacgaccgccaauuggcugugggcauuacucggaaagaagaaguccccacggcugugcacaagggaagaauucaucuccaaggugcggagcaacgccgccauaggcgcgguguuccaagaagaacagggguggaccagcgccagcgaagccgucaacgacucccgcuucugggagcucguggacaaggagcgggcccuacaccaggagggcaagugcgaguccugcguguacaauaugaugggaaaacgcgagaaaaaacuaggggaguucgguagagcuaaggguucccgggcgauaugguacauguggcugggcgcccgcuuucucgaguuugaggcccugggguuucuuaacgaagaccacugguucucacgagagaacucguggagcggggucgagggggaggggcuccaccgccugggcuacauccuggaagacaucgacaagaaggacggggauuugauauacgccgaugacacagccggcugggacacccggaucaccgaggaugaccugcuuaaugaagaacucaucaccgagcagauggcaccacaccacaagacuuuggcuaaggcgaucuucaagcugaccuaccagaacaaaguggugaagguucuccgacccacucccaagggcgccguaauggacaucauaagccggaaggaccagcgcggauccggccaggugggaaccuacggcuuaaacacauucacgaacauggaaguccaacugauccggcagauggaagcggaaggcgugaucacucaggacgacaugcaaaaccccaagggccucaaagaacgcguugagaaguggcuaaaggaaugcggcguugacaggcugaaacgcauggccaucuccggggaugacugcguaguaaagccgcucgacgagcguuucucuaccagcuugcuguuccucaacgauaugggcaagguucgcaaggacauuccccagugggagccgucgaaaggguggaagaacuggcaggaggugccuuucugcagccaucauuuccacaaaaucuucaugaaggauggacgguccuuaguaguuccgugucgcaaucaggacgagcugaucgggcgggcacgcaucagccagggagccggcuggucccugcgggagaccgcuugcuuagggaaggcuuacgcccaaauguggucacugauguacuuccauaggcgcgaccuccgccucgccucgauggcuaucugcagcgccgugcccacugaaugguuucccaccucgcgcaccaccugguccauccacgcucaccaccaguggaugacgaccgaagacaugcugaaagucuggaaucgggucuggaucgaagauaaccccaacaugacggacaagacgccugugcacagcugggaggauauccccuaucucggcaagcgggaagaccucugguguggguccuugaucggcuugaguagcagagccacgugggcuaagaacauccacacagccaucacccaggugcgaaaccuuaucgguaaggaagaguaugucgacuacaugcccgccaugaagcgguacucagcgccuuucgaguccgaaggcguucuguga

SEQ ID NO: 26283 - RNA, 9867 nt, Artificial Sequence
  derived and/or modified CDS sequence (opt11) from DENV-4__JN638570__SS-prME
ucaacgaucacccuauuaugccuuauccccacggucauggccuuccaccuaucaacgcgagacggggaaccccuaaugauaguugcaaaacacgaaaggggccgcccccuucuguuuaaaaccacagaagguauuaacaaaugcacucugaucgcuauggaucucggugaaaugugugaagacacagucacguauaaauguccccuacucguaaacaccgaaccggaagacauagauugcuggugcaaccucacaucagcauggguaauguaugguaccugcacccaaagcggggaacgcaggcgugaaaagcggagcguggcacucacaccccacucgggaaugggccuagaaacgcgagccgaaacguggaugucgucagaaggagccuggaagcacgcacagcgggucgaaagcuggauccugcgcaacccgggauucgcacucuuagcgggauuuauggcguacaugaucggucaaacagggauucaacgaacaguuuucuuuauacucaugaugcuagucgcgccaagcuacggcaugcgcuguguaggcguugggaauagggauuucgucgaaggcguuagcgggggcgcuuggguagaccuaguacuagaacacggcgggugcgugaccacgauggcgcaagguaaacccacccuggacuucgaauuaaucaaaacgacagcaaaagaagucgcacugcuacgcacauacugcaucgaggcuucaauauccaacauuaccacugcgacaagaugccccacucagggcgagccuuaccucaaagaagaacaagaccagcaauacaucuguagacgggauaugguugauagaggcugggggaacggaugcggccuuuuuggcaaagguggcguaguaacgugugccaaauuuucuugccucgggaaaauuacaggaaaccugguccaaauagagaacuuagaauacacagucgucguaaccguacauaacggugacacgcaugcagugggcaaugacacauccaaccauggggucaccgcgacgaucacaccaagguccccuagcguagaggugaaacugccagauuacggcgagcuuacucuagacugcgagccccgaucagggaucgacuucaaugaaaugauacucaugaaaaugaaaacgaaaacguggcucguccauaaacagugguuccucgaccugccacuaccguggaccacaggggcggauacacuagaaguacacuggaaccacaaagagaggaugguaacguucaaagugccacacgccaagcgucaagacgucacaguucuaggcucucaagaaggggccaugcacagugcucucgcaggagcaacagaagucgacaguggcgauggaaaccacauguucgcugggcaccucaagugcaaagugcgcauggagaaacuucgcauuaagggcaugagcuacacaaugugcagcggaaaauuuucgauagauaaagagauggcagagacucagcacggaacaaccguaguaaagguaaaauaugaaggaacaggagccccauguaaggugccaauagaaauccgggacgucaacaaagaaaaggucgugggccgaaucauaucuagcacaccuuucgcagaaaacacaaacaguguaacaaauauugaacuagagccgccauucggcgauagcuauaucguaaucggcguuggcgacggcgcccugacccugcauugguuuaggaaaggcuccagcaucgguaaaauguuugaguccaccuacagaggggcuaaacgaauggccauacucggcgaaacagccugggacuucgguagugugggaggacuccucacgagccuuggaaaagccguacaccagguguuuggcucuguauacacuaccauguucggaggugucuccuggaugguccguauauuaauaggacugcucguacuauggauagggacaaacagccguaacacaagcauggcaauguccugcaucgcggucggcggcaucacacuguuccuuggcuucaccguucacgcggacaugggcugcgucguauccuggagcggaaaggaacugaaaugugggagcggaauauuuguaaucgacaacguucauacauggacagaacaauacaaguuccaaccagagucccccgcccgcuuggcguccgcaauccuaaacgcucacaaagaaggcgucugcgguauucgcucaacaacacggcuagaaaacguuauguggaaacagaucaccaacgaacuaaacuacguccuaugggaaggcggucacgaccuaacaguagucgccggcgacgugaagggagugcucucaaaaggcaagagagcguuagcaccacccguaaacgaccuaaaauacucuuggaaaacgugggggaaggcgaagauuuucaccccagagaccaggaacagcacguucuuggucgacggaccggacacaucagagugcccgaaugagaggagagcauggaacuuccucgaagucgaagacuacggcuucggcauguucacaaccaacaucuggaugaaauucagagaagggagucccgaaguaugugaccacagacuaaugucagcggccaucaaagaucaaaaagccguacaugcggacaugggcuacuggauagaaaguagcaaaaaccaaaccuggcagaucgaaaaagcgucacucauagaaguaaagaccugccuauggcccaaaacucacacacuguggucgaauggaguacucgaaagccaaaugcugauaccaaaggcauaugcgggaccaauaucacaacacaacuacagacaaggauaugcaacccaaacugccggccccuggcaucucggaaagcuagagaucgauuucggcgagugcccagguacgacagucacaguacaagaagacugcgaucacagaggacccaguuugcgcacgacuacagcaaguggcaaauuaguuacacaauggugcugucggucuugcaccaugccaccgcuucgauucuuaggcgaagauggaugcugguacgggauggaaauccguccucucaacgaaaaagaggagaacauggucaaaagucaggucagcgccggacaagggacaagugaaacguucagcaugggacuacuaugccuuacacuuuuugucgaagaaugucuuagacggcgaguaacgcgcaaacacaugauguugguaguaguaaccacguugugcgcaauuauccuugguggucugacguggauggaccuccugagggcgcugauuaugcucggagauaccaugucgggcagaauggguggccaaauucaucuggcaauaauggcuguauucaagauguccccgggcuacguguuaggaauauuccuuagaaaauuaaccagcagagagacggcucugauggugauaggcauggcaaugacgacaguccuagccauuccgcaugaccucauggaguucaucgacggaaucucgcugggccuaauccuucuaaaaauggugacacacuuugacaauacacaaguugggacgcuugcacuagcacugacauucauaaaaucaacgaugccccuugucauggcauggcgcacgauaauggcaguucuauucgucguaacacuaaucccacucugccgcacgucaugucuacagaaacagucccacuggguugaaauaacugcacucauccuaggggcccaagcacugccaguauaccugaugacucucaugaaaggcgccucaaaaaggaguuggccacugaacgaagggaucauggcagucggacuggucucgcuacuggguagugcccuacucaaaaacgacgugccacuggccggucccauggucgcgggcggccugcugcucgcggccuacgugauguccggaagcucggccgaccucucgcuggagaaggcugcaaacgugaggugggacgaaauggccgacauuacggggagcucacccaucaucgaagugaaacaagacgaagacggauccuuuuccauacgcgacguagaagagacgaauaugaucacauugcugguaaagcuagcacuuauaaccguaucgggauuauacccccuagccauaccagucacgaugacccucugguacauguggcaagugaaaacucagcgaagcggagcauugugggacgucccaucacccgccgcggcacaaaaagccacgcucacggaaggcgucuacaggauuaugcaacgcggacuauuuggcaaaacacaagugggcguuggaauccauacggaaggugucuuccacaccauguggcacguaaccagagguagcguaaucugccacgagucaggccgguuggagccgucaugggcugacgugcggaaugacaugauuucuuauggaggcggauggcgccuaggagacaagugggacaaagaagaagacgugcaaguguuagcaauagagccaggcaaaaacccaaagcauguucaaacgaaaccuggccuauucaaaacccugaccggcgaaauaggcgcuguaacacuggauuuuaagcccggaacauccggaucaccaauaauaaaucgaaaaggaaagguaaucggucuuuacggcaacgggguugucacgaaaagcggggauuacgucuccgcaauaacacaagcagaacggauaggcgaaccggauuacgaaguugacgaggacauuuuccgaaagaagagacugacgauaauggaccuucacccaggggccgguaaaaccaaacgcauucuaccaucaauaguaagagaagcacucaaaagacgguuacgaacacuuauacuggcccccacaagaguaguagcugccgaaauggaggaagcccucagggggcuacccauacgauaccagacgccagcugugaaaucagaacacaccggcagggagauugucgaucuaaugugccacgccacauucacaacccgccugcuuagcucaacgagagucccgaacuacaaccugaucguaauggacgaggcccauuuuacagacccuagcucuguagcggcgcgaggcuauauuucaacgagaguggaaaugggcgaggcugccgcaauauucaugacugcgaccccgccggguacgaccgacccuuucccucaaagcaauagcccuauugaagauaucgagagagaaaucccugaacggagcuggaacacggguuucgacuggaucacugacuaccaggguaaaacgguaugguucguccccuccauaaaagcaggaaaugacaucgccaacugccucaggaagaguggcaagaaaguaauacaacugagcagaaaaaccuuugacaccgaauaccccaaaacaaaacugacagauugggauuucgucguaaccacggacauaucagagaugggcgcgaacuucagagccggacgugugauugauccgcgaagaugccuaaaaccagucauacugacagacgggcccgagagaguaauacuugcuggaccgaucccgguaacucccgccucagcagcucaacggagaggucggauagggcgaaauccugcccaagaggacgaucaauacgucuucagcggggacccgcuacgcaacgacgaagaccacgcacacuggacugaagccaagauguugcuagacaauauuuacacaccugaagggaucauuccuacccuguucgggccagaacgcgagaagacccaagcaauagacggggaguucaggcuacggggagaacagcgcaagacguucguugaacugaugaggcggggagacuuaccgguauggcucaguuacaagguggcgagcgcagguauuagcuacaaagaccgagaauggugcuucaccggugaacgaaacaaccaaaucuuagaagaaaauauggaaguagaaaucuggacccgagagggggagaagaagaaacuacgacccaaauggcuagacgcccgcgucuacgcagauccaauggcauugaaagacuucaaggaguuugcgagcggacggaaauccauaacacuagacauauuaacggaaauagcaagucuucccaccuaccucucuucuagagccaaacuagcgcuggacaacaucgugaugcuccauaccacagaaagaggagggaaagccuaccaacaugcccucaacgaacuaccggaaagccuggaaacacucaugcuggucgcgcuccugggcgcaaugacagcuggcaucuuccucuucuucaugcaagggaaggguauaggcaagcuauccaugggauuaaucgccaucgcaguggcaucaggccuccuaugggucgcggaaauucaaccgcaguggauugcagcgucgaucauccuagaguucuuucuuaugguacuacucgucccagaacccgaaaaacaacgcaccccucaggauaaccaacucauuuacguaaucuuaacaauuuugaccauuauugcgcuagucgcggcgaacgagaugggccuaaucgagaaaacgaaaacggauuuuggcuuuuaccaaguaaaggccgagacaaccauacuugacguagaccuaagaccggcuagcgccuggacacucuacgcuguagccaccaccauucugacgccaaugcuuaggcacacaauagaaaacacuuccgccaaccucucucuggccgccaucgcgaaccaagcggcagugcuaaugggacucggcaaaggcuggccacuacaccggauggaccucgggguaccccugcuagcgauggggugcuauucacaggucaacccaacaacacugacugccucccucgucaugcugcuggugcauuacgcaauaauaggacccggacuccaagccaaggcaacccgagaagcccagaaaaggacagcugcgggaauuaugaagaaccccacaguagacggaauaaccguaauugaccuggaaccaauuucauacgaucccaaauucgaaaaacaacugggucaggugaugcuccuaguacucugcgcugggcagcuacuuuuaaugcguacgaccugggccuucugcgagguacugacccuugcaaccgggccgauccuaacgcucugggaaggcaaucccggacgguuuuggaauacgacaaucgccguguccaccgcaaacauauuccgugggagcuaccucgcaggggcuggacuagcuuucagccuuauuaaaaaugcccaaacgccccgucggggaacgggcacaacgggagaaacacugggagaaaaauggaaaagacaacuaaacagucucgaccggaaggaguucgaagaauacaagcggagcggcauacuagagguagacaggacggaagcuaagucagcgcuaaaagacggcuccaaaauaaaauacgcugucucacguggcaccaguaagauucgcuggauuguugagcggggaauggugaaaccaaaggggaaaguuguagacuuaggaugcggacgcggcggcuggaguuacuacauggcgacacucaaaaacguaacugaagucaagggauacaccaaagggggcccuggacacgaagaaccgaucccaauggcgacuuauggauggaaccuagugaaacuccauucaggcguggacgucuuuuacaaaccgacggaacaagucgacacacuucuaugugacauaggcgagucaagcagcaaccccacgaucgaggaaggacgaacucucagaguacuaaaaauggucgaacccuggcuguccagcaaacccgaguucugcauaaaaguacucaauccauauaugcccaccgugaucgaagaauuagagaagcuacaacgacguuacggcgguuccuuaguucgaugcccauuaagucggaauagcacacacgaaauguacugggugucuggcgugaguggcaacauaguauccucggucaacaccacaucaaaaaugcuucucaaccgguucacgacgcgacaucguaaaccaaccuaugaacgcgacgcugaccucggggccgggacgcgcucaguaucaacugaaaccgaaaaacccgauaugacgauaauaggaagacgccuucagcgccuccaagaagaacacaaagaaaccuggcacuacgaccaugaaaaccccuacaggaccugggcuuaucacggcagcuacgaggccccaucaacgggaucggcaucaucaaugguaaacggagugguaaaauuacucacaaaacccugggacguaguacccauggucacacagcuggcaaugaccgacacaacccccuucggccaacaacggguauuuaaagaaaaggucgacaccaggaccccgcagccaaaaccggguacccggguugugaugacaacuacggccaacugguuauggacacuccugggacgcaagaaaaacccccgcuuaugcacccgcgaagaguucaucaguaaggugcgaaguaacgcagcuaucggggcugucuuccaagaagaacaaggauggacgucagcguccgaggcggucaaugauagcagguucugggaauugguggacaaggagcgagcucuacaccaggaagggaaaugcgaaucaugcgucuauaacaugauggggaagagggagaaaaaguuaggugaauuugguagggcaaaagguucucgagccaucugguacauguggcucggagcgcgguuucuugaguucgaagcccucggcuuccuaaaugaagaccauugguuuggcagagagaacagcuggagcggggucgaaggugaaggccugcaccgucucgguuacauacuggaagauauagauaagaaagacggagaucucaucuaugcagacgacacggcggguugggauacacgcauuaccgaggacgaccugcugaacgaggaacucauaacagaacagauggcgccccaccacaagauacuugcaaaagcaauuuucaaacucacauaccaaaacaaaguagucaagguauuacggccgacaccaaagggagcagugauggacaucaucucccgcaaagaccagcgagggagcggccaagugggcacguauggauuaaacaccuucacaaacauggaagugcaguugauccgccaaauggaggcagaaggggugaucaccagagacgauaugcacaaccccaaaggccucaaagaaagagucgagaaguggcugaaggaaugugggguagaccggcuaaagcgaauggcaauaucuggagacgacugcguggucaaaccacuagacgagcgguuuagcacuucacugcuuuuccucaacgacaugggcaagguacgaaaagacauaccacaaugggaacccucuaaaggauggaagaauuggcaggaggucccguucuguucccaccacuuccacaagauuuucaugaaagauggccggucccuuguggugccuugucgaaaucaagaugagcuuaucggccgcgcacgaauaucccaaggcgcgggauggucccuccgcgaaacagccugucucggaaaagccuacgcccagauguggucucucauguacuuccaccguagagaucuacgccucgccuccauggcaaucugcagugccgugccgacagagugguuccccacaucgcguaccacguggucuauucaugcacaucaccaguggaugacaaccgaagauaugcuaaagguauggaacaggguauggauagaggacaacccgaacaugauagacaagacucccguccacucaugggaagacaucccauaccuagguaaacgagaagacuuguggugcggcucccuaaucggccugucgaguagagccacgugggcgaaaaacauccauacugcaaucacccagguacggaaccucaucgggaaagaagaauauguagauuacaugccagcgaugcgcagauauagcgcccauuuugaaucagagggcguucuguaa

SEQ ID NO: 26284 - RNA, 9867 nt, Artificial Sequence
  derived and/or modified CDS sequence (opt11) from DENV-4__JN638571__SS-prME
agcaccaucacccuccucugucugauacccaccgugauggcauuccaccuguccacccgcgauggcgagccgcucaugauaguggccaagcacgagcgggggcgcccacugcuguucaagaccaccgaaggcaucaacaagugcaccuugaucgccauggaucugggcgagaugugcgaggacaccgugacuuacaagugcccccugcucgugaacaccgagccugaggacaucgauugcuggugcaaucugaccucggccugggucauguacgggaccugcacacagucgggugagaggcgucgcgagaagcggagcguagcccugaccccgcacuccgggaugggccucgagacacgggccgagaccuggaugagcucagagggggcguggaagcacgcacagcgcguggagagcuggauccugcgaaaucccggcuucgcgcuucucgccggguucauggccuacaugaucggccagaccgggauccagagaacaguuuuuuuuauccucaugaugcuggucgcgcccuccuauggcaugcggugcguaggcgucgggaaccgcgacuucguagagggggugagcgguggggcguggguggaccuggugcuggagcacggcgggugcgugacgaccauggcccagggcaagccgacccuagacuucgagcucauaaagaccacggcaaaggaggucgcccuacuaagaaccuacugcaucgaggcguccaucucuaacaucacgaccgccacgcgcuguccgacccagggggaaccguaucucaaggaggaacaggaccagcaguacaucugccgacgggacaugguggaccggggcugggggaacggcuguggccucuucgguaaggggggggugguaaccugugccaaguucucaugccugggcaagaucacggggaaccuuguucaaauugaaaaccuagaguauacaguggucgugaccgugcacaacggcgacacccacgccgucggcaacgacaccagcaaccacggggugacagccaccauaacgccaaggucccccucgguagaagugaagcugccggaauacggcgaacucacccuggacugcgagccccgguccgggauugacuucaacgagaugauccugaugaagaugaagacgaagaccuggcuuguacacaagcagugguuccuggaccuaccgcucccauggaccacuggcgcugacacguuggagguacacuggaaccacaaggaaaggauggucacguucaaagucccgcacgccaagagacaggacguuaccguguuggguagccaggagggggcuaugcacucagcacuagcuggcgcgaccgaggucgacagcggcgacggcaaccacauguuugcaggacaccugaagugcaaggugcgcauggagaaauugagaaucaaaggcaugaguuacacgaugugcucgggaaaauucagcaucgauaaggagauggccgagacgcagcacggaaccacuguagugaaggucaaguacgagggcaccggggcacccugcaaggugccaaucgagauccgggaugucaacaaggagaaggucgugggccgcauaaucuccuccacccccuucgccgagaacacgaauucugugaccaacaucgaacucgagccgcccuucggagacaguuacaucguuauuggggugggcgauggggcgcuuacccugcacugguuccguaagggcaguucuaucgggaagauguuugaguccacuuaccguggcgcgaagcggauggccaucuuaggagagaccgcaugggacuucggcagcgucggcggguuacugaccucccucggaaaggcgguccaccaaguguucggcagcguuuauacgacgauguucggcggggucuccuggaugguucgcauccugaucggcuuacuggugcuuuggaucggcaccaacagucggaacaccuccauggccaugaguugcaucgcgguggguggcauuacccuguuccugggguucacgguacacgccgauaugggcugcgugguuuccuggagcggcaaggaacucaagugcggcuccggcaucuucgugaucgacaauguacacaccuggaccgaacaguacaaguuccagcccgaaagcccagcaaggcuagcgagcgccauucuuaacgcucauaaggagggggucugcggcauacgauccacuacuaggcucgagaacgugauguggaagcagaucaccaacgaacucaacuaugugcuuugggagggcgggcacgaccucaccgucguggcgggcgaugugaaaggaguacugagcaagggcaagcgggcgcuggcaccgcccguuaaugaccucaaguacagcuggaagaccuggggaaaggccaaaaucuucacgccggagaccaggaauagcacauuccugguggacggccccgacaccuccgaguguccgaacgagcggcgcgccuggaacuuucuggagguugaggacuacggguucggcauguucacgaccaacaucuggaugaaauuccgggaggguucaucugaagugugcgaccaccgccucaugagcgccgccaucaaggaccagaaggcggugcacgccgacaugggguacuggauugaaucgucuaaaaaccagacauggcagauagagaaagccucccugaucgaagucaagacuugucuguggcccaagacgcacacccucugguccaacggcguguuggagucccagaugcugaucccuaaggccuacgcggggccaaucucgcagcacaacuaccgucagggcuacgccacccagaccgccgggcccuggcaccucggcaaacuggagaucgacuucggagagugccccggaaccacggugaccguccaagaggacugcgaucaccgcggccccucccuacggaccaccacggcuagugggaagcucgugacucagugguguugccgcuccugcaccaugccgccucugcgcuuccugggagaggauggcuguugguacgguauggaaauccggccacucaaugagaaggaggagaacauggugaagucgcaggucagcgccggccaggggaccucggagacguucucaaugggacuguuguguuugacccuauucguggaggaaugcuuaagacggcgagucacccggaagcacaugaugcuagugguggucaccacgcugugcgcgaucauccucgggggcuugaccuggauggaccuguuacgcgccuugaucauguugggcgauaccaugucggggcggaugggcgggcagauccaccuugccauaauggccguguucaaaaugucccccggcuacgucuuagguaucuuccuucgcaagcugaccucccgggaaaccgcccucauggucaucgguauggcuaugaccacagugcuggccaucccucacgaccugauggaguucaucgacggcaucucacucggacugaucuugcucaaaauggugacacauuuugacaacacgcaggucggcaccuuggcccuggcccucaccuuuaucaaguccaccaugccccuggugauggccuggcguacgauaauggcggugcuguucgucgugacccucauaccccugugucggaccagcugccugcagaaacagucccacuggguggaaaucaccgcccucauccuuggugcccaggcgcugcccgucuacuugaugacgcuaaugaagggcgcgagcaagcgcuccuggccgcuuaacgaggggauuauggccgugggccuagugucacugcugggcagcgcccuccugaagaacgacguuccucuggcuggaccgaugguggcggggggucuccuguuagcugcauacgucaugucuggcucaagcgcugaccucucccuggagaaggccgccaacguccggugggaugaaauggcggacaucaccgggagcucccccaucaucgaagugaagcaagacgaggacggcagcuucagcauacgcgacguggaggagaccaacaugauuacgcugcuggucaaacuggcacugauaaccguguccggcuuauauccucuggccaucccagugacaaugaccuugugguacauguggcaggugaagacccagcggagcggggcccucugggacguccccucccccgccgccgcccaaaaggcuacgcuaaccgagggcguguaucgcaucaugcaacgggggcuguucggaaagacccaggucgggguggggauccacaccgaaggcguauuucacacuauguggcacguaacgcgcggcucaguuaucugccacgaaagcggccgguuagagccuagcugggcagauguuaggaacgacaugaucuccuaugguggcggcuggcggcugggggauaagugggacaaggaggaggacguccaggugcuggcgaucgagcccggcaagaacccgaagcacgugcagaccaagcccggguuauucaagaccuuaaccggcgagaucggggcgguaacgcuggacuucaagcccggcacgucaggcucccccaucaucaaccgcaaggggaagguuauaggccucuacgggaacggcguggucacuaagagcggggacuacguuuccgccaucacucaggccgagcguaucggcgagccggacuacgaagucgaugaggauaucuuccggaagaagcgccugacgaucauggaucugcacccgggcgcagggaagacaaagcggauccugcccagcaucguccgcgaggcgcugaaaagacgccugagaacccugauccuagcccccaccagaguuguggccgccgagauggaggaggccuuacguggcuugcccauccgcuaucaaacgccggcggucaaguccgaacacaccggacgugaaauaguggaccucaugugccacgccacguuuaccacgcgacuguugucuaguacccgggugcccaacuacaaucucauuguaauggacgaggcacacuucaccgacccgucauccguggccgcccggggcuacaucucuacacgggucgaaaugggggaggccgcggccaucuucaugacggccacgccaccgggcaccacagaucccuuuccccaguccaacucgcccaucgaggacauugagcgcgagaucccggagcggucuuggaacacggguuuugacuggaucaccgauuaucaagggaagaccguaugguucguacccaguaucaaggccggcaacgacaucgcaaacugccugcgcaagagcggcaagaaggugauccagcugucccgaaaaaccuucgacacggaauacccgaaaacaaagcucacugacugggacuucguggugaccacggacaucuccgagaugggggccaacuuccgcgccgggagggucauugacccccggcgcugccugaagccggugauccuuaccgacggcccagagcgggugauucuagcuggccccauuccagucaccccagcuuccgccgcccagcggcgcgggcgcauuggcaggaaccccgcccaagaggacgaccaguacguguucucuggcgacccccugcgcaacgacgaagaucacgcccacuggacggaggcgaaaaugcugcucgacaauauauacacacccgaaggcaucaucccgacccuguucggcccugagcgggagaagacccaggcuaucgauggugaguuuaggcugcggggagagcagcguaagaccuuuguggagcucaugcgucggggugaccuccccgucuggcuguccuacaagguggccagcgccggcaucaguuacaaggaccgggaguggugcuuuacgggggagcgcaacaaccaaauccuggaggagaacauggaaguggagaucuggacgcgggagggugagaagaagaagcugaggccgaaguggcuggacgcccggguguacgcggacccgauggcccucaaagacuuuaaggaguucgccuccggccgcaaguccauuacccuggacauccugaccgagaucgccagccuucccaccuaccugaguucucgggccaagcuggcgcucgacaacauugugaugcuucacacgaccgagcgcggagggaaggccuaccagcacgcacugaacgagcuccccgagucccuggagacccugaugcucguggccuuacugggggcaaugaccgcagggaucuuccucuuuuucaugcaggggaagggcauaggcaagcugagcaugggguugaucgcaauugccguagccagcggccucuuguggguggcggagauucaaccgcaguggauagccgcgagcauuauccuggaguuuuuccuuauggugcuccugguccccgagcccgagaagcagcgcacgccccaggauaaccagcucaucuacgugauccugaccauccugaccaucauugcccucguggccgcuaacgagaugggucuuauagagaagacgaagacggacuucggguucuaucaggucaaggcugaaaccacaauccuggacguggaccuucggccggccucggccuggaccuuauacgccguggcgaccaccauccuaacgcccaugcuccgccacaccauagaaaacacgucugccaaccugucuuuagcagccaucgcaaaccaggcggccguccucaugggcuuggggaaaggauggccccugcaccggauggaccugggggugccccuucuggcgaugggcugcuacucacaggugaacccgaccacccucaccgcaagcuugguaaugcugcucgugcacuacgcgaucaucgggccaggccuccaggccaaggccacgcgcgaagcccaaaagcggaccgccgccgguaucaugaaaaacccaaccgucgacgguaucaccguuaucgaccuggaacccaucaguuaugacccgaaguuugaaaagcagcucggccaggugaugcuacuagugcucugugccggccagcuguugcucaugcgcacgaccugggccuucugcgagguccuaacccuggccaccggccccauccucacgcugugggaaggaaaccccggcagauucuggaacaccaccaucgcugugagcaccgcgaauaucuucaggggcuccuaccuagccggggccggccucgccuucagccuuaucaagaacgcccagacuccccgacgcgggaccggcacgaccggcgagacgcucggcgagaaguggaagcggcaacucaacucacuggaccgaaaagaguucgaggaguacaagcgguccggaauccuggaagucgaccgaacagaagcgaaguccgccuuaaaggacggaucaaagaucaaguacgcagucucccggggcacguccaagauccgcuggaucguggaaagaggaauggugaagccgaagggcaagguaguggaccuagggugcggucgcggcggaugguccuacuacauggcuaccuugaagaacgugacagaggucaagggcuauaccaagggcggcccugggcacgaagagccuaucccaauggcgaccuacggcuggaaccucgugaaacugcauagcggcguggacgucuucuauaaaccgaccgagcaggucgacacccuucucugcgacauaggagaaaguagcuccaaccccacgaucgaggagggccggacccugcgugugcugaaaauggucgagcccuggcucucguccaagcccgaguucugcaucaaggugcucaacccguacaugcccacaguaaucgaggaacuggagaaacuccagagacgguacggcggcagucucguucgcugcccucucagccgcaacaguacccacgagauguacuggguaagcggcgucuccgggaacaucgugagcucggugaacacgaccagcaagaugcuucucaaccgguuuacuacacgacaccgcaagccaacauacgagcgggacgccgaccugggcgccgggacccgcuccguuagcacugagacggagaagccggacaugacgaucaucggccggcgccugcaacggcugcaagaggagcacaaggaaaccuggcacuacgaccacgagaaccccuaccggacgugggccuaccacgggaguuacgaggccccguccaccggcuccgcgucuuccauggugaacggcguggucaagcugcugacgaagccgugggacguggugccuaugguuacccagcuggccaugaccgauacaaccccuuucggccagcagcggguguucaaggagaaaguggacaccaggacuccccagccgaaacccgguacccgggucgugaugaccaccaccgcuaacuggcucuggacccuucuggggcgcaagaagaacccccggcuguguacgcgcgaggaauucaucagcaaggugcggcugaacgccgcgaucggcgcgguauuccaggaggagcaaggguggaccagcgcgagcgaggccguaaacgacucccgcuuuugggagcuaguggacaaggagcgggcccugcaccaggaggguaagugcgagucaugcguauacaauaugauggggaagcgcgagaagaagcugggggaauucggacgcgccaaaggguccagggcgaucugguacauguggcucggggccagguuccuggaauuugaagcgcugggauuccucaaugaggaccacugguucggccgggagaauagcuggucuggcguggagggggaggguuuacaccgccugggguacauucuggaggauaucgacaagaaggacggagaccugauuuacgccgacgacaccgcgggcugggauacucggaucacugaggaugaccuccucaaugaggaacuuaucaccgagcagauggcgccccaccacaagauacuagcgaaggcuaucuucaagcucacuuaccagaacaagguggucaaggugcugcgcccgaccccuaagggggccgugauggacaucauaucccggaaggaccagcgaggcucaggucaggucgguaccuacggcuuaaacacguucaccaacauggaggugcagcucauccggcaaauggaggcggagggcguaauuacgagagaugacaugcacaacccuaagggccugaaggaacguguggagaaguggcugaaggaaugcgggguggaccgccucaagcggauggccauuuccggcgacgacuguguagucaagccccucgaugagcguuucagcaccucccuucuguuucuuaaugacauggggaaggugcggaaggacaucccgcagugggagcccagcaaaggcuggaagaacuggcaagaggugccguuuugcucccaccacuuccacaaaaucuucaugaaggaugggcgcagcuuagucgugcccugucggaaucaggaugagcucaucggucgcgcccgcaucucccagggugcaggcuggucgcugcgcgagacggccugccugggcaaggcauacgcccagauguggagccucauguacuuccaccggcgugaccugcgccuugcgucuauggcgauaugcuccgccgugccgaccgagugguuccccacuagcagaaccaccugguccauccacgcccaucaccaauggaugaccaccgaggacauguuaaaagucuggaaccgcguguggaucgaggacaaccccaacaugaucgacaagacccccgugcacagcugggaagacaucccguaccuggggaagagggaggaccuguggugcggcucccucaucgggcuguccucgagggccacgugggccaagaacauccacacagcgaucacccagguccggaaucuuaucggcaaggaggaguauguggacuacaugccagcuaugcgccgguacucggcgcacuuugagagugagggcgugcuuuga

SEQ ID NO: 26285 - RNA, 9867 nt, Artificial Sequence
  derived and/or modified CDS sequence (opt11) from DENV-4__JN638572__SS-prME
ucgacgauaacccuccucugccugauucccaccguaauggccuuccaccugucgacacgagauggggagccgcuaaugauaguagcaaaacaugaacgugggcgcccacuccuguuuaaaaccacagaagggauuaauaaaugcacacucauagcgauggaccuaggcgaaaugugugaagacacgguaacauacaagugcccacuccucgugaauacggaacccgaagacaucgacugcugguguaacuugacaagcgcaugggugauguacgggacuugcacccaguccggggaacgccgcagagagaaacggaguguggcccugaccccacacucagguaugggccucgaaacaagagcggaaacguggaugagcagcgaaggcgccuggaaacacgcccaacgagucgaaagcuggauucuccgcaauccaggguucgcuuugcucgcgggcuucauggcauauaugaucggccaaacagggauccagcgaacagucuucuucauauuaaugaugcuagucgcaccuaguuacggaaugcgcugcguaggagugggaaaccgagauuucguagagggagucagcggaggugcuuggguggaccuagugcuagagcauggcggaugcgucaccacaauggcccaagguaaacccacacucgacuucgaacucauuaaaaccacagcuaaagaagucgcacugcuucggacauacuguaucgaagcaagcaucucaaacauaacgaccgcaacacgcugccccacccaaggugagcccuaccuuaaagaagaacaagaccaacaguacaucugccgccgagacaugguggauagaggguggggaaacggaugcggacuuuucgggaaaggaggcgucguaaccugcgcaaaguuuaguugccucgggaaaauaacugggaacuuagugcaaauagaaaaccuggaauacacgguggucgucaccgugcacaauggcgacacucaugcaguagguaacgacacaagcaaucacgggguuacagcgaccauaacaccgagaagcccaucgguagaaguaaagcuccccgaguacggugaauuaacacuagacugcgagccacguuccgguaucgacuucaacgaaaugauacuaaugaaaaugaaaaccaaaacguggcucguacauaagcaaugguuccuggaccuaccgcucccauggacaacgggggccgacacccucgagguacacuggaaccacaaagaaagaauggugaccuucaaaguaccgcacgcgaaacgccaggacgucaccguauugggaucacaagaaggugcgaugcacagugcccuagcaggggcaacagaaguagauuccggggacgggaaucacauguucgcgggucaccuuaaauguaaaguacgaauggaaaaacucagaauuaaagggauguccuauaccauguguuccggaaaauucucaaucgacaaagaaauggcagaaacacaacaugguacaacggucgucaagguaaaauaugagggcaccggagcaccgugcaaggucccaaucgaaaucagagacguaaauaaggaaaaaguaguaggaagaauaauuucgagcacuccuuucgcagaaaacaccaacagcguaaccaauauagaauuggagccgccuuucggggauagcuauauagucaucggaguuggcgauggcgcacugacacugcacugguucaggaaaggaagcuccauuggcaagauguuugaaucaacguacagaggagcaaaaaggauggcaaucuuaggcgaaaccgcgugggacuuugguagugucggaggguuauugaccuccuuaggaaaagcgguccaccaagucuuuggcagcguauauaccaccauguucggcggcguuucuuggaugguucgcauccugauuggccuacugguacuauggauuggaacgaauagccgaaacacaucgauggccaugagcugcauugcagucggugggauuacgcuguuuuugggauucaccguccaugccgacaugggcugcguuguuuccuggucaggcaaagaacuaaaaugugggagcggugucuucgugauagacaauguccacacauggaccgagcaguacaaauuccagccggaaagcccggcuagacucgcauccgccauacugaacgcucacaaagagggaguaugugggaucaggaguacaacacggcuagagaauguaauguggaagcaaaucaccaaugagcugaacuacgugcucugggaaggagggcaugaccuaacgguagucgccggcgacgugaaaggggugcucagcaaaggaaagcgagcgcucgccccucccguuaaugaccucaaauacucguggaaaaccuggggcaaggcaaaaauauuuacucccgaaacacgcaacuccacauuccuggucgacggccccgacaccuccgagugcccaaacgagagacgagcuuggaacuuucuagagguagaggacuacggcuuugggauguuuaccacaaacauuuggaugaaguuccgagaaggcucaucggagguaugcgaccauagacucauguccgccgcuauaaaggaccaaaaagcuguacacgccgauaugggcuauuggauagaauccuccaagaaccagaccuggcaaaucgagaaagccucauugaucgagguaaagaccugccuauggccgaagacccacacgcucuggagcaacggaguuuuagaaagucaaaugcuuauacccaaggcauacgcggguccaaucucccagcauaacuacaggcagggcuacgcaacccagacggccgggcccuggcaccuaggcaaacuggagauagauuucggcgaauguccaggaacuaccgugacgguccaggaagauugcgaccaccggggaccuagccuacgcaccacaacagcgagugguaaauuagucacacaauggugcugcaggaguugcacgaugcccccgcuacgguuccugggcgaagaugguugcugguacggcauggagauuagaccucucaacgagaaagaggaaaacaugguaaaaucccaagugagcgcaggccagggaacaagcgaaacauuuuccaugggccuucugugucuaacccuguucguagaagaaugccuaaggcgccgagucacccgaaaacauaugauccugguggugguuacaacccugugugccauuauccuuggcgggcuuacuuggauggaucugcucagggcacucaucaugcuaggagacacaaugaguggacgaaugggaggccagauacaccuagcaaucauggcugucuucaaaauguccccuggauacgugcuaggcaucuuccucagaaaacuaaccagucgagaaacugcgcugaugguaaucgggauggccaugaccaccguccuagccaucccacacgacuuaauggaguucaucgaugggaucucgcuagggcucauacuccucaagauggucacacacuucgacaacacacagguaggaaccuuagcuuuggcccucacauucauaaaaaguacaaugccccuagugauggcauggcgcacgauuauggcagugcuauucguagugacgcuuaucccacugugcagaaccagcugccugcagaaacaaagucacuggguagagauaacagcccucauacugggcgcccaagcacuccccguauaccucaugacucuaaugaaaggcgcaagcaaaaggucguggccacucaaugagggcauaauggccguggggcuugucagccuccuggggagcgcgcuccugaaaaaugaugucccauuagcagggcccaugguugcgggcggcuuacugcuggcagccuacguaaugagcgggaguucagcagaccucagccuggaaaaggcagccaacgugaggugggacgaaauggcggauauaacaggcaguagcccaauaaucgaagucaaacaagaugaggacgggucauucucaaucagggacguagaggagacuaauaugauuacccugcuaguuaagcuggcguugauaaccguaagcggucucuauccccuggcaauaccggucacaaugacucuuugguacauguggcaagugaagacacaacgauccggagcccuuugggacguccccucccccgccgcagcucaaaaagcgacccuaacggagggggucuacagaaucaugcaaagggguuuauuuggaaaaacccaagucgggguggggauucacacggaaggcguuuuccacacgauguggcaugucacaagaggaucugucaucugucacgaaucaggccgccuagagcccucaugggccgacguucguaacgauaugaucuccuacggaggaggauggcgccucggggacaagugggacaaagaagaagauguacaggugcuugccaucgaaccaggcaaaaaccccaaacacguacaaacuaagcccggguuguucaaaacgcugacuggggaaaucggugcgguaacucucgacuucaagccgggaacgagcgguucuccaaucaucaaccgcaaaggaaaaguaauaggacuauauggaaauggagucgucacgaaaucaggggacuacgucagcgcgaucacucaagcagaacgcauaggagagcccgacuaugaggucgacgaagacaucuucaggaagaaacggcuaacgaucauggaucuacaucccggagccgguaaaacaaaacgaauacugccaucaauagugcgcgaggcccuaaagcgucgucugcgaacccugauacuggcacccacccgaguuguggcagcagaaauggaagaagcccuaagaggcuuaccaauuagauaccagaccccugccgucaaaagugaacauacgggucgcgagauuguagaccuaaugugccacgccaccuucacuacgcggcugcucaguaguacaagagugccaaacuacaaccucaucgucauggaugaggcucacuuuaccgacccaagcuccgucgccgccaggggguacauaucaacccgggucgagaugggugaggccgcagcaaucuuuaugacggccacgcccccagggacgacagauccuuucccccaaaguaacucgccaaucgaagacaucgagcgggaaauuccagaacgauccuggaacacgggauucgacuggaucaccgacuaccaaggaaaaacagucugguuuguaccauccauaaaggccggaaacgacauagcgaacugccucaggaagucagggaagaagguaauacagcuaucccguaagacuuucgacacggaguacccaaaaaccaaacucacagacugggacuucguggucaccacugacaucuccgaaaugggcgcaaauuuccgggccggaagaguaaucgacccgcgacgcugucugaaaccuguaauacucacggauggaccagaaagagucauacuggcgggacccauacccguaaccccagcaucagcugcgcagcgacgcggccgcaucgggcgcaauccagcccaagaggacgaccaauacgucuucucuggagauccccuaaggaacgacgaggaucacgcccacuggacggaagcaaagaugcuacuagacaacauauacaccccagaggggauuauacccacacucuuugggccagagagggaaaagacacaagcgaucgacggagaguuuaggcuacgcggcgaacaaagaaagacuuucguggagcuaaugaggcggggagauuugccgguguggcuaaguuacaagguagcaagugcaggaauaucguacaaagaucgugaguggugcuucacaggagaacguaacaaucagauccuugaagagaauauggaagucgagauauggacaagagagggcgagaagaaaaagcuaagaccuaaguggcucgacgcaagaguguacgcggaccccauggcgcuaaaagauuucaaggaauuugcgaguggccgaaaaagcauaacucuagacauucucaccgaaaucgcgagccuacccaccuaucuuagcuccagagcuaaacuagcacuggacaauaucgucaugcugcauacaaccgagcgaggcggcaaagccuaccagcaugccuuaaacgagcuccccgagagccucgaaacacucaugcuggucgcacuacucggcgccaugacggcuggaauauuccucuucuuuaugcaaggaaaggggauaggcaaacuauccauggggcuaauagccauagccguggcuucagguuuacucuggguugcagaaauacagccccaauggauagcagccucgaucauacuugaguucuuucuuaugguccuccucguuccagaaccagaaaagcaacgaacaccccaggacaaucaguugauuuacgugauccucaccauacuuacuauaaucgccuuaguagcagcaaacgagaugggacugauagagaaaacgaaaaccgacuuugguuucuaucaggugaaagcggaaacaacgauucuagacguagaccuacgcccggcgucggcauggacacuauacgccgucgccacgacgauacucacacccaugcucaggcacacaauagagaacaccuccgcaaaccuaucccuagcggccauagcgaaucaagcagcaguccugaugggucucggaaagggguggccacuccacagaauggacuuaggcgugccauugcuggcaaugggaugcuacagccaagugaacccgaccacccuaaccgcuagccuagugaugcugcuaguccacuacgccauuauaggaccgggccuucaggcaaaggcaacacgcgaagcccagaaacguacugcagcggggauaaugaaaaauccaaccgucgacggaaucacggugaucgacuuggaaccuauuagcuacgacccaaaauucgaaaaacagcugggccaagucaugcuucuaguccucuguguagggcaauuacuucucaugcgaacaacaugggcacucugugaaguauuaacccuagcaacaggaccgauaaugacacuaugggaaggcaacccagggagauucuggaacacgacgaucgcuguaagcacagccaacaucuuccgagguuccuaccucgcgggcgccggacuggcauuuucccucaucaagaacgcccagacgccccgcagagggaccggcacgacaggagaaacguugggagagaaguggaaacggcaacuaaauucccucgaccgcaaagaauuugaagaauacaagcggucaggaauccuagaagucgaccgcaccgaagcaaaaagugcccuacgcgacggcuccaaaacaaaacacgccgucucucgaggaucaagcaaaauaagguggauagucgagcgcggaaugauuaaaccaaaagguaaggugguggaccucggcugcggaaggggcggcuggagcuacuacauggcaacguugcaaaacguuacggaaguaaaggguuacacgaaaggagggcccggacacgaagaaccgauccccauggcaaccuacggcuggaaccuaguuaaacuccacucaggaguagauguauuuuacaaaccuacagaacaaguagacacguugcugugcgacaucggcgagucauccaguaacccgaccauagaagaaggaagaacucugagggugcugaagauggucgagccguggcuaagcaguaaaccggaauuuugcauaaaagucuuaaacccuuacaugccaacagucauagaggaacuggagaagcugcaaaggcgcuacggcgggucacugguaagaugucccuugagccgaaacagcacacacgaaauguacugggugagcggcguauccgggaacauagucuccuccgucaacaccacaaguaagaugcuucuaaaccgauucacgacacgccacaggaaaccgacuuaugagagggacgcggaucuaggugcaggcacgaggucggucuccacagagacagagaagccggacaugacgauaauaggaagacgguuacaaaggcuccaggaagaacacaaggagaccuggcacuaugaccaugagaacccguaccgcaccugggcguaccauggcaguuaugaagcaccuagcacgggaagcgcauccaguauggucaacggggucgugaaguuguuaacaaaacccugggacguuguccccaugguaacgcaacucgcaaugacagacacaacgccauucggccagcaacggguauucaaagagaaaguggacacucgaacuccccaaccgaaacccggaacccgagucgucaugacgacaacagccaacugguuauggacauuguuagggagaaagaaaaacccuagacuguguacccgagaagaguucauuuccaaagucaggucaaacgcagcgauaggagccguuuuccaggaggagcagggauggaccagcgcuucagaggcaguaaacgauagucgauuuugggaguuagucgacaaagaacgagcccuacaucaagagggaaaaugcgagucguguguguacaacaugaugggcaagagggagaagaaacugggagaguucgggagagcaaaaggauccagggccaucugguacauguggcuaggagcgcguuuccuggaguuugaggcccuaggauuucuuaacgaagaucacugguucggccgcgaaaacagcuggucuggggucgaaggcgaagggcuacacagauugggcuauauccuagaggacaucgauaagaaagauggcgaccugaucuaugcggacgacaccgcggggugggacacccggauuaccgaggacgaucuacucaacgaggaauugauuacagaacaaauggccccgcaccacaagguucuggcgaaagcuaucuuuaaauuaacguaucagaacaaaguggucaaaguucucagaccaacaccaaagggagccgucauggacauaauaagccgcaaagaccagcgcggcuccggacaagugggaaccuauggcuuaaacaccuuuacaaauauggaaguccaacucauacgccaaauggaggcggagggaguuauaacacgcgacgacaugcacaaucccaaaggauugaaagagcgagucgaaaaguggcuuaaagaaugugggguagaccgucuaaagcgcauggcaauaucaggagacgauugcgucgucaaaccgcuagaugaacgguucagcacgagccuacucuuccuaaacgacaugggaaaaguccggaaagacaucccacaaugggaaccgagcaaaggcuggaaaaauuggcaggaagugcccuuuuguucccaccacuuccacaaaaucuucaugaaggacggacgaagccuaguuguuccuugccgcaaccaggaugagcuaauuggccgagcgaggauuagccaaggggcuggcuggagccugcgagagacugccugucucggcaaggccuaugcacaaauguggagcuuaauguacuuccaccgucgagaccucagacuagccucuauggccaucugcagugcgguaccaaccgagugguuuccaaccucaaggacgacuugguccauccacgcacaccaucaauggaugaccacggaggauaugcucaaaguauggaaucgggucuggaucgaagacaauccgaacaugacagauaagacaccaguccauucaugggaggacauccccuaccuaggaaaacgggaggaccucugguguggcagccuaauaggcuuaucaagccgcgcaaccugggcuaagaacauccauacggcgauaacucagguacgaaaccuaauaggaaaggaggaauacauggacuacaugccagugaugaagcguuacagcgcuccuagugaaucagaaggaguccuauga

SEQ ID NO: 26286 - RNA, 9867 nt, Artificial Sequence
  derived and/or modified CDS sequence (opt11) from DENV-4__JX024757__SS-prME
agcaccaugacucugcucugucugauuccaacggugauggccuuccaccucuccacccgcgacggcgagccgcucaugaucguggccaagcacgagcgagggcgcccccugcuguucaagaccaccgaggguaucaacaaguguacgcucauagcuauggaccuaggugaaaugugcgaagacaccgugaccuacaaaugcccucugcucguaaacaccgagcccgaagacaucgacugcuggugcaaccugacgagcacgugggugauguacgggaccugcacccaguccggggagcggcggagggagaagcgcucaguggcucuaacgccgcacucuggcaugggacucgagaccagggccgagacauggaugucgucagagggcgccuggaagcaugcccagcgcguggaauccuggauacugcggaaccccggcuucgcucugcucgccgguuuuauggccuauaugaucggccagaccgggauacagcgcacggucuuuuucguucugaugaugcugguggcccccuccuacggcaugcgcugcguuggcguugggaaucgcgacuucguggaagguguaagcggcggugcguggguggaccucguccuggagcacggcggcugcgucaccaccauggcccaaggcaaacccacccuggacuuugagcuaacgaagacaaccgccaaagagguggcgcuacugcggaccuauugcaucgaggccuccaucagcaacauaacgaccgcgacgcgcugucccacgcagggggagccauaccucaaggaggagcaagaucagcaguacaucugccggcgcgacguugucgaccggggcugggggaacggcugcggccuauucgguaagggcgggguggugacgugcgccaaguuccucugcuccggcaagauuaccggaaaccucguccagaucgagaaccuggaguacaccguuguggucaccgugcauaacggcgauacgcaugccgucggcaacgacaccuccaaccacggggugacugccacaaucacgcccaggucccccagcguugaggucaaguugccugacuacggagagcucacccuggauugcgagccccgguccggcauugacuucaacgagaugauauuaaugaagaugaagaaaaagaccuggcucgugcacaagcagugguuccuggaccuuccccuccccuggagcgccggcgcggacacguccgaaguucauuggaacuacaaggagcgcauggucaccuuuaagguuccgcacgccaaacggcaggacgugaccguacuugguucccaggagggugccaugcacagcgcccuggcgggcgcaaccgagguggacuccggggauggcaaucacauguucgccggccaccucaagugcaagguccgcauggagaagcuccggaucaagggcaugagcuacaccaugugcuccggcaaauuuagcaucgauaaggagauggcagaaacccagcaugggaccacaguagucaaggugaaguacgagggggcuggggcucccugcaagguaccgauagaaaucagagacgugaacaaggagaaggugguugggagaaucauauccagcacccccuucgcagaaaacaccaacagcgugacgaacauugaguuggagccaccguucggggacagcuacaucgugaucggugucggcgacuccgcucucacucugcacugguuccggaagggaucuuccaucggaaagauguucgaguccacuuaccgcggggccaagcggauggcaauccugggggaaaccgcgugggauuucggguccguuggcggccuguucacgagccuggggaaagccguccaucaagucuucggauccguguacacaaccauguucgggggcgugucuuggaugauucgcauccuaaucgguuuucugguccuguggaucggcaccaacuccaggaacacgagcauggccaugaccugcaucgccguuggagggaucacccuguuccuggguuucaccguccaggccgacaugggaugcgucgucuccuggaacggcaaagaguugaagugcgguucgggcauuuucgugguggacaacgugcacacguggacggaacaguauaaguuucagccggagucacccgccagguuagccucagccauacugaacgcacacaaagacggaguuugcgggauacggagcacaacgcgccucgagaacgucauguggaagcagauuacgaacgagcugaauuacguuuugugggaagggggccacgaucuuaccgucguugcuggcgacguaaagggugugcugaccaaggguaagcgugcacucacaccgcccgucaacgaccucaaguacuccuggaagacgugggggaaggccaagaucuucacccccgaggcuagaaauucaaccuuccugaucgaugggcccgacaccucagagugcccgaacggacggcgggccuggaacuuccuggaagucgaggauuacggguucggaauguucacgaccaacaucuggaugaaauuucgggagggcucauccgaggugugugaucacagacuuaugagcgcagcgauaaaggaccagaaggccguucacgcggacaugggguacuggauugaauccagcaagaaucaaaccuggcagauugagaaggcuucgcugaucgaggugaagaccugccuauggcccaagacacacacccucuggaguaacggcgugcuggagucccagaugcugauaccccggagcuacgcggggccguuuucccagcacaacuaccgccagggcuacgccacccaaaccgcagggcccuggcaccugggcaaacuggagaucgacuuuggcgagugccccgggaccaccguuaccauccaggaagauugcgaccacagaggacccagccugcgcaccaccacugcguccgggaaguuagugacgcagugguguugucgcuccugcaccaugccaccucugcgguuucuaggcgaggacgggugcugguacggaauggagauccgcccccucagcgagaaggaggaaaacauggugaagucccaggugaccgccggccaggggacuagcgagacuuucuccaugggcuugcuaugucucacccuguucguugaggagugcuuacggcgccgggucacccgcaaguauaugaugcucgugguaguaauaacuuucugcgcgauuauccucggcggacugaccuggauggaccuccugcgggcccucaucaugcucggggauaccaugagugggcgcaucggugggcagauccacuuggcgaucauggcagucuuuaagaugucccccggcuacguacugggggucuuucugcggaaacugacaagccgcgaaaccgcgcugauggugaucgguauggcgaugaccacgguguucucuaucccgcacgaccugauggaacucaucgacggcaucagccugggccuuauccugcuacggauugucacccacuucgauaacacccaaguggguacccucgcccugucgcucaccuucaucagaucgaccacgccccucgugauggccuggcggaccaucauggcugucuucuuugucgugacccugaucccccugugucgcacuuccugccuccaaaagcagagucacugggucgaaaucacggcgcugauacugggagcgcaggcccucccaguuuaccuaaugacccugaugaaaggcgccagccguagaagcuggccuuuaaacgaggguaucauggccguaggccuggucucccugcucggcagcgcgcugcugaagaacgacgugccccucgcagggcccaugguggccggcggucuccugcucgccgccuacgucauguccggcagcuccgcggaccugagccucgaaaaggccgcaaacguccagugggacgagauggccgacaucaccgggagcucccccaucaucgaggugaagcaggaugaggacggaucuuuuaguauccgggacgucgaggagacaaacaugaucacacuacugguuaagcuggcccucaucaccgugucaggccuuuacccgcuggcgauccccgugaccauggccuuaugguacauuuggcagguaaagacccaacgcucgggggcacuaugggauguuccuagcccagcggccacgcaaaaggcgacucucuccgagggcgucuaccgaaucaugcagcgcgggcuguucggcaagacacaggugggggugggaauacacauggaaggcgucuuccacacuauguggcacgugacgcgggggagcgugaucugucacgaaacuggcaggcuggaaccgagcugggccgauguccggaaugacaugaucagcuacgggggcgguuggcgguuaggggacaagugggacaaggaagaggacguccaagugcucgccaucgagcccggcaagaaccccaagcauguccagaccaagccggggcuguucaaaacccugacaggggagauuggggccguuacgcuggacuuuaagccgggcacuucaggcuccccgaucaucaauaaaaaggggaaggugaucggccuguacgggaacggcgucgugaccaaguccggggacuacguaagcgccaucacccaggcggagcguaucggcgaacccgacuacgaagucgaugaggacaucuuccggaagaagcgccugacgaucauggaccuccaucccggcgccggaaagacuaagagaauccugccauccauagugcgggaggcgcugaagcggcgccuccggaccuugauccuggccccaacccgcguggucgcggcggaaauggaagaggcccugcgaggccuuccuauacgguaccagacuccggccgucaaguccgagcacaccggacgggagaucguggaccugaugugccacgccacuuuuaccacgcgccugcuuuccuccacccggguaccgaacuacaaccugauagucauggacgaggcacacuucacugacccuuguuccgucgcugcgaggggauacaucagcacucgggucgagaugggggaggcggccgcaauauucaugaccgcuacgccaccggguagcaucgaccccuuuccacaguccaacucacccaucgaggacauagagagagagauaccggagcgguccuggaacacugguuuugacuggauuaccgauuaccagggaaagacggugugguuugugccuuccaucaaagccgggaacgacaucgccaacugccugcgcaaauccgggaagcgcgugauacaacuaucucggaagacuuuugacaccgaguaccccaagacgaagcugacggacugggacuucguugucaccaccgauaucucugagaugggcgccaacuuucgcgcggggcgggugaucgaccccagaaggugccugaagccgguaauacucaccgacggcccggagcgcgucauacuggccggccccauccccgugacgcccgccagcgccgcgcagagacgcgggcggaucgguagaaaccccgcccaggaggacgaucaguacgucuucuccggggacccccugaagaaugacgaagaccaugcccacuggacggaggccaagaugcuccuggacaacaucuacacccccgagggcauuaucccgacccuguucggccccgagcgggagaagacacaagccaucgacggugaguuucgccuccggggugagcagcgcaagacguucguggagcugaugcggcgcggcgaccugccgguguggcucagcuacaagguggcguccgccggcaucagcuacaaggaccgugaguggugcuucacgggugagcgcaacaaccagauucuggaagagaacauggaggucgagaucuggacacgggagggcgaaaagaaaaagcugcggcccaaguggcucgaugcaagagucuacgcugacccgauggcgcugaaggacuucaaggaguucgcauccggccggaaaagcaucacccuggacaucuuaaccgagaucgccacccugccgaccuaccuuucgagcaaagcuaagcuggcauuagacaauauagugaugcuucacacuacugaaaaagggggcagagccuaccagcacgcgcucaacgagcugcccgagucccuggagacgcuuaugcugguugcauuacucggcgcucugaccgccggcaucuuccuguucuucaugcaggggaaaggcaucggcaagcucagcauggggcugauugcgaucgccguugcgagcggcuugcucuggguggccgagauacagccgcaguggaucgcggccucaauaauccuggaguuuuuccugauggugcuccuaauucccgagcccgagaagcagcggacaccucaggauaaccaguuaaucuauguuauccuaacgauccuaaccauuaucggccugaucgccgcuaacgagauggggcucaucgagaagacuaagaccgacuucggguucuaccagguaaagacagaaacuacgauacuugaugucgaccugcgcccagccucugcuuggacccucuaugcgguggcaacgaccauacuuacucccaugcugcggcacaccauagagaacacguccgcgaaucucucguuggcggccauagcaaaccaggccgcuguccuaaugggccucggcaagggguggccccugcaucgcauggaccugggagugccuuuacuugcgauggggugcuauucacaggucaacccuaccacgcugacggccucucuugugaugcugcugguacacuacgcgauuauaggccccggccuccaggccaaggccacacgggaggcccagaaacgcaccgcggccgggaucaugaagaaccccaccgucgacggcaucaccgugaucgaccuggagcccaucuccuacgacccgaaguuugagaagcaguuggggcaggucaugcuccugguucucugcguggggcagcuucuucugaugcggacgacgugggcccucugcgagguucugacccuggccacggguccaauaaugacgcucugggagggcaaccccggccgcuucuggaauaccaccaucgcugugagcacggcgaacauauuccggggguccuaccuggccggcgccgggcuugccuucagccucaucaagaacgcucagacuccccgccggggaacuggaaccaccggcgagacacugggcgaaaaguggaagcgccaguugaauagcuuagaccguaaggaguucgaagaauauaagcgcucuggaauccuggagguggaccgcaccgaggcgaagucugcccuuagagacggcagcaagauuaagcacgcaguaucccgggggagcuccaagauccgcuggaucgucgagcggggaaugaucaaaccgaaggggaaggugguugaccucggcugcggccgcggggguuggagcuauuauauggcuacgcugaagaacgugaccgaaguaaagggguacaccaagggcgggcccggccaugaggaacccauacccauggcgacguacggcuggaaccuggugaagcuacacuccgggguggauguguucuacaagccgacugagcagguagacacacugcugugugacaucggggaaagcuccucgaaccccaccauagaggaggggaggacgcuuagggugcugaagaugguagagcccuggcuuagcagcaagcccgaguuuuguaucaaagucuugaacccauacaugcccaccgugaucgaggaguuagaaaaacugcaacgccgucauggcgggucauugguacgaugcccccuuuccaggaauagcacgcacgagauguacuggguauccggugcgagcggcaacauaguguccucggucaacaccaucucgaagaugcugcugaacagguucacgaccaggcaccgcaaacccaccuaugaaaaggacguggaccucggggcggggacccguagcguguccacggaaacugagaagccggacaugacuauaauugggcgccggcugcagagacugagagaggaacacaaggaaaccuggcacuacgaccaagagaaccccuaucguacgugggccuaccacggcagcuacgaggcccccuccacgggcagcgcuuccaguauggugaaugggguggugaagcuacugaccaagccgugggacguaauccccauggugacccaacuggcgaugacggacaccacuccuuuugggcagcagcggguuuucaaggagaaggucgauacccgaacgccccaaccuaagcccggaacccggaugaucaugacaaugaccgccaacuggcucugggcgcugcuggggaagaagaagucuccgcgccuguguacgagagaggaguucauaucgaaggugcgcagcaacgcggccauuggggcuguuuuccaagaggagcagggcuggaccagcgccagcgaggccgucaacgacucccgguuuugggagcugguggacaaggagcgugcauuacaccaggagggcaagugcgagucuuguguguauaauaugauggggaagcgcgagaagaagcucggcgaguuugggagagccaaggggucccgcgccaucugguacauguggcuuggcgcuagguuucuggaguucgaggcucucggcuuccucaacgaggaccacugguuuagccgcgagaacuccuggaguggcguagagggggaaggccugcacaggcugggguacauccuggaagacaucgacaaaaaggacggugaccugaucuacgccgacgacacggcgggaugggauacucgcaucacagaggacgaccucuuaaaugaggagcugauaaccgagcagauggcaccgcaccauaagacguuggccaaggccaucuuuaagcuaaccuaccaaaacaaaguggugaagguccuccggcccacgccgaagggggccguaauggacauaaucucccgcaaggaccagcggggcagcggacaggugggcacauacggccuuaacaccuuuaccaauauggaaguccagcuaauccgccagauggaggcggagggcgugaucacccaagacgacaugcagaacccccggggccuaaaggagcgcgucgagaaguggcucaaggagugcgggguggaccgacugaagcguauggccaucuccggagaugacugcguggugaagcccaucgacgagcgguucagcaccucacuccuguucuugaacgacaugggaaaagucaggaaggacauuccgcagugggagccgucgaagggcuggaagaacuggcaggagguucccuucugcucccaccacuuccacaaaaucuucaugaaggauggacgcagccugguaguccccugccgcaaccaagacgaacuaauuggccgggcccgcaucagucaaggcgccggguggagccugcgcgagacggcgugcuuaggcaaggcuuaugcacagaugugguccuugauguacuuucacagacgcgaccugcggcuggcgagcauggccauaugcagcgcuguuccgacggagugguuccccacaucccgcacgaccuggucaauacacgcccaucaccaguggaugacaaccgaggauaugcucaagguguggaaccggguguggauagaggacaaccccaacaugacggacaagacccccgugcacagcugggaggacaucccguacuuagggaagagagaggaucuguggugcggcagcuuaaucgggcuguccagccgggccacuugggccaaaaauauccauaccgccaucacccaagugagaaaccucaucggcaaagaagaguacguagacuauaugccggcuaugaagcgguacuccgcgcccuuugaaagugagggcguacuauaa

SEQ ID NO: 26287 - RNA, 9867 nt, Artificial Sequence
  derived and/or modified CDS sequence (opt11) from DENV-4__JF741967__SS-prME
uccaccaugacucugcucugucugaucccuaccguuauggccuuccaucuauccacccgggauggcgagccgcucaugaucguggcgaagcaugagcgggggcgcccccugcuguucaagaccaccgagggcaucaacaagugcacgcucaucgcgauggacuuaggggagaugugcgaggacaccgugaccuacaagugcccguugcucguuaacaccgagcccgaggacaucgacugcuggugcaaccugacgucaaccugggucauguacgggaccugcacccaaagcggggagcgccgccgggagaagcgcagcguugcgcugacgccgcacuccggcaugggccucgagacccgggcggagaccuggaugagcucagagggggccuggaagcacgcgcagcgcguggagagcuggauacugcggaaccccggcuucgcccugcucgcaggguucauggccuauaugaucggccagaccgggauccagcgaacagucuucuucguguugaugaugcuggucgcccccucauacggcaugcggugcgucggaguggggaaccgcgacuucguggaaggcgucagcgggggggcguggguggaccucgugcuagaacacggggggugcguuaccaccauggcccaggggaagcccacccuggacuucgagcucacgaagaccaccgccaaggagguggcucugcugagaacauacugcaucgaggcauccaucagcaacaucacgaccgcgacacgcugcccgacccaaggggagcccuaccucaaggaggagcaggaccagcaguacaucuguagacgcgacgugguugaccggggcugggggaacgggugcggcuuauucgggaagggugggguagugacgugcgccaaauuccuaugcaguggcaagaucacagggaaccuaguccaaaucgagaaccuggaauacaccgugguggucaccgugcacaacgggaacacacacgccgugggcaacgauacgucaaaccacggggugaccgcgacaauaacgccccgcucccccagcguagaggucaagcugccggacuacggggagcuaacccuggacugugagccccgguccgggaucgacuucaacgagaugauccuuaugaagaugaagaaaaagaccuggcucgugcacaagcagugguuccuggacuugcccuugcccuggacggccggcgcggacacaagcgaggugcacuggaauuacaaggaacgcauggucacguucaaggugccgcacgccaaacgacaggacgugaccguccuggggagucaagagggcgcgaugcauagcgcucuggccggcgcgaccgagguugauagcggggauggaaaucacauguucgcugggcaucucaagugcaaggucaggauggagaaguugcgcaucaagggcauguccuacaccaugugcagcggcaaguucucgaucgauaaagagauggccgagacgcagcaugggaccaccgucguuaaggugaaguacgaaggcgccggggcccccugcaagguccccaucgagauccgggacguaaauaaagagaagguggucggccggaucaucagcuccacgcccuucgcggagaacacuaacagcgugacuaauaucgagcuggagccgccguucggggacucuuacaucguaaucggcgucggagauagcgcccucacccuucacugguuccggaagggauccagcaucggcaagauguucgaguccaccuaccgcggggcuaagcggauggccauacugggcgagacggccugggacuucgggagcgucggcgggcucuucaccucccugggcaaggccgugcaccaggucuucgggagcguguacacuaccauguucgggggcguguccuggaugauccguauccugaucggguuccucguucuguggauuggcacgaacagccggaacaccuccauggccaugacgugcaucgcugugggcgggaucacgcuguuccucgguuucacggugcaggccgacaugggaugcgucgugagcuggaacggcaaggaguuaaaaugcggguccggcaucuucguuguggacaacgugcacaccuggacugagcaguauaaguuccagcccgagagccccgcgcgccuugccagcgccaucuugaacgcccacaaggacggcgugugcgggauccgauccaccacgcgccucgaaaaugucauguggaagcagaucacaaacgagcugaauuacgugcugugggaaggcgggcacgaccuuacgguggucgcaggcgacgugaagggaguacucacaaaggggaagcgggcgcugacgccgcccgucaacgacuuaaaguacagcuggaagacuuggggcaaggccaagaucuucacccccgaggcccgcaauuccaccuuccugaucgacgggcccgacacgagcgaaugcccgaaugaacggagagcguggaacuucuucgagguggaagacuacggcuucgggauguucaccacgaacaucuggaugaaguuccgggagggcucuucugaggugugcgaccaccgccuaauguccgccgcgaucaaggaccagaaagccguccacgccgacaugggcuacuggaucgagagcuccaagaaccaaaccuggcaaauagagaaggcuagccucaucgaggugaagacaugucuauggcccaagacacacacccuguggucgaacggggugcucgagagccaaaugcugaucccccguucuuacgccggcccguuuagccagcacaacuaucgccagggguaugcuacccagaccgccggccccuggcauuuggggaagcuugaaaucgacuucggcgagugccccggcacgaccgucaccauccaagaggauugcgaccaccgggggcccucccuccgcacuaccaccgcaaguggcaagcuggugacccaauggugcugccgcaguugcaccaugccgccucuccgguuccugggggaggacggcugcugguacgggauggagauucgcccccugagcgagaaggaagagaacauggugaagagucaggucacggccggucagggcaccuccgaaaccuucagcaugggccuccugugccugacccuguucguggaggagugccuucggcgccgaguuaccaggaaacacaugaucuuggccguggugaucaccuucugcgccauaauccucggugggcugaccuggauggacuugcuucggguccugaucaugcugggcgacaccaugagugggcgcaucgggggccagauccaccucgccaucauggccguguucaaaaugucacccggguacgugcugggcgucuuccugcggaagcucacgucccgcgagaccgcgcugauggucaucgggauggcgaugaccaccguguucagcaucccucacgaccugauggagcucaucgauggcaucucccuaggccucauccuccucaagaucgucacgcauuucgacaauacgcaggucggcacucuggcccucagccugaccuucauccgcucuacgacgccccuggugauggcuuggcgcacaaucauggccgucuucuuuguugucacccugaucccuuugugccggacgagcugccuacagaagcagucccauuggguugagaucaccgcccuaauacucggcgcgcaagcucuucccguguaccucaugacccugaugaagggggccagccgccgguccuggccgcugaacgagggcaucauggccguggggcucgucagccugcugggcuccgcgcuccugaagaaugacgugccccuggccggccccaugguggccgggggccuccuccuggccgccuacgucaugagcgggucuagcgcggaucucucccuugaaaaggccgccaacguucagugggacgagauggccgacaucaccggcagcagccccaucaucgaggugaagcaggacgaggacggauccuucagcauccgcgaaguagaggagacgaacaugaucacccugcugguaaagcuggcccugauuaccguguccggacuauacccgcuggcgaucccugucacaauggcccugugguacguguggcaggugaagacgcagcgcagcggcgcccucugggacgucccgucccccgccgccacccacaaggcgacccuguccgaggggguuuaccgcaucaugcagagaggccuguucggcaagacccagguaggggucgguauccauauggaagguguguuccacaccguaggucaugucacccgcggguccgugaucugccacgagaccggccggcucgagccaagcuggggcgaugugcgcaacgauaugauauccuacggcgggggguggcgccugggggacaagugggacaaagaggaagacguccaaguucuggccaucgagcccgggaagaaccccaagcacguucagaccaagcccggcuuguucaagacccucacgggggagaucggugcaguuacccuggacuucaaaccggguaccagcgggagccccauuaucaacaagaagggcaaggugaucgggcucuacggcaaugggguggucacuaagagcggcgauuauguguccgccaucacgcaggccgagcggaucggcgagccggauuaugagguggacgaagacauauuccgcaagaagcgguuaaccauaauggacuuacauccuggagcgggcaagaccaagcgcauccuccccagcaucguccgggaagcccuaaagcgccgacuccgcacccucauccuggcgcccacgcggguaguggccgcggagauggaggaggcccuccgcgggcugccgauccgguaccagacaccggccgugaaguccgagcacaccggccgcgaaauuguggaccucaugugccacgccacuuuuacuacccgucuguugagcuccacccgcguccccaacuauaaccucauaguuauggacgaggcccacuucacagaccccugcagcguggcggcaaggggguacaucaguacgcgcgucgagaugggugaggcggccgcuauauucaugaccgcgacacccccgggcuccauugaccccuucccccagagcaauucccccaucgaggacaucgaaagagagaucccggagagaaguuggaauaccggguucgauuggaucacggacuaccaagguaagacugugugguucguccccuccaucaaggccggcaaugacaucgccaacugccugcgcaaguccggcaagcgcgucauacagcugucccgcaagaccuucgacaccgaguacccgaagacgaagcucaccgacugggacuucguggugaccaccgacaucagcgagaugggggccaauuuccgggccggccgcguuaucgacccccggcgcugucucaagccggugauccugacggacggccccgagcgggugauacucgcggggcccauccccgucaccccggccucugccgcccagcgccgcggacgcaucggccggaacccugcacaggaggacgaucaauacguauucagcggcgacccccugaagaacgacgaagaccacgcucacuggacagaggccaagaugcugcucgacaacaucuacacccccgagggcauaaucccgacgcuuuucgggcccgagcgcgagaagacgcaggccauugauggcgaguuccggcugcgcggggagcagcggaaaaccuucguggagcucaugcgccggggcgacuugcccguauggcugagcuacaagguggccagcgcggggaucuccuacaaggaucgagaauggugcuucaccggugaacggaacaaccagauccucgaggagaauauggaggucgagaucuggacucgagagggagagaagaaaaagcugcgacccaaguggcuggacgcacgcgucuacgcugacccgauggccuuaaaggacuucaaggaguucgccagugggcggaaguccauaacccuggacauccugaccgagaucgcgacccuaccaaccuaccugagcuccaaggccaagcuggcccucgauaacaucgugaugcugcacacgaccgagaagggcgggcgcgccuaccaacacgcccugaaugagcuucccgagucgcuggagacauuaaugcucguagcgcugcugggcgcuaugaccgcugguaucuuccucuucuucaugcagggcaagggcaucgggaagcuguccaugggccugaucgccauagcggucgccuccgggcuccuguggguugcggagauucagccgcaguggaucgcagcaucgaucauccuggaguucuuccucaugguacuacugauccccgagccugagaagcagcgcacaccucaggacaaucagcucaucuacguaaucuuaaccauccuuacgauaaucggccucaucgcggccaaugagauggggcugaucgagaagaccaagacggauuucggcuucuaucagguuaagccggagaccaccaucuuagacguggaccuccggccggccagcgccuggacccuguacgcaguggcgacgaccauccugacccccaugcuccgacacaccaucgagaacacgagcgccaaccugucccuggccgccaucgcgaaccaggcggccgugcucaugggccuggggaagggcuggcccuugcaucgaauggaucucgggguaccgcuucuggccaugggcuguuauagccaagucaaucccaccacccucaccgccucccugguaaugcuacucguccacuacgcuauuauuggccccgggcuacaagcgaaggccacgcgcgaggcccagaagcggaccgccgcaggcauuaugaagaaccccaccgucgacgggaucaccgugaucgacuuggaacccaucagcuaugaccccaaguucgagaagcagcucggacaggugaugcugcugguccucugcguggggcagcugcugcucaugcgcacgaccugggcccucugcgaaguacuuacccucgccaccggcccugucaugacuuuaugggagggcaaccccgggcgcuuuuggaacacaacgauagccgugucgacggccaacaucuuccgcggcagcuaccuggcgggggccggucucgccuucucccugaucaagaacgcccagacgccgcgacgcgggaccggcaccaccggcgagacgcugggggagaaguggaaacggcaacucaauucauuagaccgcaaggaguucgaggaauacaagcgguccggaauccuggagguggacaggaccgaggccaagagcgcgcuccgggacgggacgaagaucaaguacgccgucucccggggcagcucgaagauucgauggaucguggagagagggaugaucaaaccgaagggcaagguggucgacuuaggcugcgggcggggcggcuggucuuacuacauggcaacccugaaaaacgugaccgagguaaagggcuacacaaaaggcgggcccggccacgaggaacccauccccauggccaccuacggguggaacuugguuaagcugcacuccggcguagacguuuucuacaagcccaccgagcaggucgacacccugcucugcgauaucggggaaagcagcagcaaccccacgaucgaggagggccgaacucugcgcgugcugaaaauggucgagcccuggcucuccagcaaaccggaguucugcaucaaggugcugaaccccuauaugccaaccgugaucgaggagcuggagaagcuccagcgacgccacggcggaucucugguccggugcccccugagucgcaacagcacccacgagauguauuggguguccggagccagcggcaacaucguguccagcgucaacacgaucuccaagaugcugcucaacagauucacaacccgccacaggaagccgacguacgagaaggacguggaccugggagcggggacgcgcagcguguccaccgagacugagaagccggacaugacggucaucggccggcgccuccagcggcucagggaggaacacaaggagacguggcacuacgaccaggaaaaucccuaccggaccugggccuaccauggcagcuacgaggccccguccaccgguagcgccucaagcauggugaacggcgucgucaagcugcugaccaagcccugggacgugauccccauggugacgcagcucgcgaugacagacaccacccccuucgggcagcaacgcgucuucaaggagaagguggauacgcggaccccgcagcccaagcccggcacccgaaugauaaugaccacgaccgccaacuggcugugggcccugcucgggaagaaaaagaguccgcggcugugcaccagagaagaguucaucucaaaagugcggagcaacgcugccaucggcgcggucuuucaggaagagcagggauggaccagcgccucugaggccgugaaugacagccgcuucugggagcugguagacaaggaacgggcccuccaccaggaggggaagugcgagagcugcguguacaacaugaugggcaagcgcgagaagaagcuaggggaguucggccgcgccaagggguccagggcgaucugguacauguggcuaggagcccgcuuccucgaguucgaggcccugggauuccugaacgaggaucauugguucagccgggagaauucauggaguggcguggagggggaggggcuccaucgucugggcuacauacuagaggacaucgacaaaaaggauggcgaccucaucuacgccgacgauacggccgggugggacacccgaauaacggaggaugaccugcugaacgaggagcucaucacugagcagauggccccccaccacaagacgcuggccaaagccaucuucaagcugaccuaccaaaacaagguggucaaaguccuccggcccacccccaagggcgcagugauggacaucaucucacgcaaggaccagcgcgggagcggccaggucgggaccuacggccugaacaccuucacaaacauggagguucagcugauccgccagauggaagcagagggcgugaucacacaggaugacaugcagaaccccaaggggcuaaaggagcgcgucgagaaguggcugaaggaguguggcguggacagacugaaacgcauggcuaucuccggggacgacugcguggucaagccgcucgacgagcgguucucuaccucccugcuguuccucaacgacaugggcaaggugcgcaaggacaucccccagugggagcccagcaagggcuggaagaacuggcaggaggugcccuucugcagccaccacuuccacaagauauuuaugaaggauggccggagcuuggucguacccugccgcaaccaagaugagcugaucggccgggcccgcaucucccagggagccggauggagccugagggagaccgccugucuggggaaagcuuacgcacagauguggucccugauguacuuccaccgccgcgaucuccggcuggcuagcauggccaucugcuccgcagugccgacagagugguucccaaccagccgcaccaccuggagcauccacgcgcaccaccaguggaugacgaccgaggacaugcuaaagguuuggaaccguguguggaucgaggacaaccccaauaugaccgacaaaaccccagugcacuccugggaggacaucccauaucucggcaagcgggaggaccuguggugcgggagccugaucggccucuccagccgggccacgugggccaagaacauccauaccgcgaucacucagguccgcaaucugaucggcaaggaggaguacguggacuauaugcccgcaaugaagcgguacagcgcgcccuucgaaagcgagggaguucuguga

SEQ ID NO: 26288 - RNA, 9867 nt, Artificial Sequence
  derived and/or modified CDS sequence (opt11) from DENV-4__JQ822247__SS-prME
agcaccaugacccugcuuugccugauucccacgguuauggccuuccaccucagcacucgagacggggagccccucaugaucgucgccaaacaugagcggggacgcccccugcuguucaagaccaccgagggcaucaacaaaugcacgcucaucgcgauggaccugggugagaugugcgaggacaccguaaccuacaagugcccuuuacucgugaacaccgagcccgaagacauagauugcuggugcaaccuuaccagcaccugggucauguaugggaccuguacccaguccggagagcggcgccgggagaagcgcucggucgcccugacuccacacucuggcaugggucucgaaacgcgggccgagaccuggaugagcuccgagggugcauggaaacaugcccaacgcguggaaagcuggauccugagaaaccccggcuucgcucugcucgccggauucauggccuauaugaucggccaaaccggaauccaacgcacggucuuuuuugugcuaaugaugcugguggcccccucauauggcaugcggugcgucggcguggggaaccgagacuucguggagggugucagcgggggcgcguggguggaucuagugcuggagcacggcgggugcgugacgaccauggcccagggcaaaccgaccuuggacuucgaacugacgaagacuaccgccaaggagguggcccuguuacggacguauuguauugaggccuccaucagcaauauuacgaccgccacccgcugcccgacccagggggagcccuaccucaaagaagagcaggaucagcaguacauuugccgucgagacguagucgaccgcgguugggggaacggcugcggccuguucggaaaggggggggugguuacgugcgccaaguuccuguguuccgguaagauaaccgggaaucuaguccagauugagaaccucgaguacaccgucguggucacaguacacaaugguaacacgcacgcugucggaaacgauaccagcaaccacggggugacagccaccauuacaccucgcagccccagcguggaggucaagcugcccgacuauggcgagcucacuuuggacugcgagccccgguccgguaucgacuucaacgaaaugauacugaugaagaugaagaagaagacuuggcucguccacaagcagugguuccuggacuugccccuuccuuggaccgccggggcggacaccagcgaggugcacuggaauuacaaggagcgcauggucacguucaaggugccgcacgcaaagaggcaggacgucaccguccuggggucccaggagggcgccaugcacagcgcccuggcaggagcgacggaggucgacagcggggacgggaaucacauguuugccggacaccucaagugcaagguacguauggaaaagcugcguauaaagggcaugucguacaccaugugcucaggcaaauuuucgaucgacaaggagauggcagagacgcagcaugguacaaccguagugaaggugaaguaugagggcgcuggggcccccugcaagguccccaucgaaauccgggacgugaacaaggagaaggugguaggccgcaucaucucuuccacucccuucgcggagaacacaaauagcgugaccaacaucgaacuggagccgcccuucggggacuccuacaucgugaucggcgucggagacucugcguugacccugcacugguuccgaaaggguuccagcauuggcaagauguucgaguccaccuaccgcggggccaagcggauggcaauacugggugagacggcgugggacuucggcagcgucggcggcuuguucaccagucuggggaaggcggugcaccaggucuucggcagcguuuacaccacuauguucggggggguauccuggaugauccgcauucucaucggcuuccucgucuuauggaucggcacgaauagcaggaacacauccauggccaugaccugcaucgccguggggggcaucacucucuuccugggcuucacggugcaggccgacauggggugugucgugucuuggaauggcaaggagcucaaguguggguccggcaucuucguggucgauaacguucacacauggaccgagcaguacaaguuccagcccgagagccccgcgcgacuggccagcgccauccuuaacgcucacaaggacggcguauguggcauuagauccaccacgcgccucgaaaacgucauguggaaacagauaacaaacgaguugaacuacgugcuuugggagggugggcaugaccucaccgugguggccggagaugugaaaggcguacugaccaaggggaagcgcgcgcugacgccgcccgucaacgaccuaaaauacagcuggaagacuuggggcaaggccaagauauucacccccgaggccaggaacuccaccuuccugaucgacggaccagacacguccgagugccccaacgagcggcgcgccuggaauuucuucgaggucgaagacuacggguuugggauguucacaaccaacaucuggaugaaguuucgggaaggcagcagcgaggugugcgaccaccgccugauguccgcugcgauuaaggaucagaaagccguccacgcugacaugggguacuggaucgagucaucuaaaaaucaaacauggcagaucgagaaggcaagcuugaucgaggugaagacgugccuguggcccaagacccacacccuuugguccaacggcgugcucgagagccagauguugaucccccgguccuacgcggguccguucagccagcacaauuaccgccagggguacgccacccaaaccgcagggccguggcaccugggaaagcuggagauagacuuuggagagugucccggaacuaccguaaccauccaggaggauugugaucaccgggggccaucccuacgcaccaccaccgccucuggcaagcuggugacacaauggugcugccgcucuugcaccaugcccccccuccgguuccugggggaggacgguugcugguacgggauggaaauccgcccccugagcgaaaaggaagagaacaugguaaaaagccaggugacggccggccagggcacauccgagaccuuuagcaugggguugcucugccugacccucuucguggaggaaugucugcggcgccgggucacgcgcaagcacaugauucucgcggucgugauuaccuucugcgccauaauccucggcggcuugaccuggauggaccugcuccggguacugaucaugcugggagacaccauguccggccgcaucgggggccaaauccaucucgccauaauggccguauuuaaaaugagccccggguacgugcugggcguauuucugcggaaacugacuucaagagaaaccgcacugauggugauagguauggcgaugaccacgguguuuagcauuccgcaugaucuuauggagcucauagacggcaucucccuaggccugauucugcugaaaaucguuacgcacuucgauaacacccagguggggacccuggcccucagcuugacuuucauacgguccacgaccccccucgugauggcguggcguaccaucauggccgucuuuuucguagugacucuaaucccgcugugccggacgagcugccugcaaaagcagucucauugggucgagaucaccgcacucauucugggcgcgcaggcccugccuguauacuugaugacccugaugaagggggccagcaggcggaguuggccacugaaugagggcaucauggccgugggacucgucucucuucuuggcucagcuuuacugaagaaugacgugccccuggccggcccaauggucgccgggggccugcugcuugccgccuaugugaugagcggcucuagugcggaccucuccuuagaaaaggcugccaacguccagugggacgagauggcagacaucaccggcucuagccccaucaucgaggugaagcaagacgaggacggaucguuuagcauacgcgacguggaggagacaaacaugaucacccugcuggugaaacuggcccuaauuacgguguccggccucuacccccuggcgauccccgucaccauggcgcuuugguacguguggcaagucaagacgcagcgaucgggcgcccuaugggacguccccuccccagccgcgacgcagaaagcgaccuuaagugagggugucuaccguaucaugcagcggggacuguucgggaagacccaaguuggaguggggauccacauggaggggguuuuccauaccauguggcacguaacgcggggcuccgugaucugccacgaaacugggagacuagagccgagcugggccgacguaaggaacgauaugaucucguacggcgggggcuggagacugggugacaaaugggacaaagaggaggacguucagguccuagccaucgagcccgggaagaaccccaagcacgugcagaccaagcccggccucuucaaaacccuuacaggggagauaggcgccgugacccuggacuucaagccggggaccaguggcagccccaucaucaauaagaagggcaagguuauuggucucuacggcaaugggguagucacuaagagcggagauuacguaagcgccauuacgcaggccgagcggaucggggaacccgauuacgagguggaugaagacaucuucaggaagaagcggcugaccaucauggaccugcauccgggcgccggcaagaccaagcguauccuccccagcauagugcgggaggcccugaagcgccggcuacgcacgcuaauccuggccccuacgcgggucgucgcagcggaaauggaggaggcccugcgcgggcuucccauccgguaccaaacuccggcagugaaauccgagcacacgggcagggaaaucguugacuuaaugugccacgccaccuucacaacgcggcugcugagcuccaccagagugcccaacuacaacuugaucgucauggacgaggcgcacuuuaccgauccgugcucgguggccgcccgcggguacaucuccacgcgaguugagaugggcgaagccgccgcgauuuucaugaccgccacacccccggggagcaucgaccccuuuccccagagcaacuccccaaucgaagacaucgaaagagaaaucccggagcgcagcuggaacacaggcuucgacuggaucacggacuaucagggcaagaccgucugguucgugcccuccauaaaggcggggaaugacaucgccaauugccucagaaagagcgguaagcgcguuauccagcucucgcggaagaccuucgacaccgaguaccccaagaccaagcucacggacugggacuucgucgugaccaccgacaucagcgagaugggggccaacuuccgggccggccgcgugaucgacccacggcgcugucugaagccagucaucuuaacggacggacccgaacgggugauccuggcaggaccuauaccggucaccccggccucugcugcgcagcgccgggggaggauugggcggaacccggcgcaggaggacgaccaguacgucuucagcggcgacccccugaagaaugacgaggaucacgcccacuggaccgaggccaagaugcuguuggacaacaucuacacacccgaggguaucaucccgacgcuguucggccccgagcgagagaagacccaggccaucgacggcgaguuccggcugaggggggaacaacggaaaaccuucguggaacucaugcgcagaggugaccuccccgucuggcuguccuacaaggucgcgucugccggcauuuccuacaaggaccgcgaguggugcuucaccggcgagcggaacaaucagauccuugaggaaaacauggagguagaaaucuggacgagggaaggggagaagaagaagcugagacccaaguggcuggacgcccgcguguacgccgacccaauggccuuaaaggacuucaaagaguucgcgucuggcagaaaguccauuacccuggacauacucacggagaucgccacccuccccacguaccugagcucuaaggcuaagcuggcccucgauaacaucguaaugcugcacacgaccgagaaaggaggccgcgccuaccaacacgcgcugaacgagcuacccgaaucacuugagacccugaugcucguggcccugcugggcgcuaugaccgccgggauauucuuauuuuucaugcagggcaaggggaucggcaaacugaguaugggccuuauugcgauugccguggccagcgggcucuuguggguagcggagauccagccgcaguggaucgcggccuccauaauacuggaguucuuccugaugguccugcugauccccgagcccgaaaaacagcgcacaccucaggacaaccagcucaucuacguaauccugaccauacugaccaucauuggucuuaucgccgccaacgagauggggcugaucgagaagacgaagacggacuucggcuucuaccaggucaagccggagaccacaauacuggauguggacuugcgucccgcgucggccuggacccuguacgcggucgccacgaccauccuaacccccaugcuccgacacaccauagaaaacacuagcgccaaccugucacuggccgccaucgcgaaccaggccgccguccucaugggguugggcaaaggcuggccccugcauagaauggaccucggcgucccguuacuugccaugggcugcuacucccaagugaaccccacgacccucacggccucccuugucaugcugcucguccacuaugcgaucauugggcccggccuccaagccaaagccacucgcgaggcccagaagcguaccgcggcaggcaucaugaagaaucccacaguggacgggauaaccgucauagaccucgagccaaucagcuacgaucccaaguucgagaaacagcucggccaagugaugcuguuaguucucugugucgggcaacuguuacuuaugcggacgacaugggcccugugcgagguguuaacccucgccacuggccccguaaugacgcugugggaggguaaucccggccgguucuggaacaccaccauagccguauccaccgcgaauaucuuccgcggcagcuaccuggccggcgccggacucgccuucucccugaucaaaaacgcacagacgccgcggcgcgggaccggcaccaccggggagacgcugggcgagaaguggaagcggcagcucaacagccuggacagaaaggaauuugaggaguacaagcgguccggcauccuggaaguggaucgcacagaggcgaagagcgcccucagagacgggaccaagaucaaguaugccgugucccgcggcucuucuaagauccgguggaucguggagagagggaugaucaagccaaaaggcaagguaguugaucuagggugcggccggggcggguggagcuacuacauggcuaccuuaaagaaugucacagaagugaagggguacacgaaaggcggccccgggcacgaggaacccaucccgauggccaccuacgguuggaacuuggugaagcuucacuccggcgucgacguguucuauaagcccaccgagcagguagacacccugcuaugcgacaucggugagagcucgagcaacccgacgaucgaagaggguagaacccugcgcguuuuaaagaugguugagcccuggcucuccagcaagcccgaauucugcauuaaggugcugaauccuuacaugcccacgguaaucgaggagcuggagaagcuccagcgucgccacggggggagccugguucgaugcccccucucccguaauagcacccaugagauguacuggguuagcggcgcgucagggaacaucguguccucugugaauacgauaaguaagaugcugcucaaccgguucaccacccgccaccgcaagccaaccuacgagaaggacgucgaucugggcgcagggacccggaguguauccaccgaaaccgaaaagcccgacaugaccgugaucggccgucgccugcagcgucuccgcgaggagcauaaggagacguggcauuacgaccaggaaaaccccuaccgcaccugggccuaccaugggagcuacgaagcccccuccacuggaagcgcgaguagcauggucaacggcguggucaagcugcuuaccaagccuugggauguuaucccaaugguuacgcaacucgccaugaccgacaccacccccuucgggcagcagagaguguucaaggagaagguggacacgagaaccccacaacccaagcccggcacccguaugauuaugaccacgaccgccaacuggcugugggcuuugcucgggaagaagaagucccccaggcugugcacgcgcgaggaguucaucagcaaggugaggucuaaugcagcgauaggcgcgguguuccaggaagagcagggcuggaccagcgccuccgaggccgucaacgacagccgguucugggagcugguugacaaggagagagccuugcaucaggaaggcaagugugagagcugugucuacaacaugaugggaaaacgcgagaagaaacugggggaguucggacgcgcgaaggguagucgugcuauaugguacauguggcuaggugcccgcuuccucgaguucgaggcccugggguuucugaacgaagaucauugguucagccgggaaaauucauggucuggcgucgagggugagggguugcaccgacucggcuacauacuggaggacauugacaaaaaggacggagaccucaucuaugccgacgauacggcaggcugggacaccaggauaaccgaggacgaccuccugaacgaggagcucauaaccgagcagauggccccgcaccauaagacgcuggccaaggccauauucaaguuaaccuaccagaacaagguggugaaagucuugcgacccacacccaaaggcgcgguaauggacauaaucagccguaaggaccagcgcggaagcggccaaguggguaccuacggacuuaacacuuuuacgaacauggagguccagcugauccgccagauggaagcugagggcgucauuacccaggaugacaugcaaaacccaaagggccugaaggagagaguggagaaguggcugaaggaaugcggcgucgaccgguugaagcgcauggccauauccggggaugacugcguggugaaaccacuagaugagcgguucucuaccucccugcuguuucucaacgacaugggcaagguccgcaaggacauaccccagugggagccuucuaagggcuggaagaacuggcaggaggugccuuucugcucccaucacuuccacaagaucuucaugaaggacggucggagccuagugguaccuugccgcaaucaggacgagcugauugggagggcccggaucucccaaggugccggcuggucucuccgggagacggcgugccucgggaaggcguacgcccagauguggucccugauguacuuccaccgacgcgaccucagacuggcaagcauggccauuugcagcgccgugcccacagaaugguuccccaccagccgcaccacgugguccauccaugcccaccaccaguggaugacgacugaagacaugcucaagguguggaaucgggucuggaucgaggacaaccccaauaugacagacaagaccccggugcacuccugggaagauauccccuaccucggcaagcgcgaggaccuguggugcggaagcuuaaucggccuguccagucgggccacgugggccaagaacauccacacagcaaucacccaggugcgcaaccugaucgggaaggaggaguacgucgacuauaugcccgcaaugaaacgguacuccgcacccuucgagucugagggugucuuguga

SEQ ID NO: 26289 - RNA, 9867 nt, Artificial Sequence
  derived and/or modified CDS sequence (opt11) from DENV-4__JF262783__SS-prME
aguaccguuacucugcuuugucucauaccuaccgugauggccuuccauuuaagcacccgcgacggugaaccgcucaugauuguugccaagcacgagcguggacgaccccugcuguuuaaaacuaccgagggcauaaauaagugcacccuaaucgccauggaucugggggagaugugcgaggacacugugauguacaaaugcccgcugcuugugaacaccgaaccagaggauaucgacuguuggugcaaccuuacaaguacaugggugauguaugguaccuguacccagaguggggagaggcgacgggaaaagagaucaguugcgcugacgccgcacuccgguaugggccucgagacgagggccgaaaccuggaugagcuccgagggggcguggaagcaugcgcaaagaguggagagcuggauucugaggaaccccgguuucgcgcucuuggccgguuucauggccuauaugaucgggcaaacggggauccagcgcacuguuuucuucgugcuaaugaugcuaguggccccuucauacggcaugcggugcgugggcguggggaaccgcgacuuugucgaaggcguaagcgguggugcguggguggaccucguccuggaacacggcgggugcguuacgacgauggcccagggcaaaccaacauuagacuuugagcucaucaagaccacggcuaaggaagugacccugcuucggaccuacugcaucgaggcauccauuucgaauauuaccaccgccacgcgcugcccuacccagggugaacccuauuugaaggaggagcaggaucagcaguauaucugccgaagagacgucguggaccggggcugggguaacggcugcggacuguucggaaaaggcgggguagugacuugcgcgaaguuucugugcuccgggaagaucacugggaaucucgugcaaaucgagaaccuggaguacaccgugguggugacgguacacaacggcgauacgcacguaguggggaaggauacgagcaaucacggggucaccgccacaaucacgccccggucccccagcgucgaaguuaagcuaccagacuacggcgaacuaacauuagacugugagccacgcuccgggauagacuucaacgagaugauccugaugaagaugaagaagaagaccuggcucguccacaagcagugguuucuggaccuccccuuaccuuggaccgccggugcggacaccucugaggugcaguggaauuacaaggagcgcauggugaccuuuaaggucccucaugccaagaggcaagacgugaccguguuggggucccaggagggggcgaugcacagcgcucuaaccggcgccaccgaagucgacagcggggacggcaaccacauguucgcagggcaccucaagugcaagguccgaauggagaagcuccgcauaaaaggcauguccuauacaaugugcagcggcaaguuuucgaucgacaaggagauggcugagacgcaacaugggacuacugucgucaaggugaaauaugagggcgcgggagcccccugcaaaguccccaucgaaauccgggacgugaauaaggagaaggugguaggccguaucaucagcuccacccccuucgccgagaacaccaacucagucaccaauaucgaacuggaaccacccuucggcgacuccuacaucgugaucggcgugggcgacagcgcacucacccugcacugguuccggaaggguuccagcaucggcaagauguucgaguccaccuaccgcggggcaaaacgcauggccauucugggcgagacagccugggacuucggcaguguuggaggucucuucaccuccuuaggcaaagccgugcaccagguguuugggagcgucuacacgaccauguucggaggcguaucauggauggugcgcauucugauaggucuccuaguucuguggaucggaaccaauagucggaauacgucuauggccaugaccuguaucgcuaucggagguauaacccuguuccuugguuuuacgguccaugcggacauggggugcgcaguguccugguccggcaaggagcuuaagugcggaagcggcaucuuugucaucgacaacgugcacacuuggaccgagcaauauaaauuccaacccgagaguccggcccgccuagccagugccauucucaacgcccacaaggauggcguaugugggauccgguccacaaccaggcuggagaaugucauguggaagcagauaaccaacgaguuaaacuacguguuaugggagggcgggcacgaucugacaguuguggccggugacgucaaaggcgugcugacaaaggggaagcgggcccucacgccgccagucaacgaccugaaguauucuuggaagaccugggggaaagccaagaucuuuacgcccgaggcgcgcaacagcacuuuucugaucgacgggcccgacacaucggagugcccuaacgaacggcgcgcguggaacuuccucgaggucgaagacuauggcuucgguauguucgcaacuaacauauggaugaaguuccgggaggggaguuccgagguaugugaccaccgccuuaugucugccgccaucaaagaccagaaggcuguccacgcggacaugggcuauuggaucgaauccagcaagaaccagacauggcagaucgagaaggccucccugaucgaggugaaaaccugucucuggccuaagacgcacacguuauggagcaaugagguacuggagucccagaugcuaauaccaaaagccuacgcggggccguuuagucagcacaacuaucggcagggcuacgccacccaaacgaucgggccguggcaucugggcaagcuggagaucgauuucggggagugccccggcaccacugucaccauccaggaagacugcaaccaccguggcccaucucuacggacuaccacggcaaguggcaaguuagugacccaguggugcugccgcucauguaccaugccgccacuucgcuuucugggcgaggaugggugcugguacggaauggagauccggccccugagugagaaagaagagaacauggucaaaagccaggucucagccgggcaaggcacuuccgagacguucucuaugggccugcuuugucuaacccuguuuguggaggaaugucuccgccgacgggucaccagaaaacacaugauccucgugguggucaccacgcugugugccaucauccucgggggccugaccuggauggauuuauuacgcgcgcugauaaugcuaggggacaccaugucuggccggaugggagggcagauacaccuaaccaucauggccguguucaagaugucucccggauauguuuugggcguauuccuucgcaaauugaccagccgagagaccgcacugaucgugaucgguauggcuaugacuacggugcugagcaucccgcacgaucugauggaauuuaucgacggaaucucacugggccugauauuguuaaagauggucgcccacuucgacaauacucaagugggcacccuggcacucucucuuacuuucauaaggagcaccaugccccuggugauggccuggcggacgaucauggccguccucuucgugguuacccugauaccccugugcagaaccuccugucuccaaaagcaaagccacuggguagaaaucaccgcccugaucuugggagcccaggcgcugcccguuuaccugaugaccuugaugaaaggcgcgucgaagcguagcuggccgcucaacgagggaaucauggcggugggccuggucuccuugcucgggagcgccuugcuuaagaaugauguuccccucgcgggcccuaugguggccggcgggcugcugcuagcagccuauguaauguccggcagcuccgccgaccugagcuuggagaaggccgccaacguucagugggacgaaauggccgacaucacugggagcucccccauuaucgaggugaagcaggaugaggaugggagcuucuccauaagagacgucgaagagaccaacaugaucaccuugcuggugaagcuggcccucaucacggugaguggccuauacccgcuggcuauccccgucaccauggcccucugguacauguggcaggucaagacccagcgguccggcgcccuaugggacgugccaagccccgcggcggcccaaaaggcuacccuuacggagggugucuaccggauuaugcagaggggccucuucggaaaaacccaaguggggguugggauccauauggagggcguguuccauaccauguggcauguaacccgggggagcgugauaugccacgagacgggccgccuggagccaagcugggcagaugucagaaaugauaugaucuccuacgggggagguuggagacuaggugauaagugggacaaggaggaggacguccagguucuugcaaucgagcccgguaagaacccaaagcacguccagacgaaaccgggucuguucaagacacugaccggcgagaucggugccgugaccuuggacuucaagccaggcacgaguggguccccgaucaucaauaagaagggccgcgugauagggcuauacgguaacggcauugugaccaagucuggcgacuacgugagugccaucacgcaggcggaacggaucggggaaccugacuacgaggucgacgaggauauauuccggaaaaagcguuuaaccguuauggaccuccacccgggggccgguaagacgaagaggauacugcccagcaucgucagggaagcacugaaacgacgccuacggacacucauucucgcacccacccgcguggucgcugccgagauggaggaggcacugcggggacuacccauccgcuaccaaacgccggcggucaaaagcgaacacacggggcgggaaaucguugaccugaugugccacgccaccuucaccacccguuuacucagcuccaccagagucccuaauuacaaccugaucgugauggacgaagcucacuucaccgacccuuccagcguugccgcccguggcuacaucagcacccggguggagaugggggaagccgcggccaucuuuaugaccgccacgcccccuggcgccacagacccauucccccagucgaacucucccauugaggauauagagcgcgaaaucccugagcggagcuggaacaccggauuugacuggaucacagauuaccagggaaagacggucugguucguacccagcaucaaggccggcaacgacaucgccaacugcuugcgcaagagcgggaagaagguaauccagcucuccagaaagacuuuugacaccgaguacccgaaaaccaagcugaccgacugggacuuuguggucacgaccgacauaucugaaaugggcgcgaacuuucgcgcccgccgggugaucgacccccgucgcugccucaagccaguuauccuuaccgacgggccggagcgcgucauccuggccggccccaucccgguaacgccggcuuccgcggcccagcggcgcgggcggauaggccgcaauccugcacaagaggaugaccaauacguguuuucuggcgacccccuaaagaaugaugaggaccacgcccacuggacggaagcuaagaugcucuuggacaacaucuacacgcccgaagggaucauuccgacccuguucgggccugaacgugagaaaauccaggccaucgacggcgaguuccgccuccggggcgagcagcgcaagacguucgucgaguuaaugagacguggcgaucugccgguguggcucaguuacaaaguggccucagccgggaucuccuacaaggaccgcgaguggugcuuuaccggcgaacgcaacaaccagauacuggaggaaaacauggaaguggagauuuggaccagggaaggggagaaaaagaaauuacgcccgaaguggcucgacgcgcgaguauaugccgacccgauggcgcugaaggauuucaaggaguucgccagcggacgcaaguccauuacccuagacauucuaacagagaucgcaucucuacccaccuaccucuccaguagggccaaauuggcccuggacaacauagugaugcugcauaccaccgagagagggggccgcgcguaucaacacgcccucaacgagcugccagagagucucgagacauuaaugcucgucgcccugcucggcgccaugacggcggggaucuuccuauucuucaugcaggggaagggaaucggaaagcugagcaugggucuuauggcaaucgccguagccuccggccugcugugggucgccgagauacagccgcaauggaucgcggcaagcaucauacuugaauuuuuccugauggcccuucucauucccgaaccugagaaacagcggacaccucaggacaaccaguuaaucuacguuauccuaacaauacucacuaucaucgggcuuaucgcagcaaacgagauggggcugauugaaaagacgaagaccgacuuuggcuucuaccaggugaaaaccgagaccacgauucuggacguagacuuacgaccugcgagcgcuuggacacuauaugcagucgccaccaccauccucacgccgaugcugcggcacaccaucgagaacacgucagccaaucugagccucgccgccaucgccaaccaggcggccguucuaaugggccuggggaaaggguggccccuacaccgcauggaccugggcguuccguuauuagcuaugggcugcuauucccaagucaacccuacaacgcugacagcaucccuaguaaugcucucagugcacuacgccaucaucgggccaggucuucaggcaaaggcgacccgagaggcccagaaacguacugccgcggggauaaugaagaaccccacgguagacgggaucacggugauugaccucgagcccauuagcuacgacccgaaauuugagaaacagcucggccaggugaugcuacuugcacuaugcgccgggcaacuucuauuaaugagaacgaccugggccuucugcgagguacugacgcuggccaccggucccauucucacccugugggaggggaaccccggccgguuuuggaacaccacgauagccguguccaccgccaauaucuuuagggggagcuaccuggcaggcgccggccuggccuucucccugaucaagaacgcccagacuccccgccggggcaccgguacgaccggagagaccuuaggugagaaguggaaacgccaguugaacucucuggaccggaaggaguucgaggaguacaagcgcucagggauccucgagguugaccggaccgaggccaagagugcguuaaaagacggcuccaagaucaagcacgccgugucgcgcgguuccagcaagauccgguggauuguggaacgcgguauggucaagccgaagggcaaggucguggaccuggggugcgggcgcggcgggugguccuacuacauggccacgcucaaaaacguaacugaaguaaagggguacacuaagggcgggcccggccaugaggagccgauucccauggccaccuacggcuggaaccucgugaaacuucacagcgggguugacgucuucuacaaaccgaccgagcaggucgacacgcuccucugcgacaucggcgaguccagcagcaaccccacgaucgaagagggacguacauuacgcgugcuaaagauggucgaaccauggcucuccucaaaaccggaguuuugcaucaagguauugaacccauacaugcccaccguaauagaggaacuagaaaaacuccagcggaagcacgggggcaguuugguccgaugcccgcuuagccguaauagcacgcacgagauguacugggugucaggcgcauccggcaauaucgucagcucaguuaauaccaccucuaaaaugcugcuuaaccgcuucaccacacgccacagaaagcccacguacgagaaggacgugaaccugggggccgguacccgcuccguuagcaccgaaaccgaaaagccggacaugacaauaaucggacgcagacuccagcggcuccgggaggagcacaaggaaaccuggcacuacgaucaggaaaacccguacaggacaugggcguaccauggguccuaugaggccccaaguacgggcuccgccucaucaauggucaacgggguugugaagcugcuaacuaagccgugggacgugauacccaugguuacacagcuagcgaugaccgauacgacgcccuucggacagcagaggguguucaaggagaagguggacacccgcacaccgcagccgaagccuggaacgagaauggucaugaccaccaccgcaaacuggcugugggccuugcucgggaaaaagaagucgccgcgcuuaugcacucgggaggaguucaucuccaagguucgcaguaacgccgccaucggcgcgguguuccaagaggagcagggguggaccagcgccuccgaagccgucaacgacucacgauuuugggagcuggucgauaaggagcgcgcccuccaccaggaaggcaagugugagaguuguguauacaacaugauggggaaacgugaaaagaaauugggcgaguucggucgggccaagggcucgcgugcuaucugguauauguggcuuggcgcgcgguuccuggaguucgaggcccuaggguuucugaaugaggaccacugguuuggccgcgagaacucguggucugggguggagggagaaggacuccaccgguugggauacaucuuggaagacauagauaagaaggacggggaccuuaucuaugccgacgacaccgcgggaugggacacccguauuacggaggacgacuuacugaacgaggaacucaucacggagcagauggcuccccaccaucgaauccuggccaaagccaucuucaaacugaccuaucaaaacaaggucguuaaggugcuccgcccgacgccuaaaggagccgucauggacauaaucagucggaaggaccagcgcggcaguggacaggugggcacuuacgggcugaacaccuuuaccaacauggaggugcaauuaaucagacaaauggaggcggaaggcgucaucacccaggacgacaugcagaauccaaaggggcuuaaggagcgcguagagaagugguuaaaggagugcggcguggaccgguuaaaacgcauggcgaucucuggcgacgacuguguagugaagccccucgacgaacgguucucgaccagccuucucuuucucaacgacauggggaaggugagaaaggacaucccgcagugggagccuucaaaggguuggaagaacuggcaggagguuccguucugcucgcaccacuuccacaagaucuuuaugaaagacgggcggagccucgucgugccuugccgcaaccaggacgagcugauaggacgggcccgcauuucccaaggcgccggcuggagcuuacgggagacggccugccucggaaaggccuacgcacagauguggucccucauguacuuccacagacgcgacuuacggcuggccagcauggccaucugcucggccguccccacugagugguuucccaccagucgaaccacguggagcauccaugcgcaccaccaguggaugaccacugaagacaugcucaagguguggaaccgaguguggaucgaggauaaccccaauaugacagacaagacgccaguacacuccugggaggacaucccuuaccuuggaaagagagaggaccuguggugcggcagucugaucgggcucuccucuagagccaccugggccaagaacauccacacggcaauaacccaggugcgcaaccuuauaggcaaggaggaguacguggacuacaugcccgucaugaagcgguauuccgcgccguucgaaagcgaaggagugcuguga

SEQ ID NO: 26290 - RNA, 9867 nt, Artificial Sequence
  derived and/or modified CDS sequence (opt11) from DENV-4__KU513441__SS-prME
agcaccauuacccuauugugccugauccccaccgugauggccuuccaccuguccacgcgcgauggcgagccguugaugauagucgccaaacacgagcggggcagaccccugcuguucaagacgaccgaggggaucaacaaaugcacucuuaucgcgauggaucugggggagaugugcgaggacaccgugaccuacaaguguccccugcucgugaauaccgagcccgaggacauagacugcuggugcaaccugacgagcaccuggguaauguacggaaccugcacccaguccggggagcggcgccgggagaaacgcagcguugcacugacgccgcauuccgguaugggccucgaaacccgggcagagaccuggaugagcuccgagggggcuuggaaacacgcacaacgcguggaaagcuggauucugcggaacccgggcuucgcccugcuugcaggguucauggcauacaugaucggccagaccgggauacaacgcacggucuuuuucgugcugaugaugcugguggcucccuccuacgguaugcggugcgucggcguuggaaacagagacuucguggagggcgucagcgggggugcuuggguggacuuggugcuagagcacggcgggugcgucaccaccauggcucagggcaaacccacccuggacuucgaacucacuaagaccaccgccaaggagguggcccugcugcgaaccuacugcaucgaggcacucaucuccaacauaaccacugccacccgaugcccgacucagggggagcccuaccugaaggaggagcaggaucagcaguacaucugccggcgcgacguugucgaccggggguggggcaacggaugcggcuuguucgggaagggcggggugguaacgugcgccaaguucagcugcuccggcaagaucacggguaaucuaguccagauugagaaccuagaguacaccgugguugucaccgugcauaauggggacacccacgccgucgguaacgacacaagcaaucacggggucacggccaccaucacaccccgcuccccgagcguagaggucaaauugccggacuauggcgagcucacccuagacugcgagccccgguccgggaucgacuuuaacgagaugauucugaugaaaaugaaaaagaaaaccuggcucguccacaagcagugguuccuggaccugcccuuaccguggaccacuggagccgauacaagcgaaguccacuggaacuacaaggaacgcaugguuaccuucaaggugccgcacgcgaaacggcaggauguuaccguccugggaucccaggagggcgccaugcacuccgcccuagccggugcgaccgagguggauagcggggauggcaaccacauguucgcaggucaccuaaagugcaagguucggauggagaagcugcgcaucaagggcauguccuacacgaugugcuccgggaaguucaguaucgacaaggagauggccgagacgcagcacggcaccaccgucgucaagguuaaguacgagggcgccggggcccccuguaagguccccauugagauccgggacgugaacaaggagaggguggugggaagaguaaucagcgccacgccccuggcggagaacacaaauuccgugaccaacaucgagcucgagccgcccuucggagacagcuacaucgucaucggcgugggcaacuccgcccuaaccuuacacugguuccgcaagggcagcuccaucggcaaaauguucgagagcacuuaccgcggggccaagagaauggccauccuaggugagaccgcgugggacuucggcuccguuggcggcuuauucaccagccuggggaaagccguccaccagguguucgguuccguguacaccacgauguucgggggagucagcuggaugaucagaauacuuauuggauuccuggugcuuuggaucgguaccaauucacgcaauacgagcauggccaugacuugcauugcgguggguggaaucacgcuauuucuuggcuucaccgugcaggccgacauggggugcgugguguccuggagcggccgggaacucaagugcggguccggcaucuucgugguggacaacguccauacguggaccgagcaguauaaguuccagcccgagagccccgcgcgccuugccucggcgauccucaacgcccacaaggacggugucugcgggauccgguccaccacccgucuggagaacgugauguggaagcagaucaccaacgagcugaacuacgugcuaugggaaggagggcacgaccucacugucguggccggcgacgugaagggcguacuaacgaaggggaagcgggcgcucaccccaccggcgucggaccugaaguacagcuggaagaccuggggcaaggccaagaucuucacaccggaggcccgcaacagcacguuucugaucgacgggcccgauaccuccgaaugccccaacgagcggcgagccuggaacagcuucgagguggaggauuacggcuuugggauguucaccaccaacauauggaugaaguuccgggagggcuccagcgaagugugcgaccacaggcucauguccgcggccaucaaggaccagaaggccguccacgccgacaugggcuacuggaucgagucgucuaagaaccagacguggcagaucgagcgggcgucacugaucgaggugaagaccugccucuggccgaagacccacacacucugguccaacgggguacuggagagucagaugcugauccccaaguccuaugccggaccguucagucagcacaacuaccgccaaggguacgcgacacaaacagucggucccuggcacuuggggaaacuggagaucgacuucggcgagugccccggcaccaccgugaccauucaggagaacugcgaccaccgcgggcccucccugcggacgaccacugccagcggcaaguuggucacccaguggugcugccgcagcugcacaaugccacccuugcgguuccugggugaggacgguugcugguacgggauggaaaucaggcccuuguccgaaaaggaggaaaacauggucaagagccaggucaccgccggacagggaaccagcgagaccuuuaguauggggcugcuuugccucacgcuauucgucgaggagugcuuacggagacgggugaccaggaagcacaugauccucgcgguggucaucacacugugcgccauaaucuuagggggucucaccuggauggacuuacugagggcccuuauaaugcugggcgacacgaugagcgguaggaucgggggccagacucaccuggccaucaucgccguuuucaaaaugagccccggguaugugcucggcgucuuccuucguaaguugaccucccgcgagaccgcgcucauggugaucgggauggccaugacgacuacccuaagcaucccgcacgacuuaauggagcuuauagauggcaucucccucggucuaaucuugcucaagaucgugacgcaguucgauaacacacagguagggaccuuggcccucuccuuaacauucaucaggucaaccaugagccuggugauggccuggcgcacgaucauggccguacucuucgucgugacccugaucccccucugucggacauccugccuccaaaagcagagccacuggguggagaucaccgcgcuaauacugggugcgcaggccuugccgguuuaccugaugacguugaugaagggggccucccgccggucuuggccccuaaacgagggcaucauggcgguggggcuggugucccugcucggcucggccuugcugaagaacgaugugccguuagccggacccaugguggccggaggcuugcugcucgcagcguacgugaugaguggcagcucagcagacuuaucccuggagaaggccgcaaacguccaaugggacgagauggcagacaucaccggcagcucccccaucaucgagguuaagcaagacgaggacgggagcuuuuccauccgcgacguggaggagaccaacaugauaaccuugcuggugaagcuggcacucaucacgguuuccggccuguacccccuggcuauccccauaaccaugacacucugguacauguggcaagucaagacccagcgguccggcgcccucugggacguuccuucuccagccgccacccagaaagcggccuuauccgaggggguguacagaauuaugcagcggggccucuucggaaagacucaggugggcgucgggauccacauggagggcguguuccacaccauguggcaugugaccaggggcucugucauuugccaugagaccggucgccuggagcccucaugggcggacguucggaacgacaugaucucuuacggugggggcuggcggcugggcgacaagugggacaaagaggaggacgugcagguccucgcaauugaaccgggaaagaaucccaaacacgugcagacgaagcccggcuuguuuaagacccuuacuggggagauuggcgccgugacccucgacuucaaacccgggaccuccggcagcccgaucaucaaccggaaggguaaggucaucggccuguacggcaacggcguggugacaaagucaggcgacuacgucucagcgaucacccaagccgagcgcaucggagagcccgauuacgaggucgacgaggacaucuuccgaaagaagcgccugaccaucauggaucuccacccgggcgccgguaaaacgaagcggauccugccguccaucguucgcgaggcucugaagcgccgccugcggacccucauccuggcgccuaccagaguaguggcggcggaaauggaggaggcgcugcgugggcuccccauccgcuaccagaccccugccguaaagagcgagcauacgggccgggagauuguggaucugaugugccacgcgaccuucaccacccggcucuuguccagcacgcgcgucccaaacuacaaucugaucgugauggacgaagcccacuucaccgaucccagcuccgucgccgcacgcggguacaucaguacccggguggagaugggagaggccgcggcgaucuucaugacagccacgccacccggggccaccgauccuuucccgcaguccaauucgcccaucgaggacauagagcgggagauccccgaacgcuccuggaacacuggcuucgacuggauuaccgacuaccaaggcaagacggucugguucgugccgagcauuaaggccgggaacgauaucgcgaacugccugcggaaguccggcaaaaaggugauccagcucagccgcaagacauucgacaccgaguaccccaagaccaagcugacggauugggacuuuguagugacuaccgauauauccgagaugggagcuaacuuccgggccggccgcgugaucgacccccggcgcugccugaaacccguuauccucaccgacggcccagagagggucauccuggcgggccccaucccugugacgcccgcgagcgcagcucagcgccgcggccggauagggcggaacccggcccaggaagacgaccaguacgucuucuccggggacccucuuaagaacgacgaggaucaugcccacuggaccgaagcuaagaugcuacuggacaacaucuacacccccgaggggaucauccccacgcuguucggcccggagcgugagaaaacgcaggccaucgacggcgaguuccgauuacguggggaacagcggaagaccuucguagagcuaaugcgccggggcgaccugccgguguggcucucauacaaggucgcuuccgccgggaucagcuacaaagaucgcgaguggugcuucaccggcgagcggaacaaccaaaucuuggaggaaaacauggagguagagauuuggacgcgcgagggugagaagaagaaacugcggccgaaguggcucgacgccagagucuacgcggaccccauggcccugaaggacuucaaggaguucgccaguggccgcaagagcaucaccuuggacaucuugacggaaauagcaucccuuccgaccuaccugagcucccgggccaaacucgcgcuggacaauaucgucaugcugcauaccacagagcgcgggggucgggcguaccagcacgcucuaaacgaacugcccgagagccuggaaacgcucaugcugguggcccugcucggagcgaugaccgccgggaucuuccuguucuucaugcagggcaaggggaucgggaaacuuagcaugggccucaucaccauagccguggccucugggcugcuguggguagccgagauccagccacaguggaucgcggccagcaucauccucgaguucuucuugauggugcugcucaucccagagcccgagaagcagcgcacaccccaggauaaccagcuuaucuacgugauucugacuauccucaccaucaucggccuuaucgccgcaaacgagauggggcugaucgagaagaccaagaccgacuucggcuucuaccaggucaagacggagaccacuauucucgacguugaccucagacccgccuccgcguggacccucuaugccguugcgacgacgaucuuaaccccaaugcugcgccacaccaucgagaacacguccgccaacuuaucccuugccgcgauugccaaccaggccgccguccuuaugggccuaggcaaaggguggcccuugcaucguauggaccuggggguacccuugcuugcaaugggcugcuacagccaggucaaccccaccacuuuaaccgcaagccugguaaugcuacuggugcauuaugccaucaucgggccgggccugcaggcuaaagccacgcgcgaggcucagaagcggaccgcagccggcaucaugaaaaaccccaccguggacggaaucacagucaucgaccucgaacccaucagcuacgauccuaaguucgagaagcagcugggucaggugauguuacucguccucugcgccgggcagcuguuauuaaugcgcacgaccugggcauucugugaggucuuaacccucgcgacaggcccgauccuuacauugugggaggguaaccccggccgauuuuggaacacaaccaucgcuguguccaccgccaauaucuucagaggaagcuacuuagccggugccggccuggcauuuagucugaucaaaaacgcccagacgccacgucgcgggaccggcaccgccggggagacauuaggggagaaguggaaacggcagcugaacagccucgaccgcaaggaguuugaggaguacaagcgauccggcauccuggaaguggaccgcaccgaagccaagagcgcacugaaggacggguccaagaucaagcaugcggucagccggggcuccagcaagauccgcuggaucguggaacgcgggauggugaaacccaagggcaaggugguggaccucgggugcgggcggggcggauggucuuacuauauggccacgcucaagaaugucaccgaggucaaaggcuacaccaaaggagggccggggcacgaggagcccauucccauggccaccuacggguggaaccugguuaagcugcacagugggguagaugucuuuuacaagccuacggaacagguggacaccuugcugugcgacaucggggagagcuccucuaauccuacaaucgaggagggccgaacccuccgagugcucaagauggucgaacccugguuauccagcaaacccgaguuuugcaucaaagugcugaauccguauaugccuacgguaauagaggagcuggagaagcuccagcgcaagcacggugggaaccugguccguugcccccugucccgcaacagcacccacgagauguacuggguguccggcgccagcggaaacaucgucuccagcgucaacaccaccuccaaaaugcuccugaaccgguucaccacccgccaccggaagcccaccuacgagaaggauguugaccugggagcggggaccagaagcgucucaacagagaucgagaagcccgacaugaccaucaucggccggcgccuccagagacugcaggaggaacacaaggagaccuggcacuacgaccaggagaauccguaccggaccugggccuaccacggaagcuacgaggcgcccucgaccgggagcgccuccagcauggugaacgggguagugaaacugcugaccaaacccugggacgucaucccaauggugacgcagcuggcaaugaccgauacgaccccuuuugggcagcagagagucuucaaggagaagguagauaccaggacuccccagccgaagccgggcacgaggauggucaugaccacgaccgcgaacuggcuuugggcccuccuggggaagaagaagaacccccgccugugcacucgagaggaguucaucucuaaaguccgcagcaacgccgccauuggcgccguguuccaggaagaacaaggguggacgagugcguccgaggccgugaacgacucgcgguucugggagcuagucgacaaggaaagggcgcuacaccaggagggcaagugugaauccugcguguacaacaugaugggcaagcgcgagaagaaauugggcgaguucggccgggccaaagggucgcgcgcaauuugguacauguggcucggggcgcguuuucuugaguucgaggcccugggauuccucaacgaggaccacugguucggcagagagaacuccuggagcggcguugagggggagggccugcaccggcugggguacauccuggaggagaucgauaagaaggacggcgaccugauguacgcggacgacaccgccggcugggacacccgcaucacggaggacgaccugcagaacgaggagcugaucaccgagcagauggcgccccaccacaagauccuggccaaggccaucuucaagcugaccuaccaaaacaaggucguuaaggugcuccggcccaccccacgcggggccgucauggacaucaucagucguaaagaucagcgcggcagcgggcagguuggcacguacggcuuaaacacguucaccaacauggagguccagcugauccggcagauggaggccgagggcgucaucacccaagacgacaugcagaaccccaaggggcucaaagagcguguggagaaauggcuucgggagugcggggucgaccgccugaagcggauggcgaucuccggggacgacugcgucgugaagccccuugacgagcgcuucgggaccagccugcuguuccucaaugauauggguaaggugcggaaggacaucccccagugggaaccguccaaggguuggaaaaauuggcaggagguucccuuuugcagccaucauuuccacaagaucuucaugaaggacggccgcucccugguagugcccugccggaaccaggacgagcugauuggccgugcccgcauaagucagggggcaggcuggucccuccgugagacggccuguuuggggaaggccuacgcgcagauguggucgcuaauguauuuccaccgccgggaccugcgccuagccuccauggccaucuguucagcggucccaacugaaugguucccgaccagccgaaccacguggagcauccacgcccaucaccaguggaugacgaccgaggacaugcugaaaguuuggaaccgcguguggaucgaggauaaccccaacaugaucgauaagaccccgguccacaguugggaggacauccccuaccucggcaagcgcgaggaucuguggugcgggucccugaucggccucucaucccgagcgacgugggccaagaacauccacaccgccaucacccaggugcggaaccugaucggcaaggaagaauacguggacuacaugagcgucaugaagagguacagugccccuagcgaguccgagggggugcuuuga

SEQ ID NO: 26291 - RNA, 9867 nt, Artificial Sequence
  derived and/or modified CDS sequence (opt11) from DENV-4__KC762694__SS-prME
agcaccaugacccuccucugucugaucccuaccguuauggcguuccacuuguccacccgggacggggagccgcucaugauaguggccaagcacgagcgggggcgcccccugcuguucaagaccacggaggguaucaacaagugcacgcucaucgcgauggaccugggggagaugugcgaggacaccgugaccuacaagugccccuuacucgugaacacggaaccugaggacauugauuguuggugcaaccuuacgagcacuugggugauguacgggaccugcacgcaguccggggagcggaggcgggagaagcgcagcguggcccugacuccgcauucuggcaugggccucgagacccgugcagagaccuggaugagcuccgagggggccuggaagcaugcccagagaguggaaucuuggauccugaggaaucccggcuucgcgcugcucgccggguucauggccuacaugaucggucagaccggcauccagcgcaccgucuucuuugugcugaugaugcugguggcccccuccuacggcaugcggugcgucggcgucgggaauagggacuucguggagggcgugucagggggcgcguggguggaccuggugcuugagcauggcgggugcgucacgaccauggcccaggggaagccgacgcucgauuuugaacuaacgaagaccacagcgaaggagguggcgcugcugcggaccuauuguaucgaggcuuccaucagcaacaucacgaccgcuacccgcugcccgacccagggggagcccuaccucaaggaggaacaggaccagcaguauaucugccggcgcgauguugucgaccggggcuggggcaacggcugcggacucuucgggaagggcggcguggugacuugugccaaguuccuguguucgggcaagauaaccggcaaccucguacagaucgagaaccuggaauacaccguuguagucaccgugcacaacggcgacacacacgcugugggcaacgacacuagcaaucacggggucaccgccaccauaacgccccgcucccccagcguggagguuaaacuuccggacuacggcgagcucaccuuggacugugagccgcggagcggaaucgauuuuaacgagaugauucugaugaagaugaagaagaagacauggcucgugcacaaacagugguuccuugaccugccccuccccuggacggcaggcgcggacacuagcgaggugcacuggaacuacaaggagcgcaugguuacguucaagguuccgcacgcgaagcggcaggacgugaccgucuuaggaucccaagagggcgcuaugcacagcgccuuagccggcgcaaccgagguggacucaggggacggcaaccacauguuugccggacacuuaaagugcaaaguccgcauggagaaacugcgcauuaaaggcaugucuuauaccauguguucaggcaaguucuccaucgacaaggagauggcugaaacgcagcaugggaccaccguugugaagguaaaguaugaaggugcuggggcgcccugcaagguccccauagaaauccgggacgugaauaaagagaaaguggucggccgcauaaucagcuccacaccuuucgcggagaacacgaacagcguaacgaacaucgagcuggagccgcccuuuggggacucguauaucgugaucggcgucggagacucugcucucacauuacacugguuccggaaggguuccucgaucggcaagauguucgaguccaccuaccgaggggccaagcggauggcaauccugggagagacugcgugggacuucgggagugugggcggacucuuuaccucccugggaaaggccgugcaccagguuuucggaagcguauacacaaccauguucggagggguauccuggaugauccgcauccugaucggauuccucguccuguggaucggcacaaacagccgcaacaccuccauggcaaugacgugcaucgcugugggcgggauaacgcuguuccucgguuucacggugcaggcagacaugggaugugucguaucauggaacggcaaggagcucaagugcggguccggcauauucguggucgacaacguacauacguggacugagcaguacaaguuccaacccgaaagccccgcgcgccuggccagcgcaauccugaacgcccacaaggacggagugugcgggauccggagcacuagcagacucgagaacguuauguggaagcagaucacgaacgagcugaauuacguguuaugggagggcgggcaugaucucaccguggucgccggcgacgugaagggcgugcucaccaaggggaagcgugcgcuaacaccacccgucaacgacuuaaaguacuccuggaagacgugggggaaggcuaaaaucuucacucccgaggcacgcaacaguaccuucuuaaucgacgggccagacaccuccgagugcccgaaugaacggcgagcguggaauuucuuugagguugaggacuauggcuuugggauguuuacgaccaauauauggaugaaguuucgcgagggaucuucugaggugugcgaccaucgccugaugagcgcugcgaucaaagaccaaaaggccgugcacgccgauaugggcuacuggauagaguccagcaagaaccagaccuggcagauugagaaggcaucccucauagaggucaagaccugccucuggcccaaaacgcauacgcuguggagcaacggcguccucgagucucagaugcugaucccccggagcuacgcgggccccuucucccagcauaacuaccgccagggauacgcuacccagaccgccggccccuggcaccugggcaaacuugagaucgacuucggcgaguguccugggaccacggucacgauacaggaggacugcgaccaucgggggcccagccugagaaccaccaccgcgucuggcaaguuagugacccagugguguugucgcagcugcaccaugccaccccucagauuccuuggggaagauggcuguugguacgggauggagauacgcccccugagcgaaaaggaggaaaacauggugaaaagucaagucaccgcuggccagggcacgagugagaccuuuuccauggggcucuuaugccugaccuuauuuguggaggagugccuacggagacgugucacccgcaagcacaugauccuggugguggucaucacguuuugugcgaucauacuaggcgggcugaccuggauggaccugcuccgggcgcugaucaugcugggcgacaccaugagcggccgcaucgggggccagauccaccuugccaucauggccguguucaaaaugucccccggauacgucuuaggcguuuucuugagaaagcucaccagccgagaaacagcccugauggugaucggaauggcgaugaccaccguguucuccaucccgcacgaccugauggagcucaucgacggcaucagccugggccucauccuccugaagaucgucacccacuuugacaacacacaggugggaacucuggcccucucucugaccuucauccggucuacuacaccccuggugauggccuggcggaccauaauggccguguucuucgucguuacccucauaccucugugccggacaucaugccuucagaagcagagccacugggucgagauaacggcccucauucugggcgcccaggccuuacccguguaccucaugacucugaugaagggggcuucccgccggagcuggccucugaacgagggcaucauggcggucgggcuugucucccugcugggcagcgcauuacugaagaacgaugugccgcuugccggccccaugguggccggagggcucuugcuggccgcguacgugauguccgguagcuccgcugaucucagccuggaaaaggccgcgaaugugcagugggacgagauggccgauauuaccgguagcuccccuaucauagaggugaagcaagacgaagacggcagcuucuccauccgcgacguugaggagaccaacaugaucacgcugcucgugaaguuggcccugauuaccgugagcggccucuauccgcuugcgauucccguaacgauggccuugugguacguguggcaagugaagacccagcgguccggcgcucucugggaugucccuagccccgcugccacgcagaaagcuacucugagcgaggggguguaucgcaucaugcagcgaggccuuuucgggaagacccaggucggugucgggauucacauggagggcguguuccacaccauguggcacgugaccaggggcagcguuaucugccacgagacagggagacucgaaccaucgugggccgaugugcgcaacgacaugaucagcuacggcgguggcuggcgacugggcgauaaaugggacaaggaagaggacgugcagguccuggccauagagcccgggaaaaaccccaagcaugugcagaccaagccgggccucuucaagacccugacaggagaaaucggugccgugacguuggacuucaagccggggaccuccggaucccccaucaucaacaagaagggcaaggucaucggccucuacgguaaugggguggugaccaaauccggcgacuacgucagcgcuaucacucaagcggagcggaucggagagccagacuacgagguagaugaggacaucuuccgcaagaagcggcugacgaucauggaccugcacccgggcgcugguaagaccaagagaauccuacccuccauaguucgggaggcccuaaagcgucggcugcgcacgcugauacuggcucccacccggguuguggccgcagaaauggaagaggcccugcgcgggcugccuauccgcuaccagacaccagcugugaaaagcgagcauaccggccgcgagaucgucgaccucaugugccacgccaccuuuacaacgcgccugcuguccucuacgcgcgugccaaacuauaaccucaucguuauggacgaggcgcacuucacugaccccugcucgguugcagcgcggggguacaucagcacccgcguagagaugggagaggcagccgcgaucuuuaugaccgcgacgcccccgggcagcaucgaccccuucccucaguccaacagcccgauugaggauaucgaacgagagaucccggaacgcuccuggaauaccggcuucgacuggauuacagacuaccaaggcaagacagucugguucguucccagcauaaaagcggguaacgacaucgccaauugccuaaggaaguccggcaagcgcgugauccaguuaagccgcaagaccuucgauacugaguaucccaagaccaagcucacggacugggacuucgucgugaccaccgacaucuccgagaugggggcgaauuuccgggcgggucgcgugaucgauccccgacgcugccugaaaccggucauccugaccgacggucccgagcgagugauccucgcaggccccauucccgugacuccggccagcgccgcgcagcggagagggcguaucggacgaaaucccgcacaagaggacgaccaguacgucuuuuccggggauccccuuaaaaacgacgaagaccacgcccacuggaccgaagccaaaaugcugcucgacaacaucuacacccccgaggguaucaucccgacguuguucggccccgagcgcgagaagacccaggccaucgacggcgaguuccggcugcgcggggaacagcggaagaccuucguggagcucaugcgccggggcgaccuuccaguauggcugagcuacaagguggcgagugccggcaucagcuacaaggaccgcgaguggugcuucaccggcgagcguaauaaucaaauucucgaggagaacauggaggucgagauuuggacgcgugaaggggagaagaagaagcugcgacccaaguggcuggacgcacgcgucuaugccgacccgauggcccuaaaggacuucaaggaguucgcuucuggucgcaagagcauaacgcuagacauccugacagagaucgccacccuucccaccuaucucucuagcaaggccaagcuggcccuggacaacaucguaaugcugcauacaacggaaaaaggagggcgcgccuaccagcacgccuuaaacgagcucccugagagcuuggagacccugaugcucguggcgcuguugggagcaaugaccgccgggauauuccucuucuucaugcagggaaaggguaucggcaagcucagcaugggccugaucgcgauagccguggcguccggguuacuguggguagcugagauccagccccaguggaucgccgcgucuauaaucuuggaguucuuccucauggugcuucugauccccgagcccgagaaacagaggacaccccaagacaaucagcuuaucuaugugauucuuacgauucugaccauaauuggccucaucgccgccaacgagauggggcugaucgagaagacgaagacggacuucggcuucuaccaagucaagacggagaccaccauccuggacgucgaccuccguccggccagcgccuggacacuguacgcgguggccacgaccauccuaaccccuaugcuucgccacacaaucgagaacacgucugccaaccugagccucgcagccaucgccaaccaggcggcaguucucaugggacugggcaaaggauggccacuacaccgcauggaccugggcgugccccugcuggccaugggcugcuacucgcagguuaauccgaccacgcucaccgccagccuggugaugcugcuagugcacuaugcgaucauaggacccggauugcaagcgaaggcaacuagagaggcccagaagcgcaccgcugccggcauuaugaagaaccccacgguagacgggaucacugucaucgaccuggagcccauauccuacgaucccaaguucgagaagcagcucggccaggugaugcugcucgugcucugcgucgggcagcuccugcucaugcggacgacaugggcgcugugcgaggugcugaccuuagcuaccgggcccgugaugacucugugggaggguaaccccggccgguuuuggaacacuaccaucgccguguccacggcgaacaucuuccgcggcuccuaucuggcgggagcuggauuggcauucagucugaucaagaacgcccagacgccacggcguggcaccggcaccaccggugagacucugggcgaaaaguggaagcgacagcucaacucccuggaccguaaggaguucgaggaguacaagagaagcgggauucuggagguggacaggaccgaggcgaagucugccuugcgggauggaucuaagaucaaguacgccguaucccgcgguaguuccaagauccgguggaucguagagcgcgguaugaucaagccgaaggguaaaguuguggaccugggguguggucggggcggguggucguacuacauggccaccuugaagaacgucacagagguuaaaggguacaccaagggcgguccggggcaugaggagccuauucccauggcuacuuacggcuggaaccuugucaagcugcacuccggcguggacguguucuacaagcccaccgaacagguggacacccuguuaugcgauaucggcgagagcucgagcaacccgaccaucgaagagggccgaacgcuccgcguccugaagauggucgagcccuggcuaucgaguaaacccgaguuuugcaucaagguacugaacccuuacaugcccacugugaucgaggagcuggagaagcuccagcggagacacgguggaagccucguucggugcccccugucccggaacucgacccaugagauguauugggucuccggagcgucagggaacaucgugucuagcguuaauaccaucuccaagaugcugcugaaccgcuuuaccacccgccaccggaagcccaccuaugaaaaggacguggaucugggugcugggacacgaagcgugucaacagagaccgaaaaaccggauaugaccauaaucggccggcgccugcagaggcuccgcgaggagcacaaggaaaccuggcacuacgaccaggagaauccuuaucggacgugggccuaccacgggagcuacgaggcgccauccaccggaagcgcgucuagcauggugaauggcgucguaaaguuacugacgaagccgugggaugugauccccaugguaacucagcuggccaugacggacaccacccccuucggacagcagcgcguguucaaggagaagguugacaccagaacgccccaaccaaagcccggcaccagaaugauuaugacgaccacggccaacuggcugugggcccugcuagggaagaagaaauccccacgcuugugcacucgcgaggaguucauaagcaagguacggagcaacgccgcgaucggcgccguguuucaggaagaacagggguggaccagcgccagcgaggccgugaacgauagccgcuucugggaacuggucgauaaagagcgagcccuacaccaagagggcaagugcgagagcugcguguauaacaugaugggcaagcgcgagaagaaguuaggggaguucggccgagcgaaagggucucgggccaucugguacauguggcugggcgcccgcuuccucgaguucgaggcccugggcuuccugaacgaggaccacugguucagccgggagaacuccuggagcggcguggaaggcgaaggguugcaccgacugggcuacauccuggaggacaucgauaagaaagacggggaccucaucuacgccgacgacaccgcgggaugggacacgaggauaacggaggacgacuuguuaaaugaggaacucaucacggagcaaauggcgccucaccacaagacccucgcuaaggccaucuucaagcugacguaucaaaacaaggucgugaaggugcuccgcccuaccccgaagggcgcggucauggacaucaucagccggaaagaccaacgcgggagcggccagguaggcaccuacggccugaacaccuucaccaacauggaagugcagcugauacgccaaauggaggcagagggugucauaacacaggacgacaugcagaacccgaagggccugaaggagcgcgucgagaaguggcuuaaagagugcggcguggaccggcugaagcgcauggccauauccggagacgacugcgucgugaagccccucgacgagcgcuucucuacgucccuccuguuccuuaaugacauggggaaagugcggaaggacaucccgcaaugggagcccagcaaaggguggaagaacuggcaggaagugccauucuguucccaucacuuccauaagauauucaugaaggacggacggagccugguggugcccugucgcaaccaggaugagcugaucgggcgggcucgaaucucccagggcgccggcuggagccugcgggagaccgcuugucuaggcaaggcguaugcgcagauguggagcuugauguauuuucaccgccgcgaccuccgguuggccucgauggcuaucuguagcgcggucccgacugagugguuccccacgucaaggaccaccuggucuauccacgcccaucaccaguggaugaccacggaagacaugcuuaaaguguggaaccgggucuggaucgaggacaaucccaauaugacugacaagacacccguacacagcugggaggacaucccguaccucgggaagcgcgaggacuuguggugugggagccugaucgggcuguccucucgggccacgugggccaagaacauccacacggccauuacccagguccgcaaucucaucgguaaagaggaguacguggauuacaugccugccaugaaacguuacuccgcacccuuugagagugagggcguacuguag

SEQ ID NO: 26292 - RNA, 9867 nt, Artificial Sequence
  derived and/or modified CDS sequence (opt11) from DENV-4__KC762695__SS-prME
ucgaccaugacccugcuuugucuaaucccgaccgccauggccuuucaccugagcacccgggacggcgaaccgcucaugaucguggcgaagcacgagagaggccgcccccugcuauucaagaccaccgagggcaucaacaagugcacccuaaucgcuauggaccugggggagaugugcgaggacaccgugacauacaagugcccucugcucgugaauaccgagcccgaggacauagauagcuggugcaaccugacguccaccugggugauguacgggaccugcacccagagcggggagagacggcgggagaaacgcuccguggcccuuacgccacacaguggcauggggcucgaaacccgggccgagaccuggauguccucggagggggcguggaaacacgcgcagcgcguggagucguggauccugaggaaccccggcuuugcccugcucgcgggguucauggccuacaugaucgggcagaccgggauccaacgcacgguguucuuuguccugaugaugcugguggcgcccagcuacgguaugcgcugcgugggagucgggaaccgcgauuucguggagggcguguccgggggcgccuggguagaccucgugcuggagcacggcgguugugugacuaccauggcucagggcaagccaacacuagacuucgaacucacgaagaccaccgcgaaggaggucgccuugcugcguaccuauugcauagaggcgucaaucuccaacaucacgaccgcaaccagaugcccgacgcagggagagccguaccucaaggaggaacaggaccagcaguacauuugcagacgcgacgugguggaccgggguugggggaacggcugcggccuguucgguaagggcggggucgugacgugcgccaaguuccuguguagcgguaagauuaccgggaaccucguccagauagagaaccuugaguauacgguuguggugacaguccauaacggcgacacgcacgccguuggcaacgacacuuccaaccacggugucaccgccacuaucacgccccgaagccccucgguggaggugaagcugccggauuacggcgagcucacccuggacugugagccucggagcggaaucgacuucaacgagaugauccugaugaagaugaagaagaaaaccuggcucguccacaagcagugguuccuggaccugccccucccauggaccgcgggagccgacaccuccgaggugcacuggaacuacaaggaacgcauggucaccuuuaaagucccgcacgccaagcgacaggaugugacgguucucgggagccaggaaggggccaugcacagcgcccuggcgggcgccaccgagguugacuccggcaacggcaaccacauguucgccgggcaccucaaguguaaggugcgcauggagaagcugaggauuaaggguaugagcuacaccaugugcuccgggaaauucagcaucgacaaggagauggccgagacgcagcacgggacaaccguagucaaggugaaguacgagggcgccggggcgcccuguaaggugcccaucgaaaucagagacgugaacaaggagaagguagugggccgcaucaucuccagcacccccuucgccgaaaacacgaacuccgucaccaacaucgagcuggagccacccuucggggauagcuacaucgugaucggcguuggcgauuccgcccuuaccuuacacugguuccgcaagggcucguccaucgguaagauguucgagagcaccuacaggggggccaagcggauggcgauccugggcgagacagccugggacuucgguuccgucggcggccucuucaccucucuagggaaggccauccaccaggucuucggcuccguguacacaaccauguucgggggugucuccuggaugauccgcauccugaucgggcuccugguucuguggauaggcaccaacagccggaacaccagcauggccaugaccugcaucgccgugggcgggaucacgcuguuccucggguucacgguucaagcggacauggggugcgugguguccuggaacggcaaggaacugaagugcggcagcgggaucuucguaguggauaacguacacaccuggacugagcaguacaaauuucagcccgagagcccagcucgccuggcuagugcaauccucaacgcacacaaggacggcgucugcgggauccggaguaccacgcgccuagagaaugucauguggaagcaaauaaccaacgagcugaacuaugugcugugggagggcgggcacgaccugaccgugguugcgggcgacguuaagggaguccugaccaaggggaagcgggcccuaaccccgcccgugaacgacuugaaguacuccuggaagaccuggggcaaggccaagaucuucacccccgaggcccgaaauagcaccuuccugauagacgggcccgacacguccgaaugcccgaacgagcgucgcgccuggaacuuucucgagguugaggacuauggcuucgggauguucucuaccaacaucuggaugaaguuccgggaggggucaagcgaggucugcgaccaucgucucauguccgcugccauuaaggaccaaaaggccgugcaugccgacaugggcuauuggaucgagagcuccaagaaccaaacauggcagaucgaaaaggcgagccugaucgaggugaagaccugccucuggcccaaaacgcacacccugugguccaacgggguccuggagucucagaugcucaucccccguucuuacgcgggcccguucagccagcacaauuaccgccaggguuaugcuacccagaucgccggcccauggcaucugggaaaacuggagauugacuucggcgagugccccggcaccacugugacgauccaagaggacugcgaccaccgggggcccuccuugcgcacaaccacggccagcggcaagcugguuacgcaguggugcugccgcaguuguaccaugccaccccugcgguuccucggcgaggauggcugcugguacgggauggagauccgccccuuaucagagaaggaagagaacaugguuaaaucacaggugaccgcgggucagggcaccucggaaacguuuagcauggggcugcucugccugacccuguucguggaggaaugccuacggagacgggucacccgcaagcauaugaucuugguggucaccaucacguucugugcaaucauccugggcgggcucaccuggauggaccuccuucgagcccucaucaugcugggggacaccaugaguggccgaaucgggggccagauccaccuggcgaucauggccguguucaagaugagccccggguacguucucggcgucuuccugcggaagcugaccucccgagagacggcccucauggugaucgguauggccaugaccaccguauuuagcaucccgcacgacuuaauggagcugaucgauggcaucucccucggauugauccuccuuaagauagucacccauuuugacgacacccagguggggacccuggcccugagccucaccuucauccgguccaccacgccccugguuauggcguggaggaccaucauggccguuuucuucguggugacccugauuccucucugccggaccaguugucugcagaagcagucccauugggucgagauuacggcgcuaauacuuggcgcccaggcccugcccguguaccugaugacccucaugaagggagccagccggcgauccuggccgcuuaacgagggcaucauggcggugggccugguaagccuacuuggcuccgcccugcuuaagaaugacgugccccuagccggccccaugguggccgggggacugcuucuggcggcguacguuaugagcgggaguuccgccgaccugucucucgagaaggccgccaacgugcagugggacgagauggccgacaucacaggcuccucucccaucauagaggugaagcaagacgaagacggguccuucagcauccgcgauguggaggaaaccaacaugaucacgcuucuuguuaagcucgcucugaucacgguguccggccuuuacccgcucgccaucccgguaacgauggcucuaugguacaucuggcaggucaagacccaacgaagcggcgcccugugggauguucccucccccgucgccacgcaaaaggcgacccuuucagaggggguguaucgcauuaugcagcgcggacuguucgggaagacccaggucggggucggcauccacauggagggcguguuccacaccauguggcacguuacccgcggcuccgucauaugccaugagacggggaggcucgaaccaagcugggccgacgugcgcaacgacaugaucuccuacggggggggcuggcgccugggcgacaagugggauaaggaggaagacgugcagguccuggcaaucgagccggggaagaacccgaagcacgugcaaaccaagcccggccuguucaagacgcucaccggagagaucggcgcagugacgcuggacuucaagccagggaccagcggcucacccaucauaaacaagaagggcaaggucaucgggcuguacggcaacggcgucgucaccaagagcggcgacuacgucucagccaucacucaagcggagcgcaucggggagcccgacuacgagguggacgaggacauuuuucgcaaaaaacggcucacgauaauggaccugcacccaggcgccggaaagaccaagcgcauccugccuucgaucgugcgagaagcccucaagaggcggcugcgcacccuaauccuggccccaacccggguaguggcggcugagauggaagaggcacuccgaggccugcccauccgguaccagacgccggccgucaaguccgaacacaccggccgagagauaguggaccucaugugccaugccaccuuuaccacgagacuucugucauccacccgagugcccaacuacaaccugaucgugauggacgaggcgcacuucaccgaucccugcagugucgcagccagaggguacauaagcacccgcguugagaugggcgaggccgccgcaaucuucaugacggccacgcccccggggaguaccgaccccuucccucagagcaacucgccaaucgaggacaucgaacgagagauccccgaacgcagcuggaacacaggcuucgacuggauaacugauuaccagggaaagaccguaugguuugugcccaguaucaaggccgggaacgacaucgccaacugccuccgcaagagcggcaaacgcgugauccagcugucccggaagaccuucgacaccgaguauccuaagacgaagcugaccgacugggacuuuguaguaaccacagauaucagcgagaugggagccaacuuccgggcgggacgcguuaucgacccucgucguugccucaagccgguuauccugacagacggcccggagcgggugauauuggcgggccccauccccgugacgccggccucugccgcccagcggagaggccgcauugggcggaacccggcccaggaggacgaccaguaugucuuuucaggcgacccccucaagaacgacgaggaucacgcucacuggacugaggcaaagaugcuguuagacaauaucuacacccccgaggggaucaucccgacccuuuuuggccccgaaagagagaagacccaagccaucgacggcgaguuccggcugcgcggggagcagcggaagaccuucgucgagcucaugcgccggggugaccuccccguguggcugucauauaagguggcuagcgcagggauauccuacaaggaccgcgaguggugcuuuaccggagagagaaacaaccagaucuuagaggagaacauggagguggagaucuggacgcgcgagggggagaagaagaagcucaggcccaaguggcuggacgcccggguguacgcagacccgauggcacuuaaggacuucaaggaauuugcaucgggacggaaguccaucacccucgacaucuugacggagauagccaccuugccaaccuaucucagcuccaaggcaaaacuggcccuggacaacauugugaugcuccauacgaccgagaagggagggcgcgccuaccagcacgcguuaaacgagcugccugagagccucgagaccuugauguuaguggcccucuugggugccaugacagccgggaucuuccuguucuucaugcagggcaaggggauaggcaaguuguccaucggccugaucgccaucgccgucgcgagcggacugcucugggucgcggaaauccagccgcaguggauagcugcgagcauuauccuggaguucuuccugaugguacuacuuauccccgaaccggagaaacagcggacgccccaggauaaccagcugaucuacgugauccucaccauucugacuaucauagggcugaucgcggcuaacgagaugggguuaaucgagaagacuaagacggacuuuggcuucuaccaggucaagaccgagaccacgauacuggacguggaucugcggccggccuccgccuggacgcuguaugcgguggccaccaccauccugacccccaugcugagacauacgaucgagaauacgagcgccaaucuuucccuggcugcgauugcgaaccaagccgcuguucugaugggacucggaaagggcuggccgcugcaccgaauggaccugggugugccccucuuagcuaugggcugcuacagccaagugaacccaaccacccugaccgcaucccucgucaugcuguuagugcauuacgcgaucaucggcccuggccuacaggccaaggccacccgugaggcccagaagcggaccgcggcagguaucaugaagaaucccaccguggaugggaucacggucaucgaccuggagcccaucuccuacgacccuaaguucgagaagcagcuggggcaagucaugcuccuggugcugugcgucgggcagcuccuguuaaugcgcacaaccugggcccucugcgaggugcuuacccuggccacggggcccaucaugacccugugggaggggaaccccggccgguuuuggaacaccaccaucgcggucuccaccgcuaacaucuuccgcggcaguuaccuggcgggggcaggacuggccuuuucccucaucaagaacgcacagacuccccggcgugggacaggcaccacgggggaaacccugggggagaaguggaagcggcaguuaaacagccuugaccgcaaggaguucgaagaguacaagcggucugguauccuggagguagaucgcaccgaggccaagagcgcccugcgggacgggagcaagaucaaacacgccgugagcagaggcuccucaaagauccgguggaucguggagcgcgggaugaucaagccgaaaggaaaggucguggaucucgggugcggcagaggcgggugguccuauuacauggcgacuuuaaagaacguuaccgaagucaagggguacacgaagggcgggcccgggcaugaagagcccauucccauggccacuuacggcuggaaccuggugaagcuccacucugguguggaugucuucuacaaaccuaccgagcaggucgacacccuccugugcgauaucggagagucaagcagcaaccccacgauagaggagggacguacccuccgugugcuaaagauggucgagcccuggcuguccaguaagcccgaguucugcauuaagguccucaaucccuacaugcccaccgugaucgaggagcuggagaagcugcagaggcgccacggggguucccugguccggugccccuuaucccgcaacuccacccacgagauguacugggugagcggcgcgucagggaacaucgucagcucagugaacacgaucucuaagaugcuguugaaccgguucaccacccgccaccgaaagcccaccuaugagaaggacguggaccucggcgccggaacgcgcuccgucagcaccgagacagagaagccggacaugaccaucauaggccggcgccugcagcggcugagggaggagcacaaggagacauggcacuacgaccaggaaaacccuuaccguacuugggccuaccacgggucauacgaggcaccuagcaccggaucggcgaguuccauggugaaugggguggucaagcuacugaccaagccgugggacgugaucccuauggugacccagcuagccaugacggacacaacccccuucgggcagcagcgcgucuucaaggagaaaguagacacgcggacuccccaaccgaagcccggcaccaggaugaucaugaccacgaccgccaacuggcucugggcccugcuggggaagaagaaguccccgagacucuguacgagggaggaguucauuuccaagguacggagcaacgccgcgaucggcgccgucuuccaggaggagcagggguggaccagcgcauccgaggccgugaacgacagccgcuucugggagcuuguugacaaagagcgagccuugcaucaagaggguaagugcgaguccugcgucuacaacaugaugggcaagcgcgaaaagaagcuaggggaguucggucgcgcaaaggggagccgggcgaucugguauauguggcugggggcccgcuuccuggaguucgaagcccucggauuccugaacgaggaccacugguucucacgggagaacagcugguccggcguagagggggaggggcugcaccgucucggcuacauacuggaggacauugacaaaaaggacggugaccugaucuacgccgacgauacggcgggaugggacacccgaaucaccgaggacgaucuacugaacgaggaacugaucaccgagcagauggcgccccaucacaagacacucgccaaggcgaucuucaagcugaccuaccaaaacaagguggucaagguguugcgccccacccccaagggcgcggugauggacaucaucagccggaaggaucagcgcgggaguggccaagucggcaccuacggccuuaacacguucacgaauauggagguccaguugauacgacagauggaggccgaaggcgugaucacccaggacgacaugcagaacccuaagggccuggaggaacgcgucgagaaguggcucaaggagugcggcgucgaccggcugaagcgcauggccaucagcggagacgauugcguugucaagccccuggaugaacgguucuccaccagccucuuguuccuaaacgacauggguaaggugcggaaggacauaccgcagugggaacccuccaagggguggaagaacuggcaggaggugcccuucuguagccaccacuuucauaagaucuucaugaaggaugggcggucccucgucguccccugcagaaaucaggacgaacugauagggcgggcccgcaucucgcagggcgccggcuggucccugcgagagaccgcgugucucgggaaagccuacgcucagauguggagccugauguauuuccaucgccgcgaucugcgcuuagccagcauggcuaucugcuccgccgucccgacggagugguuccccauaagccgcaccacuugguccauccacgcccaccaucaguggaugaccacggaggacaugcugaaaguguggaaccggguuuggaucgaggauaaccccaacaugacugacaagacccccauacacagcugggaagacaucccguaccugggcaaacgcgaggaucucuggugcgggucccugaucggccugucgucccgggccacaugggcuaagaacauccacacggccaucagccaagugcgcaaccucauagggaaggaggaauaugucgacuauaugccggugaugaagcgguacuccgcgcccagcgagagugagggugugcuguga

SEQ ID NO: 26293 - RNA, 9867 nt, Artificial Sequence
  derived and/or modified CDS sequence (opt11) from DENV-4__KC762696__SS-prME
agcaccaugacccucuugugccugauaccaaccguuauggccuuucaccugagcaccagagacggcgagccguugaugauaguggccaagcacgagcgggggcgcccucugcuguucaagaccaccgaggguauuaacaaguguacccucaucgcgauggaccugggggaaaugugugaggacaccguaaccuacaaguguccucugcuugugaacaccgagcccgaagacauagacugcuggugcaaccuuaccuccacgugggugauguacgggacgugcacgcaauccggggagcggcgcagggagaagagaagcgucgcccuaacgccgcacuccggcaugggccuggagacgcgggccgagaccuggaugucuuccgagggggcguggaagcacgcgcagcgcguggagaguuggauccugcggaaccccggcuucgcacugcucgccggguucauggcauauaugaucggccagacagggauucagcgcacgguauucuucguucuaaugaugcugguggcacccaguuacggcaugcggugcgucggcgugggaaaccgcgacuucguugaaggagucagcggaggggcguggguggaccucguucucgaacacggcgggugcguaaccaccauggcccaggggaagccgacucuggauuucgagcuuacgaagacuaccgcaaaggagguggcccugcugcgcaccuacuguaucgaagccuccauauccaacaucacgaccgcgacccgcugcccaacccagggggagcccuaccucaaggaagaacaagaccaacaauacaucugccggagggacguagucgaccggggcugggggaacggaugcggccuguucgggaagggcggaguggucacuugcgccaaguuccuuugcuccgguaaaaucaccgggaaccucguccagauagagaaucuggaguauaccgugguggucaccgugcauaauggcgauacgcacgccgucggaaacgauaccagcaaccauggagugaccgccaccauuacaccgcgcuccccgagugucgaggucaagcugccugacuacggcgagcucaccuuggacugcgagccaaggucggggaucgacuuuaacgagaugauucugaugaaaaugaagaagaagaccuggcuuguccauaagcagugguuccuggaccuuccccucccguggaccgccggggcggauacaagcgaggugcacuggaauuacaaggaacgcaugguuacguucaaggugccucacgccaaaaggcaagacguuaccguccuggggucccaggagggcgccaugcacagcgcccuugcuggggcaaccgaagucgacaguggggacggcaaucacauguucgccgggcaccugaaguguaaaguacgcauggagaaacugaggaucaagggcaugucguauacuaugugcagcggcaaguucagcaucgacaaggagauggccgagacgcagcacgguaccaccguuguaaaggugaaguacgaaggcgccggcgccccgugcaagguccccaucgagauucgcgacgugaacaaggagaaaguggucggccgcaucaucagcuccacucccuucgcggagaacacgaacagcguaaccaacaucgagcuggaaccgcccuuuggggacuccuacaucgugaucggcgucggcgacuccgcccucacccugcauugguucagaaagggguccagcauugguaagauguucgaguccacuuaccggggagcuaagcggauggccauccugggcgagacggccugggacuucgggagcgugggcgggcucuuuaccucccuggggaaggccguccaccaggucuucggcagcguguacaccaccauguucggcggcguguccuggaugauccguaucuugaucggcuuccucguccuguggaucggcaccaacagccggaacaccuccauggccaugaccugcaucgccgugggcgggaucacccuguuccugggguucacugugcaggccgacaugggcugcguugugagcuggaacggcaaggagcucaagugcgggucggguaucuuuguggucgauaacgugcacaccuggaccgaacaauauaaguuccagcccgaaagccccgcgcgccuggcgagcgccauccugaaugcccacaaggacggggugugcgguauccgguccaccacucgacucgagaacgucauguggaagcagauuacaaacgagcugaacuacgugcugugggaagguggacacgaccuuaccguggucgccggcgacgugaagggaguacucaccaaagggaagcgggcgcugaccccgcccgucaacgaccuuaaguacagcuggaagaccugggggaaggccaaaauuuuuacccccgaagcuaggaacagcaccuuccugaucgacggcccagacacgagcgagugcccuaacgagcggagagccuggaacuucuucgagguggaagacuacggcuucgggauguucaccaccaacaucuggaugaaguuccgggagggcucgagcgaggugugcgaccaccgcuuaauguccgcggcaaucaaggaccagaaggcgguccacgccgacaugggauacuggaucgagagcuccaagaaccagacguggcaaaucgaaaaagcaagccucaucgagguaaagacuugccucuggcccaagacucacacucuuugguccaaugguguguuggagucacagaugcugaucccucgguccuaugcgggaccguucucacagcacaacuaccgccaaggguacgccacgcaaaccgcugggcccuggcaccucgggaaacucgaaaucgacuucggcgagugucccgguacgacggucaccauacaggaggacugcgaucaccgugguccgucccucaggaccacaaccgccagcggcaagcuggugacacagugguguugcaggaguuguaccaugccgccccuccgcuuccugggggaggacggcugcugguacggaauggagauccgccccuuaagcgagaaggaggagaacauggucaaaagccaagucacggccggccaaggcaccuccgagaccuucagcauggggcuccugugccugacccucuucguggaggaauguuuacggcgccgggucacccgcaagcacaugauccugguggugguaaucacuuucugcgcgaucauccucggcgggcugaccuggauggaccugcuccgggcccugaucauguugggcgacacgauguccggcagaaucggcgggcagauccaucuagccaucauggccguguuuaagaugagccccggguauguucugggcguguuccugcggaagcuaacaucccgagagaccgcccugauggugaucgggauggcgaugaccaccguguucuccaucccgcacgaccugauggagcucaucgacggcauuucccugggccugauaauacuuaagaucgugacgcacuucgauaacacccaaguugguacccuggcccuuucuuuaaccuucauccguagcacuacgccccuugugauggccuggaggacuaucauggccgucuucuuuguggugacccuuaucccccuuugccggacgucuugccuucagaaacaaucccacugggucgaaauaaccgcccugauucucggagcgcaggcgcugccuguguaccugaugacccucaugaaaggggccagccgccgguccuggccgcugaacgagggcaucauggcgguggggcugguuagccuccugggcagugcgcugcuaaagaacgacguuccccuggccggucccaugguggccgggggccuguugcuggccgccuaugucaugagcggguccuccgcggaccugucccucgagaaggccgccaacgugcaaugggacgagauggccgacaucaccggcagcucucccauuauugaggugaagcaggacgaggacggguccuucagcauccgugacgucgaggaaacuaacaugauuacccugcugguaaagcucgcccugaucaccgucuccggccuguacccauuagcgaucccggucaccauggccuugugguacguguggcaggucaagacacagcgaagcggcgcccugugggacguuccgucgcccgccgcuacacaaaaggcgacacugagcgaaggggucuaccgcauaaugcagcgaggccuguucgggaagacccaggugggcgucgggauccacauggagggcguguuccacaccauguggcacguaacgaggggcuccgucauuugccacgagaccgggcggcuggagccgucaugggccgacgugcguaacgacaugauauccuacggcggggguuggcgccucggcgauaagugggacaaagaagaggaugugcagguccuggccaucgagcccggcaagaaccccaagcacguucagaccaagcccggacuauucaagacgcucacgggggagaucggcgccgugacccuggacuucaagcccgggaccagcggcagucccauuaucaauaagaagggcaaggucaucgggcuguacggcaaugggguugugaccaagagcggggacuacgucagugcaaucacacaggcggaacggaucggggagccagauuacgagguggacgaggacaucuuccgcaagaagagguuaaccaucauggaccuacacccgggcgccggcaagaccaagcgcauucuucccucgaucguacgagaggcuuuaaagcgacgacugcgcacccugauccucgcccccacgcgggucguggcggccgagauggaggaggcguugcgcggccuucccauccgguaccaaacgccggccgugaaaagcgagcacaccggccgcgaaaucguugacuugaugugucacgcaaccuuuaccacccggcucuuaucaucgacccgagugcccaacuauaaccugaucgucauggacgaggcacacuucacugaucccugcagcguggccgcccggggauacaucaguacccgcguggagaugggcgaagcagccgcgauuuucaugaccgcuacacccccggggucuauugacccuuucccccaaaguaacuccccuauagaggacaucgagcgggaaaucccggagcgcagcuggaacaccggcuuugacuggaucaccgacuaucagggcaaaaccgugugguucguccccucgaucaaggccgggaacgacauagccaacugccuccgcaagagcgggaagagggugauccaauuauccaggaaaaccuucgacaccgaguaccccaagacaaagcugaccgacugggacuucguugugacuaccgacaucagcgagaugggggccaacuuccgggcgggucgcgugaucgacccucggcgcugccucaagccgguaauucugacagaugggcccgagagagugauccuggccggccccauccccgugacccccgccuccgccgcgcagcgccggggcaggaucggacggaauccagcccaagaggacgaccaauacgucuucagcggcgacccccucaagaacgacgaggaccacgcccacuggaccgaggccaagaugcugcuggacaauaucuacaccccagaggggaucaucccgacccuauucggccccgagcgcgaaaagacccaggccauugacggcgaguuucggcugcgcggggagcagcgcaagacuuuuguggagcugaugagacggggagaccuccccguguggcuuuccuacaaggucgcgagcgccgggaucuccuacaaggaccgcgaguggugcuucaccggggagagaaauaaccagauccuggaggagaauauggagguggagaucuggacuagggagggagagaagaagaaguugcggcccaagugguuagacgcgcgcguguacgccgauccgauggcauuaaaggacuuuaaggaguucgcgagcgggcggaaguccaucacgcucgacauacugaccgaaauagccacccuacccaccuaccucagcagcaaggccaagcuagcccuggacaacaucgucauguuacacacgaccgagaagggcggacgcgccuaucaacaugcgcugaacgagcugcccgagucacucgagacccugaugcugguggcccuccugggagcgaugaccgccgggaucuucuuauucuucaugcagggaaagggcauuggcaaacuuuccaugggacugaucgcgaucgccgucgccagcggccugcucuggguugcggagauccagccgcaguggaucgccgcgucgaucauucuggaguucuuccugauggugcuccugauccccgagcccgagaagcagcguacaccccaggauaaccagcugaucuacgugauccucaccauccugaccaucaucggccugauugccgccaacgagauggggcucaucgagaagaccaagacggacuucggcuucuaccaggucaaaaccgagaccacaauccuggacguggacuugcgcccggccuccgccuggacgcuguacgcggucgcuaccaccauccugacucccaugcugcgccacacgaucgagaauaccucggcuaaccucucccuugccgcuaucgcaaaccaagcugccguacugauggggcugggcaagggcuggccacugcaccggauggaccugggaguuccccuccucgccaugggcugcuacucacagguaaauccgaccacccugacggcuucccuagucauguugcuggugcacuaugcgaucaucgggcccggcuugcaggccaaagcuacccgcgaggcccagaagcggaccgcggccggcaucaugaagaaccccacgguggacgggaucacgguuaucgacuuggagcccaucagcuacgauccgaaguucgagaagcaacugggccaggugaugcugcugguguuaugcgucgggcagcuccugcugaugcgcaccaccugggcccucugcgaaguucugacccuagcaacgggcccggugaugacccucugggaggggaaucccggacgguucuggaacaccaccaucgcugucuccaccgcgaacaucuuccgcggcagcuaccuggccggggccggccuggccuuuagccucaucaagaacgcucaaacgccccgucgcgggacggguacgacgggggagacccugggcgagaaguggaagcgccaacugaauagccuagaucgcaaggaguucgaggaauacaagcggucggggauccuagagguggaccgcaccgaggcaaagagcgccuuacgggacgguuccaaaaucaaguaugccgucagccggggcuccagcaaaauccgguggauagucgagcgcggcaugaucaaacccaagggcaaagugguggaccuagggugcggccggggcgggugguccuacuacauggccacguuaaagaacgugaccgaagugaagggcuacaccaaagggggccccgggcacgaggagccgauccccauggccaccuacggguggaaccuggugaaacuucacucuggcgucgauguguucuacaagccgaccgagcaaguugacacccuguugugcgauaucggggaguccagcucaaaccccaccaucgaagagggccgcacacuccgcguccuaaagaugguugagcccuggcucagcagcaagcccgaguucugcaucaagguucucaaccccuacaugcccaccgugauagaggaacuggaaaagcugcagcggcgccacgggggcucccucguacggugcccccugagccgcaacuccacccacgaaauguauugggucucuggcgcguccgggaacaucgugagcuccgugaauacgauuuccaaaaugcuguuaaaccguuuuaccaccaggcaccggaagcccacguacgagaaggacguugaccucggcgccgggacgcgcuccguguccacugagaccgagaagccggacaugaccaucauaggacggcgccugcagagacuacgggaagaacacaaggagacguggcacuaugaccaggagaaccccuaccgcacaugggcuuaccacggguccuaugaggcacccagcacaggcuccgcgagcuccauggugaauggcguggugaagcuccugaccaagccaugggacgugauccccauggucacucaguuagccaugacugacaccacgccuuuugggcagcagcggguguucaaagagaagguggacacgcggacgccccagccuaagcccggcacucgcaugauaaugacgacaacugcaaacuggcucugggcccugcuggggaaaaagaagucaccgcggcucugcaccagagaggaguucauuuccaaaguccggucuaaugcugcgauuggggccgucuuccaggaagaacaaggguggaccuccgccagcgaagccgugaacgacucuagguucugggagcuggucgacaaggagcgggcccugcaccaggagggcaagugcgaguccugcguguacaacaugaugggcaagcgcgagaagaagcucggggaguucggccgugcgaaggggucgcgcgccauuugguauauguggcugggcgcgcgcuuucuggaguucgaagcccucggauucuugaacgaggaccacugguucucccgggagaacagcuggagcggcguggagggcgaggggcugcaucgccucggcuacauacuggaagauaucgacaaaaaggacggggaccugaucuacgccgacgacacggcgggcugggacacacggaucacagaggacgaccuccugaacgaggaguuaaucacagagcagauggcuccucaccacaagacgcuggccaaggccaucuucaagcugaccuaccagaacaaggucguuaaggugcugcgcccaacacccaagggcgcggucauggauaucaucagccggaaggaccagcgugggaguggccagguggggacguacggccucaacacuuucacgaauauggaggugcaacugauccggcaaauggaggcggagggggucauaacccaggacgacaugcagaaucccaagggccugaaggagaggguggagaaauggcucaaggaauguggcguggaccggcugaagcgcauggcgaucagcggggacgacugcgucguuaaaccccuugaugagcgguucuccaccagccucuuguuccuaaacgacaugggcaaggugcgcaaggacaucccccaaugggagcccuccaagggguggaagaacuggcaggagguccccuuuugcucgcaccacuuccacaagaucuucaugaaggacggcagauccuuaguggucccaugccgcaacccagacgaguugaucgggcgcgcucgcaucagccagggcgccggcugguccuugcgggagaccgccugccuggggaaggccuacgcccaaauguggagccugauguacuuccaccgccgcgacuuacggcucgccuccauggcgauuugcagcgcgguucccacggagugguuccccaccagccgcaccacaugguccauacacgcccaccaccaguggaugacuacggaggacaugcugaagguguggaaccgcguguggaucgaggacaaccccaacaugaccgacaagaccccgguccacagcugggaggauaucccguaccucggcaagcgcgaggaccucuggugcgggucacugauaggcuuaagcucccgggccacgugggccaagaacauccacacagccauuacacaggugcgcaaccucauaggaaaggaggaguacguggacuacaugcccgcaaugaagcgguauuccgcccccuucgaauccgaaggcgugcuguga

SEQ ID NO: 26294 - RNA, 9867 nt, Artificial Sequence
  derived and/or modified CDS sequence (opt11) from DENV-4__KC762697__SS-prME
agcaccaugacccuucucugcuugauccccacugccauggcuuuucaccugagcacccgggacggggagccgcucaugaucguggcgaagcacgaacgggggaggccccugcuguucaagacuacggaaggcaucaacaaguguacccugaucgccauggaccugggggagaugugugaggacaccgugaccuacaagugcccccugcuugugaacaccgaaccggaggauauugacuguuggugcaaccucacgagcaccugggugauguacgggaccugcacucagagcggggagcggcgccgggagaagcgcagcguggcccugacgccgcacagcggcaugggccucgagacccgggccgagaccuggaugagcuccgagggggcuuggaagcacgcgcagcgcgucgaguccuggauccugcgaaacccgggcuucgcgcugcucgccggcuucauggcuuacaugaucgggcagacggggauccagcggacgguguuuuucgugcugaugauguuaguggcgcccagcuauggcaugcggugugugggugucgggaaccgcgacuuuguugaaggggugagcgggggagccugggucgaccucgugcuggagcauggugggugcguuaccacuauggcccagggcaagcccacacuggacuucgagcucacgaagaccacggccaaggaggucgcucugcugcggacuuauuguauagaggcguccaucagcaacaucacaaccgccacccgcugcccgacccaaggggagccuuacuuaaaggaggagcaggaccagcaguacaucugccggcgcgacgugguggaccgggggugggggaacggcugcggcuuguucgggaagggcgggguggugacgugcgccaaguuucugugcucugggaagaucaccgguaaccugguucagaucgagaaucuagaguacaccgucguggugacuguacacaacggagacacgcacgccgugggcaacgacaccagcaaccacgggguaaccgccaccaucacaccccgcucucccaguguggagguaaaguugccggauuacggugagcucacccuggacugcgaaccccgguccgggaucgacuucaacgagaugauucugaugaagaugaagaagaagacuuggcucguccacaagcagugguuccuggaccugccccuccccuggaccgcgggcgccgacaccagugaggugcacuggaauuacaaggagcgcaugguuacguucaaagucccgcacgccaagcggcaggacgugacggugcuggggucccaggagggcgcaaugcacuccgcccuugccggagcuaccgagguagacagcggggacggcaaccauauguuugcagggcaccucaaguguaaagugcgcauggagaagcugagaaucaagggcauguccuacaccaugugcucaggcaaauucuccaucgauaaggaaauggccgagacgcagcacgggaccaccguggucaaggugaaguacgagggggccggggcgccgugcaaggugcccaucgagauucgagacguuaacaaggagaaagucgugggccggaucaucucgucaacgccuuucgccgagaacacaaauucuguaaccaacauugagcuggagccaccauucggggauuccuacauagugaucggagugggcgacagcgcccucacccugcacugguuucggaaggggucaagcauuggcaagauguuugaguccacuuaucgcggagccaagcggauggcgauccugggcgagacggcaugggauuucgggagcgucggcggucucuucaccuccuuagggaaggcaguucaccagguguucggcagcgucuacacuaccauguucgguggcguguccuggaugauccgcauccugaucgggcuucuggugcuguggaucggcacgaacagccggaauacauccauggccaugaccugcaucgcagucggcgggauuacccucuuccugggguucacgguacaggcggacauggggugcgucgucagcuggaauggcaaggagcuuaagugcggguccggcaucuucgugguggacaacguucacaccuggacugagcaguacaaguuccagcccgagagccccgcccgccuugccagcgccauucucaacgcccacaaggauggagugugcgguauccgcuccaccacccgccuggagaacgugauguggaagcagauaacuaacgaacugaacuacguucucugggaaggagggcacgaccucacagugguggccggcgacgucaaaggcguccugaccaaggguaagagagugcucaccccgccugucaacgaucugaaguacagcuggaagaccuggggcaaggccaagaucuucacccccgaggcccgcaacuccaccuuccugaucgacggucccgacacgagcgagugcccgaacgagcggagagcuuggaacuucuucgagguggaagacuauggauuugggauguuuuccaccaacaucuggaugaaauuccgggagggcagcuccgaggugugcgaccaccgccucaugucagccgcgaucaaagaccaaaaggccguucacgcugacaugggguacuggaucgaguccagcaaaaaccagaccuggcagaucgagaaggcgucccugauugaagugaagaccugcuuguggcccaagacgcacacccucuggagcaauggugugcuggagucccagaugcucaucccacggucauacgcgggcccguucagucagcacaacuaccgccagggguacgccacccagaucgccggccccuggcaccucgggaaguuggagauagacuucggcgagugcccgggcaccaccgucacgauucaggaggacugcgaccaccggggccccagccuuaggacaaccaccgccuccgguaagcucguaacgcagugguguugccgcagcugcacgaugccacccuuacgguuccugggggaggauggcugcugguacggcauggaaauccgcccccucucggagaaggaggagaacauggucaagucacaggucaccgccggccagggcacgagugagacuuucaguaugggccugcugugccucacacuguucgucgaggagugucugagacggcggguuaccaggaagcacaugauccucgucguggcgauuaccuucugugccaucauacuaggagggcucacguggauggaucuccuucgggcccuaaucaugcucggcgacaccaugagcggccgcaucgggggccagauccaccuggccauuauggccguauucaagaugucccccggauacguccugggaguguuccucaggaaacugacaucccgagagaccgcccugauggucauagggauggccaugacaacuguauucaguaucccgcacgaccucauggagcugauugacggcaucagccugggccucauucugcugaagaucgugacccacuucgacgacacccaagucgggacgcucgcccugucacucacauucauccggagcaccacaccgcuugugauggccuggcgcacgaucauggccguguucuucaugguaacacugaucccccugugccggacuuccugccuccagaagcaaagccacuggguggagaucaccgcgcugauccugggcgcccaggcccuccccguguaccucaugacccuuaugaaaggggccucucgccggagcuggccgcuuaacgagggcaucauggcggucggucuuguuucccuacucggcagcgcccuacugaaaaaugacguuccccucgccggcccgaugguagccggcggccuucugcuugccgcguacgugauguccggaagcuccgccgaucuaucucuggagaaggccgcaaacgugcaaugggaugagauggcggacaucaccggcagcagccccaucaucgaaguaaagcaggacgaagacggaaguuucuccauccgcgacgucgaggagacaaacaugaucacccuucucgugaaguuagcccucaucacggucagcggucucuacccgcuggccauacccgugacuauggccuugugguacauuuggcaggucaagacccaacguuccggcgcccuaugggacguccccagccccgcggcgacccagaaggccacgcuuuccgaggggguguaucguaucaugcaacgaggccuauucgggaagacacaggugggcguuggcauucacauggaaggcguguuccauacgauguggcacguuacccgcggcagcgucaucugccacgaaaccggccgguuggagccguccugggcagaugugagaaacgacaugaucucauacggugggggcuggaggcugggcgacaagugggacaaggaggaagacguucaaguccucgccaucgagcccggcaagaaccccaagcacguucagacgaagccaggccuguucaagacccugaccggggagauuggcgcagugacacucgauuucaagccggguacguccggcagccccauuaucaauaaaaagggcaaagugaucggguuauaugguaacggggugguaaccaaguccggggacuacguuucugcgauuacgcaggcagaacgaauaggagagccagacuacgagguggacgaggacaucuuccggaaaaagcggcugaccaucauggaccugcacccuggcgccggcaagacgaagcgaauccugcccucaaucgugcgggaggcgcuaaagcggagguugcgcacccugauccuggcgcccacccgggucguggccgcugagauggaggaagcacuacgcgggcuuccuauccgguaccagaccccugcagugaaggcggaacacacgggccgcgagauagucgaccucaugugccacgccacguucaccaccagacugcucuccuccacgcgcguuccaaacuacaaccugaucguuauggacgaggcccacuucacugaccccuguagugucgccgcucggggguacaucuccacgcggguggagaugggcgaggcagccgcgaucuucaugaccgcaacgcccccgggguccaccgaccccuuuccgcagagcaacucccccaucgaggacaucgagcgugagaucccggagcgcagcuggaauaccggcuucgauuggaucaccgacuaccagggcaagacggucugguucguaccuuccaucaaggcggggaacgacauagccaacugccugcguaagagcggcaagagagugauucagcugucgcgcaagaccuuugacaccgaguaucccaagacgaaacugacggacugggacuucgucgugaccaccgauaucagcgagaugggcgccaauuuccgggccggcagaguuaucgacccccggcgcugccugaaaccggucauccucaccgacgggcccgagagggugauucuugcaggccccauccccgugacaccggccuccgccgcccagcgccggggccgcaucggacggaacccugcgcaggaggacgaccaauaugucuucucgggcgacccccugaagaacgaugaggaccacgcccacuggaccgaggcgaagauguuacuggauaacaucuacacccccgaggggaucaucccgacucuguucggccccgagcgcgaaaagacgcaggccaucgacggugaguuccggcuccgcggggagcagagaaagaccuucguggagcugaugcgccggggcgaucugccagucuggcucucuuacaaggucgcaucugcggggaucuccuacaaagaccgcgaguggugcuuuaccggcgagcgaaacaaccagauucuggaggagaacauggagguggagaucuggacccgcgagggugagaaaaagaagcugaggcccaaguggcuugacgcacggguguaugcggauccgauggcgcugaaggauuucaaagaguucgccagcggccggaaaucgauaacgcuugacauucucacggaaauugccacccugcccaccuaccuaagcuccaaggccaagcucgcucuggacaacaucgucaugcugcacaccacggagaaaggcgggcgcgccuaccagcacgcucucaacgagcugccggagucucuggagacccucaugcugguggcccugcucggggcaaugaccgccgggaucuucuuauucuuuaugcagggcaaggggaucggcaaguuguccaugggccuuaucgccaucgccguggcaucaggccuucugugggucgcugagauccagccgcaauggaucgccgccucaaucauccucgaguuuuuccugauggugcugcucaucccugaaccggagaagcagaggacgccacaagacaaccagcugaucuacgugauacugaccauucucaccauaaucggccugaucgccgccaacgagaugggguugaucgagaagaccaagaccgauuucggcuuuuaccaagcgaaaacugagaccacuauccucgacgucgaccugcggccggccagcgccuggacauuauacgcuguggccaccacgauccucaccccgaugcuacgccacaccaucgagaacacgagcgcgaaccuuucccucgccgccaucgccaaccaggcggcugugcucaugggguugggcaagggcuggccccuccaccggauggaccugggggucccccuccuggcuaugggcuguuacagccagguaaauccgacaacccugaccgccucccucguuaugcuccugguacacuacgccauuaucgggcccggccugcaggcuaaggccacgcgggaggcccaaaagcggaccgccgccgguaucaugaagaaccccaccguugacgggaucaccgugaucgaccucgagccaauuagcuacgacccgaaguucgagaagcagcuuggccaagucauguuguuagugcuguguguggggcagcugcuccugaugcgcacgaccugggcccuaugugagguucugacacuggccacggggcccauaaugacccugugggaagggaaucccggccgguucuggaacacgacuauugccguguccaccgccaauauuuuccguggaagcuacuuggccggggcgggccuagccuucucgcugaucaagaacgcgcagacgccuaggagggggaccgggacuaccggugagacgcuaggcgaaaaguggaagcggcagcugaacagccuugaccgcaaggaguucgaggaguacaagcguuccgggauccucgagguggaucgcacagaagcaaagucagcccugcgggacgggucaaagaucaaguacgcagucagccgcggcucgagcaagauccgauggaucguagaacgugggauggugaagccuaaggguaaagucguggacuuagguuguggccgaggcggcuggucauacuauauggcgacucuaaagaacgugaccgagguaaagggguacaccaagggcggacccgggcacgaggagcccauacccauggccacguacggcuggaaccuggugaaguuacacagcggcguggacguuuucuacaagccaaccgaacaggucgacacccuccugugcgacaucggggaguccuccuccaaccccacaaucgaggagggccggacgcugcgaguauuaaagauggucgagccguggcugagcaguaaaccugaguucugcaucaaggugcucaacccguacaugcccaccgugaucgaggagcuugagaaacugcagcggcgccacgguggcucgcugguccggugcccgcugucgcggaacuccacccaugagauguacugggugucaggugcuuccggaaacaucgucagcucgguuaacaccauuuccaagaugcuccugaaccgguucacgaccagacaccggaaacccaccuacgaaaaagacgucgaucugggcgcggguacacgcuccgucagcacggaaaccgaaaagccugacaugacgauaaucggccggcgccuucagcggcugcgcgaggagcauaaggagaccuggcacuaugaccaggaaaaccccuaccgaacgugggccuaucacgggucguacgaggcccccuccacuggcuccgccagcuccaugguaaauggggugguaaagcugcucacaaagcccugggacguaauccccauggugacccaguuagccaugacggauacaacccccuuugggcagcagcgugucuucaaggagaagguggacacccgcacgccccaaccgaagcccggaacccgcaugaucaugaccaccacggcgaauuggcugugggccuugcuagggaagaaaaaguccccgcggcuuugcacccgcgaggaguuuaucucuaagguccggagcaacgccgcuaucggcgccgucuuccaggaggagcaaggguggaccuccgcgagcgaggccgugaacgacagccgcuucugggagcuaguugacaaagaacgcgcccugcaucaggagggcaagugcgaguccugcgucuacaauaugauggguaagcgcgagaagaagcugggggaguuuggccgcgccaaggggagccgagcaaucugguacauguggcugggagcgcgcuuccuggaguuugaggcccugggauuuuugaacgaagaccacugguucagucgggaaaauucauggucuggcguugagggcgaggggcugcaucgucugggguacaucuuagaggacaucgacaagaaggacggugaccugaucuacgccgacgacaccgccggcugggacacccgaauuacugaagacgauuuacugaacgaggaguugaucaccgagcaaauggcaccccaucacaagacccuggcuaaagcgauuuuuaagcucaccuaccagaacaaggugguuaagguccugcgcccaacgcccaagggcgccgugauggacaucauaagcaggaaggaccagcgcgguuccggccaggucgggaccuacggccugaacaccuuuacaaacauggagguacagcucauccggcagauggaggccgaaggugugaucacccaggacgacaugcagaacccgaagggccuggaggaacgugucgagaaauggcugaaggagugcgguguugaccggcucaagagaauggcaaucagcggggacgacugcguggucaagccccuggacgagcgguucuccaccagccuccucuuccugaaugacaugggcaaggugcgcaaagacaucccgcagugggagcccuccaaaggguggaagaacuggcaggaaguacccuuuuguucccaccauuuccacaaaaucuuuaugaaggauggccggucccuggucguccccugucgcaaccaggacgagcucaucgggagggcccggauuucucagggcgccggcuggucgcuaagagagaccgccugccuggggaaggccuaugcgcagauguggagccucauguacuuccaucgccgugaucugcgguuggcauccauggcgaucugcagcgccgugccgaccgagugguuccccacaagccgcaccaccugguccauacaugcccaccaccaguggaugaccacggaggacaugcucaaggucuggaacagaguguggaucgaggacaacccgaacaugaccgacaaaacccccauccacagcugggaagacauaccauaccugggcaagcgcgaggaccugugguguggcucccucaucggacugagcucccgggcgaccugggccaagaacauccacacugccaucacccaggugcggaaccugauuggcaaggaggaguacgucgauuacaugcccguaaugaagcgauacagcgcccccuccgagagcgagggcgugcuauaa

SEQ ID NO: 26295 - RNA, 9867 nt, Artificial Sequence
  derived and/or modified CDS sequence (opt11) from DENV-4__KC762698__SS-prME
agcaccaugacccugcucugccugauccccaccgugauggccuuccacuuaagcacccgggauggcgagccguugaugauaguggcgaaacacgagcgggggcggccccuguuauucaaaaccaccgagggcaucaacaaguguacucucaucgccauggaccuaggggagaugugcgaggacaccgugacuuauaagugcccccugcuggucaauaccgagccugaggacauagugugcuggugcaaucugacgagcaccugggucauguacggaaccugcacucaauccggggagcggagacgggagaagcgcagcguugcccucaccccgcacucgggcaugggucucgagacccgggccgaaaccuggauguccuccgagggugccuggaagcaugcccagcgcguggaaagcuggauucugcggaaccccggcuuugcguuguuggcgggcuucauggcguacaugaucggccagacggggauccagcgcaccguguucuuugugcugaugaugcucgucgccccuuccuacggcaugcggugcgugggcguggggaaccgcgacuucguggagggagugagcgggggugcguggguggaccucguacuggagcacggagggugugucaccaccauggcccaggguaagcccacgcucgacuucgagcucaccaagaccacugcgaaggaagucgcacuucugcguacuuacugcaucgaggccucgaucagcaacauuacgacggcgacccgaugcccaacacagggagagccguaccucaaggaggagcaggaccagcaguauaucugccgccgcgacgucguggaucgagggugggggaauggcugcggccuguucgggaagggcggggugguaaccugcgcgaaauuccugugcuccggcaagauuacagggaaccucgugcagauagagaaccuggaguacaccgucgucgucacgguccauaacggcgacacccacgccgugggcaacgauacuagcaaccauggagugacagccaccauaacgccccgcuccccgagcgucgaggugaagcugccggacuacggcgagcugacacuggacugcgagccacgaaguggaauagacuucaaugagaugauccuuaugaagaugaagaagaaaacguggcucgugcacaagcaaugguucuuagaccugccucuuccauggaccgccggcgcggacaccagcgagguccacuggaacuauaaggaaagaauggugacguucaaaguuccucacgccaagcgacaggaugucaccguacuggggucgcaggagggcgcuaugcauagcgcccuggcuggagcgaccgaaguagacaguggggacggaaaccacauguucgccggccaucucaaguguaaggucaggauggagaaacugcgcauaaaagggauguccuacacaaugugcagcggcaaguucaguauagacaaggagauggcugaaacgcagcaugggaccaccgucgugaaagucaaguacgaaggcgccggggcacccuguaagguucccauugagauccgcgacgugaacaaagagaaggucguuggccgcaucauuucuuccacccccuuugcggagaacaccaauuccgugaccaauaucgagcuggagcccccauuuggggacuccuacaucgucaucggcgcuggcgacuccgcccucacacugcacugguuccggaagggguccucgaucgggaagauguucgaauccaccuaccgcggagcaaagcgcauggcgauucugggagagacggccugggacuucgggagcguggguggccucuucaccucccuggggaaggccguucaccaggucuucggaucaguguauaccaccauguuugggggcguuuccuggaugauccgcauccugaucggguucuuaguccucuggaucggcacgaacagccggaacacauccauggccaugaccugcaucgcagugggcgggaucacgcuguucuugggcuucacgguucaagccgacauggggugcgucguaagcuggaacggcaaggaacucaagugcggguccggcaucuucguggucgacaaugugcacacauggaccgaacaguacaaguuccagcccgagagccccgcccgccuggccucagcuauccugaacgcccacaaggacggcgugugugggauccgguccacuacgcgccucgaaaaugucauguggaagcaaauaaccaacgaacuuaacuacgugcuaugggagggcgggcacgacuugaccgucgucgcgggcgacguaaaaggaguguugaccaaagggaagcgggcacugacgccgcccgugaacgaccucaaguacucauggaagacauggggcaaggccaagaucuucacgcccgaggcccgcaacuccacuuucuugaucgacggucccgacacgagcgaaugcccgaacgagcggcgcgccuggaauuucuucgagguggaggacuacggcuucgggauguuuacgaccaacauuuggaugaaguuccgcgagggguccagcgagguaugcgaccacagacugauguccgccgccaucaaagaccagaaggccguccacgccgacaugggcuauuggauugagagcuccaagaaccagaccuggcagaucgagaaggcgagccuaaucgaggugaagacaugccuauggcccaagacccacacgcugugguccaacgggguguuagagagccagauguugaucccgcguuccuacgccggccccuucagccagcacaacuaccgacagggguacgccacccagacggccggacccuggcaccuggggaagcuggagaucgacuucggagagugccccggcaccacaguaaccauccaggaggacugcgaccaccgggggccuuccuugagaaccacgaccgccagcggcaagcuggucacccagugguguugccgcuccugcaccaugccgccucugcgguuccugggggaggaugggugcugguacgggauggagauccgaccacuaagugagaaggaagagaacauggucaagucacaggucacggcgggccagggcacuuccgagaccuucucaaugggccuccugugucuuacauuguucguggaagagugccugagacgcagggucacgcgcaaacauaugauacugguaguggucaucaccuuuugugccauuauccucggcgggcugaccuggauggaccugcuccgggcgcucaucaugcuaggcgauacgauguccggacgcauaggaggacagauccaccucgcgauuauggccguguucaagaugagccccggcuacguguugggcgucuucuuaaggaaacucacuucccgcgaaaccgcgcucauggugaucgggauggccaugaccaccguauucucgaucccgcaugaccugauggagcugaucgacggcaucucccuuggccugauccuccugaagaucgucacacacuucgauaauacccagguugggacccuggcucucagccugacauuuauucgguccacaacuccucuggugauggccuggagaacgaucauggccgucuucuucguggugacccucaucccgcugugccggacaaguugucuacagaagcagagucacugggucgagaucaccgcguuaaucuugggcgcacaagcacuacccgucuaucuaaugacacucaugaaaggggcuagucgcagaucguggccgcucaacgagggcaucauggcgguagggcucgucagcuuguugggcuccgcccuccucaagaacgacgucccgcuggccggccccauggucgcagggggacucuuacuggccgcuuauguaaugucagggaguuccgccgaccucucccuggaaaaagcggcuaacguucagugggacgagauggcugacaucacagggagcagccccaucaucgaggugaaacaggacgaggaugguuccuuuuccauccgcgacgucgaggagacgaauaugaucacccuccucgugaagcucgcgcugaucaccguguccggccuauacccgcuggccauucccgugaccauggccuugugguauguguggcagguuaagacccagcggagcggcgcccucugggacguccccuccccugcggcgacccagaaagccacccugagugaggguguauaccgcaucaugcaaaggggccuguucgggaagacccagguaggcguggguauccacauggagggcguguuccacaccauguggcacgugacgcgcgggucagucaucugccaugagacggggcggcucgagccgagcugggcagaugugcgcaaugacaugauuagcuacggcggaggcuggcgccugggcgacaagugggacaaagaagaagacgugcagguucuggccauugagcccgggaagaaccccaaacacgugcagaccaagcccggccuguucaagacucugacgggagaaaucggagccgugacccucgauuucaaaccugggaccucuggcagccccaucaucaacaagaagggcaaggucaucgggcuuuacggcaacggagucgugaccaagagcggcgauuacguuucggcgauaacgcaggcugaacgaaucggagaaccagacuacgagguagacgaggacauauucaggaaaaagcggcugaccauuauggaccugcacccgggcgcagguaaaacaaagcgcauccuccccagcauuguacgcgaggcccugaagcgcaggcugcgcacacucauccuggcgccuacgcggguuguagccgccgagauggaggaggcccugcgagggcugccgauucgguaccagaccccggccguaaaguccgagcacaccggaagagagauaguggaccucaugugccacgcgacguucacuacccggcugcugagcucuaccagggugccgaauuauaaccucaucgucauggacgaggcacacuucacagaccccugcucaguugccgcccggggguacauaaguacgcgcguggagaugggcgaagcugcggcaauauucaugaccgccacucccccggggagcauugacccguucccccagagcaauagucccaucgaagacauugagcgcgagaucccggagcgcagcuggaacaccggauucgacuggauuacggacuaccagggcaagaccgucugguucgugcccuccaucaaggccgggaacgacaucgccaacugccucaggaagucagggaagaaggugauccagcucucccgcaagacguucgacacagaguaccccaagacaaagcucacggacugggacuucguugucaccaccgauauaucggaaaugggggcgaacuuccgugccggccgggugaucgacccccggcggugccugaagccggucaucuugacggacgggcccgagcgcgugauccucgccggcccuauaccugugacaccggccuccgccgcccaaagacgcggccgaaucgggcgcaacccugcccaggaagacgaccaguacguguucagcggcgacccucugaaaaacgacgaggaccacgcacacuggacugaggcaaagaugcugcuggacaauaucuacaccccugaggggaucauaccgacgcuguuuggcccggagcgagagaaaacccaggcgaucgauggagaguuccguuuaagaggggaacagagaaaaaccuucguggaguuaaugcggcgcggagaccugccggucuggcuuucguacaaggucgccagcgccgggauauccuacaaggaccgagagugguguuucaccggugagagaaacaaccagauccuugaagagaacauggagguggagauauggacccgggagggggaaaagaagaaacugcgcccgaaguggcucgacgcgagaguguacgccgacccuauggcgcuaaaagacuucaaagaguucgcgagcggccgcaaguccaucacccuugacauccugaccgagauagccacccuccccaccuaccugagcuccaaggccaagcuggccuuagacaauaucgucauguuacauacgacagagaaggguggacgggccuaccagcaugcacucaacgaguugcccgagagccucgaaacccugaugcucgucgcacuguugggcgcgaugaccgcggggaucuuccucuucuuuaugcagggcaagggcaucggcaagcuguccaugggccugaucgccauagcuguggccagcggccuccugugggucgccgagauccagccacaauggaucgccgccuccauuauccucgaguucuucuugauggugcuuuugauaccugagcccgaaaaacagcggacgccacaggacaaccagcucaucuacgugauucugaccauacugaccauuaucggccucaucgccgcaaacgagauggggcugaucgagaaaaccaaaacagacuucggcuucuaucagguuaagaccgagaacaccauccuugacguggaccuccggccggccagcgcuuggacucuguacgccgucgcaacgaccauccugacgccuaugcugcggcacaccaucgagaacacgagcgcgaaucugucccuggcagcuauugccaaccaggcagcaguccugauggggcuagggaagggcuggccccuacacaggauggaucugggggucccacugcuugccaugggguguuacagccaagugaacccgaccacacucacagccucauuagucaugcuacucgugcacuaugccauuauagggcccggucugcaagcaaaggccacgagggaagcgcagaagcgcaccgccgccggcaucaugaagaaccccacuguugacgguauaacugucauugaccuggaacccaucucguaugacccgaaguucgaaaagcagcucggacaggugaugcugcugguucucugcgugggacagcugcugcucaugagaaccaccugggcacugugcgagguacugacguuagccaccggacccgugaugacucuaugggaagggaacccuggccgauucuggaacaccaccaucgcgguauccaccgcaaacauauuccggggaagcuaucuggccggggccggccucgcuuucucccugauaaagaaugcacaaacgccaaggcgggggaccggcaccaccggggagacgcugggggaaaaguggaagcgccaguuaaacucacuggaccgaaaggaguucgaggaguacaagagaucuggcauccuggaggucgaccguaccgaagcuaagagcgccuuacgcgauggcuccaagauaaaauaugccgugagcagaggcuccucaaagaucagauggauaguagagcgagggaugaucaagccaaagggcaagguuguggaccugggaugcgguagaggcggguggaguuacuauauggccacgcugaagaacgucaccgaggucaaagguuacacaaaaggcgggcccgggcacgaagaacccauccccauggcgacauauggcuggaaccucgugaagcugcauagcggcguggacguguucuauaagccaaccgagcaggucgauacccugcucugcgacaucggcgagagcucguccaaccccacuaucgaagaaggccgaacacuucgcguccugaagaugguugaacccugguugagcagcaagcccgaguuuugcauaaaagucuuaaaucccuacaugccgaccgugaucgaggagcuggagaagcugcaacgccgccacggugggucccuggugaggugucccuugagccguaauuccacacaugagauguauugggucagcggcgcguccgggaacaucguaucuucagugaacaccauuagcaagaugcugcucaaccgcuuuacgacccggcaccgcaagcccacguaugagaaggacgucgaccugggugcggggacccggucugugagcacggagaucgagaagcccgacaugaccaucaucggccgccggcugcagcgccuacgggaggagcacaaggagacuuggcauuacgaucacgagaaucccuacagaaccugggccuaccacggcucguacgaagcgcccagcacggguucagccucauccauggugaacggcaucgucaagcuguugaccaagccgugggaugugauacccauggugacucagcucgccaugaccgacacgaccccuuuuggucagcagcgggucuucaaagagaagguggauacccgcacaccccagcccaagcccggcacgcggaugaucaugacgaccaccgccaacuggcuaugggcccugcucgggaagaaaaaguccccucgccuauguacgcgggaggaguucaucagcaaggugcgcucuaaugcggcaauaggcgcagucuuucaggaggagcagggguggaccuccgcuucugaagccgucaacgacucaagauucugggagcugguagacaaggagcgagcgcuccaccaggagggcaagugcgaguccugcguguauaacaugaugggaaagcgggagaagaagcugggggaguucggcagagccaaaggcagccgcgccaucugguacauguggcugggugccagguuccuggaguucgaggcccugggcuuccugaacgaggaccauugguucucccgagagaauagcuggaguggcguggagggcgaggggcuccaccggcugggguacauccuggaggacauugacaagaaggauggggaccucaucuacgcugacgauaccgccggcugggacacgcgcaucacggaggacgaccuguugaacgaagaacucaucaccgagcagauggcgccccaucacaagacccuggcgaaggcgaucuucaagcugacguaucagaacaaggucgucaagguguuacgucccacgcccaagggugccgugauggacaucaucucacgcaaagaccagcgcggguccggccaagucgggaccuacggacuuaacaccuuuaccaacauggaggugcaguugauccgccaaauggaggccgagggggugaucacgcaagacgacaugcagaacccaaaaggucucaaggagagagucgagaaguggcugaaggaguguggcguagaccgucuggagcgcauggccaucagcggggacgacugcgucgucaagccccuagacgagcgcuuuucgaccagccugcuguuccuuaacgacaugggaaagguacggaaagacaucccccagugggagccguccaagggguggaagaacuggcaggaagugcccuucuguagccaucauuuccacaagaucuucaugaaagauggcagaucucuugucgugcccugucggaaucaagacgaauuaauaggccgcgcccgaaucagccagggcgcaggcugguccuugagggagacggccugccuagggaaggcauacgcccagauguggcugcuuauguacuuccaccggcgcgaccugcgccuggccucuauggcgauaugcuccgcaguaccgaccgaaugguucccgaccucgcggacgacauggaguauccacgcccaccaccaguggaugaccaccgaggacaugcucaaggucuggaacaggguguggauugaggauaacccgaacaugacggacaagacccccgugcacuccugggaagauaucccuuaccugggcaagcgggaggacuuguggugcggaagccucauaggccucuccagccgcgccaccugggccaagaacauccacacugcgaucacacagguccggaaccuaauuggaaaggaggaguacguggacuauaugccugccaugaagcgcuacuccgcccccuucgagucugaaggcgugcucuag

SEQ ID NO: 26296 - RNA, 9867 nt, Artificial Sequence
  derived and/or modified CDS sequence (opt11) from DENV-4__KC762699__SS-prME
agcacuaugaccuuguuaugcuuaauacccaccgugauggccuuccaccugagcaccagggacggugagccucucaugaucguggcgaagcacgagcgggggcgcccccugcucuucaagaccacggagggcaucaacaagugcacgcucauagcuauggaccugggggagaugugcgaggacaccgugaccuacaagugcccccugcucgugaacaccgagcccgaggauaucgacugcugguguaaccuuaccagcaccugggugauguacgggacuugcacccaguccggugagcggcgccgcgagaagcgcagcgucgcccugaccccgcacucuggcaugggccucgaaacccgggccgagaccuggaugagcuccgagggggccuggaagcacgcccaacgcguggagagcuggaucuuaaggaaucccggcuucgcgcugcucgcuggguucauggccuacaugauuggacaaacagggauccaaaggacgguguucuuugugcugaugauguuaguggcccccuccuacggcaugcggugcgucggcguugggaaucgcgacuucguggagggagucagcgggggcgcguggguggacuuggugcuggagcacggcgggugcgucacgaccauggcccaaggcaaacccacccuggacuucgagcucacgaagaccaccgcaaaagagguggcccugcuacgcaccuacugcaucgaagccaguaucucgaacauuacgaccgcuacgcgcugcccgacccagggggagcccuaccucaaggaggagcaggaccagcaauacaucugccggcgcgacguggucgaccggggcugggggaacggauguggccuguucgggaaggguggggucgugacuugcgcuaaguuccuauguuccggcaagaucaccgggaaucucguccagaucgagaaccuggaguacaccgugguggucaccgugcacaacggcgacacgcacgccgucggcaacgacaccagcaaccacgggguuacagccaccaucacgccccgcucccccagcgucgaggucaagcugccugauuauggcgagcucacccuggacugcgagccacgguccggcaucgacuucaacgagaugauccugaugaagaugaagaagaagaccuggcucgugcacaaacagugguucuuagaccugccccucccuuggaccgccggcgcggacaccagcgaggugcacuggaacuacaaggagcgcaugguuaccuucaaggugccgcaugccaagcggcaggacguuaccguacuugggucccaggaaggcgccaugcacagcgcccuggcuggcgcgaccgagguggacagcggggacgguaaccacauguucgccgggcaccucaagugcaaggugaggauggaaaagcugagaaucaagggcaugucguacacaaugugcagcggcaaguucuccaucgacaaggagauggcggagacgcagcacggcaccaccgucgugaaggugaaguacgagggcgccggggcccccugcaagguccccaucgagauccgggacguaaauaaggagaagguggucggccgcauuaucucguccacccccuucgcggagaacacgaacagcguuaccaacaucgagcucgagccgccguucggagauaguuacaucguaaucggcgucggcgacagcgcccuuacccuccacugguuccggaaggguuccagcauaggcaagauguucgaguccacuuaccgcggggccaagagaauggcuauccugggcgagacggcgugggacuucgggagcguggguggccucuucaccucucuggggaaggccgugcaccaggucuucggcagcguguacaccacgauguucggggguguguccuggaugauccgcauccugaucggguuccucguccuuuggauuggaacgaauagccggaacaccuccauggccaugaccugcaucgccgugggggggauuacgcuuuuccugggcuucacggugcaggccgacauggggugcgucgugagcuggaacggcaaggagcucaaguguggguccggcaucuucgugguggacaacguacacaccuggacugagcaguacaaguuucagcccgagucgcccgcacgccuggcaagcgccauccugaaugcccacaaggacggcgugugcgggauccggucaaccacgcgacuagagaacgucauguggaaacagaucaccaacgagcugaacuacgugcugugggagggcggccacgaccucaccgucguugccggcgacguaaagggcgugcuaaccaaggggaaacgggcgcugacgccgcccgucaacgaccucaaguacagcuggaagaccuggggcaaggccaaaaucuucacgcccgaggcccgcaacuccaccuuucuuaucgacgggcccgacaccagcgagugcccgaacgagcggcgcgcguggaacuuuuucgagguggaggacuacggcuucgggauguucaccaccaacauauggaugaaguuccgggagggcuccagcgaggucugcgaccaccgccugauguccgccgcgaucaaggaccaaaaggcugugcaugccgacaugggguacuggaucgaaaguuccaagaaccagacauggcaaauagagaaggcgagccucaucgaggugaagacgugucuguggcccaaaacccacacuuuaugguccaaugggguacucgagagccagaugcuuaucccccgguccuacgcgggcccguuuagccagcacaacuaccgccagggguacgccacccagaccgccggccccuggcaccuggggaaguuagagauagacuucggagagugucccggcacaaccguaaccauccaggaggacugcgaccaccggggucccagccugcgcaccacgaccgcaagcggcaaacucgugacccaguggugcugcagguccuguaccaugccgccccuccgguuccugggggaggacggcugcugguacgggauggagauccgcccacugagcgagaaagaggagaacauggucaagagccaggucacggcuggccaggguaccuccgagaccuucaguaugggacuccugugccugacccucuucguggaggagugccugcggaggcgggucacgcgcaagcacaugauccuggugguggucaucaccuuuugcgcaaucauccucggcggguugacauggauggaccugcuccgggcccugaucaugcugggagacaccauguccggucguaucgguggccagauccaccucgcgaucauggcgguguucaagaugagccccggauacgugcugggcgucuuccugcggaagcucacgucgcgcgaaacagcccuaauggucaucgggauggccaugacuaccguguucagcaucccgcacgagcugauggaacucauagacgguaucucccugggccugauccuacugaagaucgucacgcacuucgacaacacccagguggggacccuggcccucagccugaccuucauccggucaacgacgccccuggugauggccuggcgcaccaucauggccgucuucuuuguggugacccucauuccccuuugccggacgagcugucugcagaagcagucccacugggucgagaucaccgccuugauccugggcgcucaggcccugcccguguacuuaaugacccuuaugaagggggccagccgucgguccuggccgcugaacgagggcaucauggccguggggcucgugagccuucugggcuccgcacuccugaagaacgacgucccgcuggccggccccaugguagccggcggacuacugcuggccgccuacgucaugagcggauccagcgcggaucucucccuggagaaggccgccaacgugcagugggacgagauggccgacaucaccggcagcagccccauuauagaggugaagcaggacgaggacggguccuucagcauaagagaugucgaggagacgaacaugaucacccuucuagugaagcuggcccugaucaccguguccggccucuacccgcuggcgauccccgucaccauggcccuuugguacguauggcaggucaaaacgcagcgguccggcgcccucugggacguacccucccccgccgccacucagaaggcgacccugagcgaggggguguaccgcaucaugcagagaggccuguuugguaagacccaggugggggucgguauccauauggagggcguguuccacacgauguggcacgugacgcgcggcuccgucauuugccacgaaaccggacgacucgagccgaguugggcggacgugcgcaacgauaugaucuccuacggcgggggcuggcgccugggcgacaaaugggacaaggaggaggacgugcagguccuggccaucgaacccgggaagaaccccaagcaugugcagaccaagcccggucucuucaagacacugacgggggagauaggcgcagugacccuggacuucaagccggggacuagcggcucgcccaucaucaacaagaagggcaaggucaucgggcucuacggcaacggcgugguaaccaagagcggcgauuacgucuccgccaucacgcaggcggagcggaucggugaaccugauuacgaggucgacgaggacaucuuccgcaagaagcgacugaccauaauggaccugcacccgggcgccggcaagaccaagcgcauacucccuagcaucgugcgggaagcccugaagcgccggcugcgcacccucauccuggcccccacacgggucguggccgccgagauggaggaagcccugcgcgggcugccgauccgguaccagacaccggccgugaaguccgagcacaccggucgagagaucguggaccugaugugccacgccaccuuuacgaccaggcuguugucguccacgcgaguacccaauuacaaccucaucgucauggacgaggcucauuucaccgacccaugcucuguggcugccaggggguauaucuccacgcgcguggagaugggcgaggccgcggcgaucuucaugaccgccacacccccggggucaaucgauccuuucccccagagcaacuccccaaucgaggacaucgagcgggagaucccggagcgcucguggaauaccggcuucgacuggaucacggacuaucagggcaagaccgucugguucgugcccuccaucaaagcugggaacgauauugccaacugccugcgcaagagcggcaagcgcgugauccagcugucccgcaagacguucgacacggaguaccccaagacgaagcucaccgacugggacuuugucgugaccacugauaucagcgagaugggggccaacuuccgggcgggccgcgugaucgacccccggcgcugucugaagccggucauccugacggacgggcccgagcgggugauccuagccgggccuauccccguaaccccggcguccgccgcgcaacgccguggccgcaucgggcggaacccagcgcaggaggacgaucaauacgucuucagcggcgacccgcugaagaacgacgaggaccacgcccacuggaccgaggccaagaugcuucucgacaacaucuacacccccgaggguaucaucccgacgcuguucggacccgagcgcgagaagacccaagccaucgacggcgaguuccggcuucgcggggagcagcggaagaccuucguagagcucaugagacggggcgaccugcccguguggcuguccuacaagguugcgucugccgggaucaguuacaaagaccgcgaauggugcuucaccggugagagaaacaaccagauccuggaggagaacauggaaguggagaucuggacgcgcgagggggagaagaaaaagcugcggccuaaguggcuggacgcccgcguguacgccgacccgauggcccucaaggacuucaaggaguucgcuagcggccggaaguccaucacccuggacauccugaccgaaaucgccacccuccccaccuaccugagcuccaaagccaagcuggcccucgacaacaucgucauguuacacacgaccgagaagggcggacgagccuaccagcacgcgcugaacgagcuccccgagagccuggaaacccugaugcuaguggcccuacuaggcgccaugaccgccgggaucuuccucuucuucaugcagggcaaggggauuggcaaguuguccaugggccugaucgcgaucgccguggccuccggauugcuguggguggccgagauccaaccucaguggaucgcugcgucgauuauacuugaauucuuccucauggugcuguuaauccccgagcccgagaagcagaggacgccccaggacaaccagcucaucuacgugauauugaccauccugaccaucaucggccucaucgccgccaacgagauggggcugaucgagaagacuaagacggacuuuggcuucuaccaggucaagaccgagaccacuauccuggacguggauuuacggccggcuagcgccuggacucuguacgcgguggccacgaccauacucacccccaugcuccgccacacaaucgagaauaccuccgccaaccugagucuagcggccaucgcgaaccaggccgccguccucauggggcugggcaagggcuggccccugcaccguauggaccucggggugccccugcuggccaugggcuguuacagccaaguuaacccgaccacccucacagccagucuggucaugcugcucgugcacuacgcgauaaucgggccaggccugcaagcuaaggccacccgcgaggcccagaagcggaccgcggccggcaucaugaagaaccccaccguugacgggaucacagucaucgaccuggagcccaucagcuacgacccgaaauucgagaaacagcucggccaggugaugcugcuggugcucugugucgggcagcugcugcucaugagaaccaccugggcccugugcgaggugcuaacccucgccaccggccccgucaugacccucugggaggggaaccccggcagguucuggaauaccaccaucgccgucaguacggcgaacaucuuccgcggaucguaccuggcuggggccggccucgccuucucccucaucaagaacgcgcagacgccccggcgcgggaccggcaccacgggggagacccugggcgagaaguggaagcggcaacugaauagccuggaccgcaaggaguucgaagaauacaagcgguccggcauucucgagguggaccgcaccgaggcaaagagcgcccuccgggacggguccaagauaaaguacgccgugagccgcggcucuagcaagauccgguggaucgucgagagaggcaugaucaagccgaagggcaaaguaguggaccuuggguguggccgcggggggugguccuacuauauggcgacccugaagaacguaaccgaaguuaagggcuauaccaaggggggccccgggcacgaggaaccuauccccauggccaccuacggcuggaaccucgugaagcuacacagcggcguggauguguucuacaagccgaccgagcaggucgacacccugcucugcgacaucggggaguccagcucaaaccccacgaucgaggagggccgcacccugcgcguacugaagaugguggaacccuggcucucaagcaagcccgaguucugcaucaagguccugaacccguacaugcccaccgugauagaggagcuggagaagcuccagcggcgccaugggggcuccuuggugcggugcccucugagccgcaacuccacccacgagauguacugggucucgggcgcguccgggaacaucgugagcuccgugaacacgauauccaagaugcugcucaaucgguucaccacccgccaccgcaagcccaccuaugaaaaggacgucgaccugggcgcugggacacgcuccgugagcacggagaccgagaagccugacaugaccaucaucggccggagacugcagcggcuacgcgaggagcacaaggagacguggcacuacgaccaggagaaucccuaccggaccugggccuaucacggguccuacgaggcccccagcacuggcuccgcgagcaguauggugaacggcgucgugaaguugcugaccaaaccgugggacguuauccccauggucacacaacucgccaugaccgacaccacccccuucgggcagcagcgcguguucaaagagaagguggacacgcggacgccccagccgaagccgggcacccgcaugaucaugaccaccaccgccaacuggcugugggcccugcucgggaagaagaaguccccgcggcugugcacccgcgaggaauucauuuccaaggucagaagcaacgccgcgaucggcgccguguuccaggaggagcagggguggaccuccgccagcgaggccgugaaugacagcagauucugggagcuggucgacaaggagcgggcccuccaccaggagggcaagugugaguccuguguguacaacaugaugggcaagcgcgagaagaagcuuggggaguucggccgcgccaaggggucgcgggccaucugguauauguggcugggcgcccgcuuccucgaauucgaggcccugggguucuugaacgaggaccacugguucagccgggagaacagcugguccggaguggaaggcgaggggcuccaccgucugggcuauauccuggaggacaucgacaagaaggacggggaccucaucuacgccgacgacacggcgggcugggauacccggaucacagaggacgaccugcugaacgaggagcucaucaccgagcagauggcgccccaccacaagacacuggcgaaggccaucuucaagcugaccuaccaaaacaaggucguaaaggugcuccgccccaccccuaagggcgcggucauggacaucaucagccggaaggaccagcgcgguuccggccaaguggggaccuacggccugaacaccuuuacgaauauggaggugcagcugauucggcagauggaggccgaggggguaaucacgcaggacgacaugcagaaccccaagggccucaaggagcgcguggagaaguggcugaaggagugcggcguggaucggcugaagcgcauggccaucagcggggacgacugcgucguaaagccccuagacgaacgguucuccaccagccugcuguuucucaaugacaugggcaaggugcgcaaggacaucccacagugggagcccuccaagggguggaagaauuggcaggagguucccuucugcagccaccacuuccacaagauuuucaugaaggacggucgauccuuaguggugcccugccgcaaccaggacgagcugauuggccgggcgagaaucagucagggggccggcuggucccuacgggagaccgcgugccugggcaaggccuacgcccagauguggagccugauguacuuccaccgccgcgaccuccggcuggccuccauggcuaucugcagcgcggucccgacggagugguucccgaccagccggaccaccugguccauccacgcacaucaccaguggaugacgaccgaggauaugcugaagguuuggaaccggguauggaucgaggacaaccccaacaugaccgacaagaccccuguccacagcugggaggacauuccguaccucggcaaacgcgaggaucuguggugcggaucucugauuggucucagcagucgggccacuugggcaaagaacauccauaccgccaucacccaaguucgcaaccugaucgggaaggaggaauacguggacuacaugcccgcaaugaagcgguacagcgcccccuucgagucggagggaguucuguaa

SEQ ID NO: 26297 - RNA, 9867 nt, Artificial Sequence
  derived and/or modified CDS sequence (opt11) from DENV-4__JQ915085__SS-prME
ucgaccaugacucugcucugcuuaauccccaccgugauggccuuccaccugagcacgcgcgacggagaaccgcugaugauaguggccaagcaugaacgggggcgaccuuuauuauucaagaccaccgaagggaucaauaagugcaccuugauugcuauggacuugggugagaugugugaggacaccgugacguauaagugcccccuccucgucaauacggagcccgaagauaucgauugcugguguaaccucaccagcacuuggguuauguacgggacgugcacccaguccggggaacggcgccgggagaagcgcucagucgcccugaccccgcauuccggcauggggcucgagacccgggccgaaacuuggaugaguucggagggggccuggaagcacgcccagcgcguggaaagcuggauccuccggaaccccggcuucgcguuacuugccggguucauggcguacaugauuggccagaccgguauacagaggacugucuucuucgugcugaugauguugguggcccccucguauggcaugcggugcguaggcguagggaacagagacuucguagagggcgucagcggaggcgcguggguggaccucguguuagagcauggcgggugcgucaccacaauggcccagggcaaaccaacccuggacuucgagcucacgaaaaccaccgcuaaggagguggcccugcugcggacauacugcaucgaggccucuaucucaaacaucacgacagcgacccgcuguccgacccagggggagccauaccucaaggaggagcaggaccagcaguacaucugccggcgcgacguggucgaccggggcugggggaacggcugcggacuguucgggaaaggcggcguaguaaccugcgccaaguucuuaugcuccggcaagaucaccgggaaccucguccagaucgagaaccuagaguacaccgugguggucaccgugcacaacggggacacgcacgccgucggcaacgacaccagcaaccacggggucaccgccaccaucacgccccgaucccccagcguggaggucaagcucccugacuacggcgagcucaccuuggacugugagccccggucggggaucgacuucaacgagaugauacugaugaaaaugaaaaagaagacauggcucgugcacaagcagugguuccuggaccugccccuucccuggaccgccggcgccgacaccagcgaagugcacuggaacuacaaggagcgcaugguaacguucaaggugccgcaugccaagcgucaggauguaaccguccugggcucgcaggagggagccaugcacagcgcccuggccggagcgaccgaaguggauagcggggacggcaaccacauguucgccgggcaccugaaauguaagguccgcauggagaaguuaagaaucaagggcauguccuacaccauguguagcgguaaguucagcauugacaaggagauggccgagacgcagcacgggacuacgguugugaaggugaaguacgagggcgccggggccccaugcaaagucccgauugagauccgggacgugaacaaggagaaggucguaggccgcaucaucagcuccacgcccuuugcggagaacacgaauagcgugaccaacaucgaguuagaaccgccguucggagacuccuacaucgugaucggagucggcgacucggcccucacacugcauugguuccggaaggguuccagcaucggcaagauguuugaguccacuuaccgcggagccaagcguauggccauccugggcgaaacugcgugggacuucggaagcgugggaggccucuucacaucccuggggaaagccgugcaucaggucuucggcucgguguacacgaccauguuugggggagugagcuggaucauccgcauacugaucggguuuuugguccuguggaucggaacgaacagccggaacacuuccauggccaugaccuguauagccguaggcgggaucacccuguuccugggguuuacgguccaggccgacaugggaugcgucgugaguuggaacgggaaggagcucaagugcggcucuggaaucuucgugguggacaacgugcauaccuggaccgagcaguacaaauuccagccggaaagccccgcgcgccuggcgucggcuauccugaacgcccacaaagacgguguuugcgggauacggaguaccacgaggcucgagaacguuauguggaagcagaucacuaacgagcugaacuacgugcugugggagggugggcacgaccugaccguggucgccggugacgucaaggguguguugaccaaggggaaaagagcguuaacgccgcccgucaaugaucucaaguacagcuggaaaaccugggggaaggccaagaucuucacccccgaagcccgcaauucuacauuuuugaucgacgggccggacacgucggagugcccgaaugagcggcgcgccuggaacuuuuucgagguggaggauuacggcuucgggauguucaccacaaauauauggaugaaguuccgggagggcuccucagaggugugcgaccaccgcuugauguccgccgcgaucaaggaccagaaagcaguucacgcugacaugggcuacuggauagagagcucuaagaaccagacguggcagauagagaaggccucauuaaucgaggucaagacgugccucuggccuaagacccacacccuguggucuaacggugucuuagagagccaaaugcugaucccuagguccuacgcgggcccguucagccagcacaacuauaggcagggguacgcgacccagacggcggguccguggcaucucgggaaguuggagaucgacuucggcgagugcccaggcaccacagucacuauacaggaggacugcgaccaccgggggcccucacugcgaacaacgaccgccagcggcaaacuggucacccaguggugcugccgcuccugcaccaugccgccguugagguucuugggggaggacggcuguugguacgggauggagaucaggccgcuaagcgagaaggaggagaacauggucaagagccaaguuacggccggccaaggcaccuccgaaaccuuuagcaugggguuacugugccugacccucuuuguugaggaaugccugcggcgacgggucacgcgcaagcacaugauccuggucguggucauaaccuuuugcgcgauaauccucggcggccugacguggguggaccuacuccgagcccugaucauguugggcgacaccauguccgggagaaucgggggccagauccaucucgccauuauggccguuuucaagaugucacccggauacguccuggggguguuccugcggaagcucacgagccgggagaccgcccucauggugauagggauggccaugacuaccguuuuuagcauaccacgggaucugauggagcucaucgacggaaucucgcugggacugauccuccugaagauagugacgcacuucgauaacacucaggugggcacacuggcucucagccugaccuucauacgguccacgacgccacugguuauggccuggcggaccaucaugguggucuucuucgucguaaccuugauuccccugugcagaacgagcugccugcagaagcagucccacuggguagaaauuaccgcccucauacugggcgcccaagcucuacccgucuaccucaugacccugaugaaaggggccucaagacgcagcuggccgcugaacgagggcaucauggccgugggacucgugagcuuacuuggauccgcacuccugaagaacgacguucccuuagcgggccccauggucgccggagggcuccugcuagccgccuacguuaugucagggucgagcgccgaccucagucuggagaaggcggccaacguucaaugggacgagauggcugacauuaccggcagcagccccaucaucgaggucaagcaagacgaggacggguccuuuagcauacgggacguugaggaaacgaacaugaucacacugcucgucaaauuggcccuaauuacuguguccggucucuacccgcuggcuaucccagugaccauggcucuuugguacaucuggcaggucaagacacagcguagcggcgcucuuugggacgugcccucccccgccgcaauucaaaaggcuacccuguccgaggggguguaccggaucaugcagcgugguuuguucggcaaaacccaaguagggguggguauccacauggaaggcguguuccauaccauguggcacgucacccggggcuccguaaucugccaugagacggggcgcuuagagcccucgugggcggaugugcgcaacgacaugauuuccuauggcggcggcuggcggcugggcgacaagugggacaaggaagaggacguucagguguuggccaucgaacccggaaagaacccuaagcacgugcagacuaagcccggccuguuuaagacccugaccggcgagaucggcgccgucacgcuggacuucaagccugggaccucaggcucacccauaauuaauaaaaagggcaaggugaucgggcuauacgggaacggcgucguaacuaaguccggcgacuacguguccgcaaucacacaggccgagcgcauuggcgaacccgacuacgagguggacgaggacaucuuucggaagaagcgcuugacgaucauggaccugcaccccggcgcuggcaagaccaagaggauccuccccagcaucguucgagaggccuugaagcgacgcuuacgcacacucauccuggccccuacccgcgugguugccgcggagauggaggaggcccugcgcgggcuacccaucagguaucagacgccggcugucaaauccgagcacaccggccgggagaucguggaccucaugugccacgcaacguucacgacgcgccugcugagcuccaccaggguuccgaacuacaaccucaucguuauggacgaggcccauuucacagaucccugcuccguggcggcgcguggguacauuuccacccgggucgagaugggggaggccgccgccauauucaugacggcgacgcccccgggcagcauugaccccuucccgcagagcaacucccccaucgaggacaucgagcgcgagauuccggagcggucauggaacacgggcuuugauuggaucacggacuaccagggcaaaacggugugguucgugcccucgaucaaggccgguaaugacauagccaacugccuacgcaagagcggcaagaaggucauucaacuuucccgcaagaccuucgacaccgaauacccuaagaccaagcucacggacugggacuucguggugaccacggacaucucggaaaugggagccaacuuccgggccggucgagucaucgauccccggcgcugucugaaaccgguuauacuuacagacggccccgagagggugauacucgcgggcccgauccccgucaccccggccucugccgcccagcgccggggccggaucgguaggaaucccgcccaggaggacgaucaguacguguucagcggcgauccgcucaagaacgacgaagaccacgcucacuggaccgaggccaagaugcugcucgacaauauauauacccccgagggcaucaucccgacauuauucggcccagagcgcgagaaaacgcaagccaucgacggcgaguuucgccugagaggggaacagcggaagaccuucguggaguugaugaggcggggugaccugccugucuggcucagcuacaaaguggccagcgcgggaaucaguuacaaggaccgcgagugguguuucaccggagaacguaauaaucagauccucgaggagaacauggagguggagauauggacccgcgagggagaaaagaagaaacuucggccgaaauggcucgacgcccggguguacgccgacccgauggccuuaaaagauuucaaagaguucgcaagcggccggaaguccaucacacuggacauccugacugagaucgcgaccuugccaaccuaccucagcuccaaggcaaagcuggcccuugacaacaucgugauguugcacacugccgaaaagggcgggcgcgcuuaccagcaugcgcugaacgaguugccggagagucuggagacgcugaugcugguugcccugcuuggugccaugaccgccgguaucuuccucuucuucaugcagggcaagggaauugggaaacugagcaugggacugaucgcgauagccgucgccagcgggcuucuauggguggccgagauccagccgcaauggaucgccgcguccauuauccuggaguucuuccucaugguccuacugaucccagagccggagaagcagcgcacgccccaggacaaccagcucaucuacgugauacucacgauacuaacgaucaucgguuugaucgccgccaacgagaugggccuuauugagaagaccaagaccgauuucggcuucuaucagguaaagaccgagacgaccauccuggacguggacuugcggccggccuccgccuggacucuguacgcggucgcaaccacgauccugacucccaugcuacgacauacaauugaaaauaccagcgccaaccugucguuagcugccaucgcgaaccaagccgcagugcucauggggcugggcaagggcuggccgcuccacagaauggacuuaggagugccgcugcucgccaugggcugcuacagccaggucaauccgaccacacucacugccucccuggugauguugcucgugcacuacgcgaucaucgguccaggucugcaagccaaagcuacgcgcgaagcccagaaacggacggcagccggcaucaugaagaacccgacugucgacggaaucacagugaucgaccucgagcccauaagcuacgacccgaaguucgagaaacaguuaggacaggucaugcuuuugguucucuguguggggcagcugcugcucaugcgcaccacgugggcacugugugaggugcugacgcuggccacaggccccaucaugacccugugggaggggaaccccggacgguucuggaauacgaccauagccgucaguaccgcgaacaucuuccgcggcagcuaucucgcgggggccggacucgccuucucccugaucaagaacgcccagaccccucgucgcgguacuggcaccacgggggagacccugggcgagaaguggaagcgacagcugaacucucuggaccgaaaggaguuugaggaguacaagcgauccgggauccuggagguagaccgcacggaagccaagagcgcccuccgggacgggaguaagaucaaacacgccgugucucgcggaagcucuaagauucgcuggauagucgaacgcgggaugaucaaaccgaaggggaaagugguagaccugggcugcggacggggcgggugguccuacuacauggccacucugaagaacgucacggaggugaagggcuauacaaaagguggucccggccacgaggagccgauccccauggccaccuacggcuggaaccucgugaagcugcacucaggcgucgacguguucuacaagccgacggaacaggucgacacucugcucugugacauuggcgaguccagcuccaaccccaccauugaggagggccgcacccuccgcguucugaagaugguggagcccuggcuaucgagcaagcccgaguucugcauuaaggugcucaacccauacaugccaacggugaucgaggagcuggagaaauugcagcggcgccacgguggaucccucgugcggugcccucugagccggaacuccacccacgagauguacugggucagcggggcguccgggaacauagugagcucugugaacacgauuagcaaaaugcugcucaaucgguucaccacgcgccaccggaaaccgaccuacgagaaggacguugaucugggcgcggguaccagauccgugagcacagagacggaaaagccggacaugaccaucauaggccggcggcugcaaagacuccgcgaggagcacaaagagacguggcacuacgaccaggagaaucccuaccguacgugggcguaccacgggucuuacgaggcccccagcacgggcuccgccagcuccaugguaaacggcgucgugaagcuguuaacgaagccgugggacgugauuccaauggucacccagcucgccaugacagacacgaccccguuugggcaacagcgcgucuucaaagagaagguggacacgcggacgccucagcccaagcccggcacgcgcaugauuaugaccaccaccgcgaacuggcugugggcgcugcucgguaagaagaaguccccgcgguugugcacgagagaggaguucaucucaaaggugaggucuaacgccgcuaucggcgcaguuuuccaggaagaacaggguuggacguccgccagcgaggccgugaacgacagccgcuucugggaguuagucgacaaggagagagcgcugcaucaggaaggaaagugcgaguccugcguguacaacaugaugggcaagcgcgagaagaagcugggggaguucggccgcgcgaagggcagccgggcgaucugguacauguggcucggcgccagauuccucgaguuugaggcacuaggcuucuuaaacgaagaccacugguucuccagggagaauagcuggagcggcguggagggagaggggcuccaccggcugggcuauauccuugaggacaucgacaagaaggacggggaucuaaucuacgccgacgauaccgcggggugggacacgcgaauaacggaggacgaccuucugaaugaggagcuuaucacugagcagauggcaccccaccauaaaacccuggcaaaggcaaucuucaaguuaaccuaccagaauaagguggugaaggugcuccgcccuacgcccaagggggcuguuauggacaucauuucgcggaaggaucaacgcggguccggccaggugggcaccuacggccugaacacguucaccaacauggagguccaauuaauccgacagauggaggccgagggggucaucacccaagacgauaugcagaaccccaaggggcucaaagagcguguggaaaaguggcugaaagagugcggcguggaccgacugaagagaauggccauaucaggggacgacugcgucgugaagccccucgaugaacgguucuccacgagccugcuguuccucaaugauaugggcaaggugcgcaaggacaucccgcagugggaacccuccaagggguggaagaacuggcaggagguccccuuuuguucccaccacuuccacaagaucuucaugaaggacggccggucucugguggugcccugccgcaaccaggacgagcugaucgggcgagcccgcaucucucagggcgcuggguggucccuccgcgagaccgcgugccuagggaaagccuaugcacaaauguggucgcugauguacuuccaccgccgcgaucugagauuagccuccauggccaucugcucggcgguaccgacugagugguucccuacaagucgcaccaccuggaguauacacgcccaccaucaauggaugacuaccgaggauaugcugaagguguggaaccggguguggauagaagacaacccuaacaugacggauaagacccccguccauucgugggaggacauaccguauuuaggcaagcgcgaggaccuguggugcgggucccugauaggacucagcucgcgggccaccugggccaaaaauauccacaccgccaucacccagguucggaaucugaucggaaaggaggaauacguugacuacaugccagcaaugaagcguuauucggcccccuucgaguccgagggcgugcuguga

SEQ ID NO: 26298 - RNA, 9867 nt, Artificial Sequence
  derived and/or modified CDS sequence (opt11) from DENV-4__JQ915088__SS-prME
ucgaccaugacccugcucugccugauucccacugugauggccuuccacuuaucuacccgggacggcgagccgcuuaugaucguggccaaacaugaacgagggaggccccugcuuuucaagaccaccgaaggcauaaauaagugcacccucauagcuauggaccugggggagaugugcgaggacaccgugacauauaagugcccacuacucguaaacaccgagccggaggacauagacugcuggugcaaccugacgagcaccugggucauguaugggaccugcacgcaguccggggagcgccgucgagagaagcgcagcguggcccugacuccccauucaggcauggggcucgagacacgggccgaaaccuggaugagcuccgagggggcuuggaagcacgcccagaggguggagucuuggauccugcggaaccccggcuucgcgcugcucgcgggguucauggcauauaugaucggccagaccgggauccagcgcaucguguucuucgugcugaugaugcugguggcccccuccuacggcaugcggugcgugggugugggcaaccgcgacuucguggagggcgucagcggaggcgcguggguggaccucgugcuggagcacggcgggugcguuacgaccauggcacaggggaagcccacccuggacuucgagcucaccaagacgacugccaaggaaguggcacugcugcggacuuacuguaucgaggcguccauuucgaacaucaccacggcuacccgcuguccgacccaaggggagcccuaccucaaggaggagcaggaccaacaguacaucugccggcgcgacgugguagacaggggcuggggaaauggcuguggccuguucgggaaggggggggugguaaccugugcaaaguuccugugcucuggcaagaucacggggaacuuagugcagaucgagaaccuggaguacacggugguggucacggugcacaacggcgacacgcacgccgucggcaacgacacgagcaaccacggggugaccgcuaccaucacgccgcgguccccuagcguggaggucaagcugccggacuauggcgagcugacgcuggauugcgagccccggucagggaucgacuuuaaugaaaugauccucaugaaaaugaagaagaaaaccuggcucgugcacaagcagugguuccuggaccuaccccuccccuggaccgccggcgcggacacuucugaggugcacuggaacuacaaggagcgcaugguaaccuucaaggugccgcacgccaagcggcaggacgugacgguccuggggucccaggagggcgccaugcauucugcccuggccggcgcgaccgagguggauucuggggauggcaaccacauguucgcggggcaccucaaguguaaggugcgcauggagaaguugcggaucaagggcauguccuacaccaugugcagcggcaaauucuccaucgauaaggagauggccgaaacccagcacgggacuaccgucgugaaggugaaguacgagggcgccggggcccccugcaagauccccauagagauccgggacgucaacaaggagaagguggugggccgcaucaucagcucgacuccauucgcggagaacaccaacuccgucaucaacauagagcuggagccgccuuucggagacuccuacaucgugaucggcgugggcgacagcgcccuaacgcugcauugguuucggaagggcaguuccauaggcaagauguucgaguccaccuaccgcggggcaaagcggauggccauccugggcgagaccgcgugggacuucgggagcgucggcggccucuucaccucccuggggaaggccguacaccagguguucggcagcgucuauacuaccauguucgggggcguguccuggaugauccguauucugaucgguuuccucgugcuguggauuggcaccaacagccguaacacuuccauggccaugacgugcaucgccgucggcgggaucacccuguuccugggcuuuacgguccaggcggacauggggugcguggucagcuggaacggcaaagagcucaagugcggguccgggaucuucgugguugauaacguccacacuuggacggagcaauacaaguuccagcccgaaagccccgcgcgccuggccagcgccauacugaacgcccacaaggacggcguaugugggauucgguccacuaccagacucgaaaacgugauguggaagcagaucaccaacgagcugaacuacguccucugggagggagggcacgaccucacggugguggccggggacgugaagggcguacugacuaaagggaagcgggcccugaccccacccgugaacgaccucaaguacagcuggaagacauggggcaaggccaagaucuccacgcccgaggcucgcaacagcacuuuccuaaucgacgggccagacacuuccgagugcccgaacgagcgucgcgccuggaacuucuucgaagucgaggacuacggguucgggauguucaccacaaacaucuggaugaaguuccgggaggggagcucagaggugugcgaccaccgccugaugagugcugccaucaaggaucagaaggccgugcacgcugacaugggcuacuggaucgaguccagcaagaaccagacguggcagaucgaaaaggccuccuugauagaggucaagaccugccuguggccuaagacgcacacgcucuggagcaacggggugcucgagucucagaugcugauaccacggagcuacgcaggcccguucucccagcacaauuaccgccagggguacgccacgcagaccgccggcccuuggcaucuuggaaaacucgagaucgacuucggcgagugucccggcaccaccgugaagauccaagaggauugcgaccaccgggggccgagucugcguacgaccacugcauccggcaagcuggucacccaguggugcugucgcagcugcacgaugccgccccuccgguuccugggggaggacgguugcugguacggcauggagauccguccccuaagcgagaaagaggagaacaugguaaagucccaggugaccgcaggacagggcaccagcgagaccuucuccauggggcuccugugccugacccuguuuguggaggaaugccuccggcggcgagugacacgaaagcacaugauccuggucguggugaucacauucugcgcgaucauccugggcgggcuaacauggauggaccugcucagagcccugaucaugcugggcgacacgauguccggccgcauugggggucagauccaccucgccaucaugaccguuuucaaaaugucccccggguacgugcuaggcguuuuccuucggaagcucacuagccgcgagacggcccugauggugauaggaauggccaugacgaccguguucuccaucccacacgaccugauggagcucaucgauggaaucagccugggccugaucuugcugaagauagugacccacuucgacaacacccagguggggacgcuggcgcucagccuuaccuucaugcggagcacaacgccccuggugauggccuggcggacgaucauggccguguucuucgucaucacccugauuccccugugucggaccuccugccugcaaaagcagagccacuggguggaaaucaccgcguugauccucggcgcgcaggcguugcccguauaccugaugacgcugaugaagggggccucccgccggagcuggccucugaacgagggcaucauggccgucgggcucgugucacugcucggcagcgcccugcugaagaacgacgugccccuggcgggccccaugguugccggggggcucuugcucgccgcuuacgugauguccgggagcagugcggaccugagccuggagaaagcggccaacguccagugggacgaaauggccgauauaaccggcagcucccccauaaucgaagucaagcaagacgaggacggaagcuuuuccauccgcgacguggaggagaccaauaugauuacccugcucguuaagcuggcccuaaucacgguuucgggccucuacccgcuggccauaccggucacaauggcgcugugguacaucuggcagguaaagacacagcgguccggcgcccucugggacguccccagccccgccgccacccagaaggccacucugucugagggaguguaucgcaucaugcagcggggccuguucgguaagacccaggugggcgucggaauccacauggagggcguguuccacaccauguggcacgugacccgcggcagcgucauuugccacgagacaggucgguuggagccguccugggcggacgugcgcaacgacaugaucaguuacggcggaggcuggaggcugggcgauaagugggauaaggaggaggacgugcaaguccuggccaucgagccagggaagaauccccggcacgugcagacaaagcccggccuguucaagacccugacgggggaaaucggagccgugacgcuggacuuuaaaccggggacaaguggcucaccuaucaucaauaagaagggcaaggucaucgggcucuacgggaacgggguggucaccaaguccggcgacuaugucagcgccaucacccaagccgagcgcauuggggagcccgacuacgagguggaugaggacaucuuccggaagaagagacuaaccauuauggaccuucauccgggcgcggggaagacgaagcggauccuccccuccaucgugagagaagccuugaagcggcgccugcggacccucauccuagccccgacgcgagucguggccgcggagauggaagaggcccugcgggggcugcccauccgcuaccagacccccgccgugaaguccgaacacacgggccgggagaucgucgaccucaugugccacgccaccuucaccacacgccugcugucaucgacgcgugugcccaacuacaacuugaucgugauggacgaggcucacuucaccgaccccugcuccgucgcggcccgcggguacaucagcaccagaguggagaugggcgaggccgcugccaucuucaugaccgccacgcccccggggagcaucgaccccuucccccaguccaacagcccgaucgaggacaucgagagggagaucccggaacgguccuggaacaccggcuucgacuggaucaccgauuaccagggcaagacugucugguucgugcccagcauuaaggccgggaacgacaucgccaacugccuucgcaaguccggcaagcgggugauacagcugucgaggaagacauucgacaccgaguacccuaagacgaagcucaccgacugggacuuugucgugacgaccgacaucuccgagaugggggccaauuuccgcgccggccggguaaucgauccccgucggugccugaagcccgucauucugaccgacgggcccgaacgugugauccucgcgggccccauccccguuacccccgcuagcgccgcccagaggcggggcaggaucggacgcaacccagcgcaggaggacgaccaauauguguuuuccggcgaccccuugaagaacgacgaagaccacgcccacuggacggaggccaagauguugcucgacaacauuuacacccccgaggggaucaucccgacccuguuuggccccgagcgggagaaaacccaggcaauugauggcgaauuccgucugaggggugagcagcgcaagacguucguggagcucaugcggcgcggcgaccugcccguguggcugagcuauaaggucgcauccgcggggaucagcuauaaggaccgggaguggugcuucaccggagagcgcaauaaccaaauccucgaagagaacauggaggucgagauuuggacacgggagggggaaaagaagaaacugcgccccaaauggcuggacgcccgcguuuacgccgacccgauggcccucaaggacuucaaggaguucgccaguggccgcaagagcaccacgcuggacauccuuacagagauugcgacccuccccacguaccuguccuccaaggccaaguuggcucucgacaacaucgucaugcugcacacuacggagaagggcggucgggcguaccagcacgccuuaaacgagcugcccgagucacuggagacccuuaugcucguggcgcugcugggcgcgaugaccgccgggaucuuccucuucuucaugcagggcaaggggaucggaaagcugagcaugggacugauugcaauggcgguggccuccggguuguuaugggucgcugagauccagccucaauggauugccgcgagcaucauucuggaguucuuccucauggugcugcugauccccgagcccgagaaacagcggacgccccaggacaaccaacucauuuacgugauucugacgauacugaccauaaucggccucaucgcggccaacgagauggggcugaucgaaaagaccaagaccgacuucggcuucuaccagguuaagacggaaaccaccauacucgacguggacuugcgcccggccucugccuggacccucuacgcgguggcgacgaccauacugacccccauguuacggcacacaauugagaacacguccgcaaaccugagccuggccgccaucgccaaccaagcggccguucucauggggcugggcaagggcuggccccugcacagaauggaucucggggucccccugcuggccauggguugcuauucgcaggugaauccaacuacacucacagccagccuggucaugcugcucauccacuaugcgaucaucgggcccggccuccaggcgaaggccacgcgggaggcccaaaagcgcaccgccgcgggcaucaugaaaaaucccaccguagacgggaucaccgucaucgaccucgagcccauauccuacgacccgaaguucgagaagcaacucggccaggucaugcugcuggugcucugcguugggcagcuuuugcucaugcggacgaccugggcccuuugcgaaguccugacccucgccaccggccccaucaugacucugugggaggggaaccccggccgcuucuggaacacaaccauugccguaagcaccgccaacaucuuccggggcuccuaccuggcgggggccggucucgccuucagcuuaaucaagaacgcccagacccccagacgggggaccggcacgacgggggagacgcuuggcgagaaguggaagcgccagcucaacucccuggaccgcaaggaguucgaggaguacaagcgcagcggcauucuggagguggaccggacugaggcuaaguccgcgcuccgcgacgggaguaagaucaagcacgccgucucccgcgguagcuccaagauccgcuggauuguggagcgugggaugauuaagccgaaggguaagguggucgacuuaggcuguggccgcgggggguggagcuacuacauggccaccuuaaaaaacguaacugagguuaagggcuacaccaaggggggcccagggcacgaggagcccauccccauggccacguacggguggaaccucguaaagcuacacuccggcguggacgucuucuacaagccgacggagcagguagacacccugcucugugacaucggggaaagcuccagcaaccccacgaucgaggagggcaggacgcugcggauacugaagaugguggagccauggcucagcuccaagcccgaauucuguaucaaggucuugaacccauacaugccgaccgucaucgaggagcuggagaaacuccagcgccggcacggagggagccuggugcgcugcccccugagccggaacagcacccacgagauguacugggucuccggcgccagcgggaacaucgucuccagcgugaacaccaucuccaagaugcugcucaaccgcuucacgacccggcaccgcaagcccaccuacgagaaggacgucgaccugggcgcgggcacucggagcguguccacggagaccgagaagccugacaugacaaucaucggccgccggcugcagcgccugcaggaggagcacaaggagacauggcacuacgaccaggagaaccccuaccggacgugggccuaccacgggagcuacgaagcacccucuaccgguagcgccuccagcauggugaacgggguugugaagcuguugacuaagccgugggacgugauccccauggucacccagcucgcgaugacggauacgacccccuucgggcagcagcgcguguucaaggagaagguagacacuaggacgccccagccgaaacucggcacgcgcaugauaaugacgaccacggccaacuggcugugggcccuacuggggaagaaaaaaucaccgcggcucugcacgcgcgaggaauucaucuccaaggugcguagcaacgccgccaucggagcgguguuccaggaggagcagggguggaccucugccagcgaggcagugaacgauucacgcuucugggagcucgucgacaaggaacgggcccugcaccaagagggcaagugcgagagcuguguguacaacaugauggguaagagggagaagaagcugggggaguucggccgcgccaaggggucccgggcgaucugguacauguggcucggcgcucgauuucuggaguucgaggcccugggguuccucaacgaggaccacugguucucgcgggagaacuccuggagcggcguggagggcgaggggcugcaucgccucggauacauccucgaagacaucgacaaaaaggauggggaucugaucuaugcggacgacaccgcgggcugggacacgcggaucaccgaggacgaccugcucaacgaagaguuaauuaccgagcagauggcgccccaccauaagacccuggccaaagcgaucuuuaagcucaccuaucagaacaaaguugugaaggugcuacgucccacacccaaaggcgcggucauggauauuaucuccaggaaggaccagcgcgggaguggccagguggggacauacggccugaacaccuucacuaauauggagguccagcucauccgccagauggaggcggaaggcgucauuacgcaggacgacaugcagaaccccaagggccugaaggaacgcguggagaaguggcugaaggagugcgguguggacagacucaagcgcauggccaucuccggggacgacugcgucgugaagccccuugaugagcgguucagcaccucccuccucuuccugaacgacauggggaaggugcgcaaggacgucccccagugggagcccagcaagggguggaagaacuggcaggagguucccuucugcucacaccacuuccacaagauauucaugaaggacggccggagccuggugguucccugucgcaaucaggacgagcucauagggagagcccgcaucucccagggcgccggcuggagccugcgcgagaccgccugccuggggaaggcguacgcccagauguggucucucauguacuuccaccgccgcgaccugcggcuggccaguauggccaucugcagcgccgugcccacggagugguucccgacgagucgcaccaccuggagcauccacgcgcagcaccaguggaugaccacggaagacaugcugaagguguggaaccgggucuggaucgaggacaaccccaacaugaccgacaagacccccgugcacuccugggaggacauccccuauuuaggcaagcgugaggaccuguggugugggucacucaucggcuuauccagccgggccaccugggccaagaacauccacacggcgaucacgcagguccguaaucugauugguaaggaggaguacgucgacuacaugcccgugaugaaacgguacuccagccccuccgagagcgagggcgugcucuga

SEQ ID NO: 26299 - RNA, 9867 nt, Artificial Sequence
  derived and/or modified CDS sequence (opt11) from DENV-4__JQ915086__SS-prME
agcaccaugacccugcugugccugauccccaccgugauggccuuccaucugagcacccgcgacggugagccgcucaugaucguggccaagcacgagcgggggcgaccccugcuguucaagaccaccgaggggaucaacaaguguacgcuuaucgcgauggaccugggggagaugugugaggacaccguaaccuacaagugcccccugcucgucaacaccgaacccgaagacaucgauugcuggugcaaccuuacaucaaccugggugauguacgggaccugcacgcaguccggggaacggcgccgcgagaagcgcagcguggcacuuacuccgcacuccggcaugggccucgagacccgggcagagacuuggaugagcuccgagggggcauggaagcacgcccagaggguggaaucuuggaucuuacggaacccgggcuucgcacuguuagcuggguucauggccuacaugaucgggcaaaccgggauccagcgcaccgucuucuuugugcugaugaugcugguggcucccaguuacggcaugagaugcgugggaguggggaaccgcgacuucgucgagggggucagcggaggggcguggguggaccucguguuagagcacggagguuguguaacgaccauggcucagggcaagcccacccuggacuucgaacugacgaagacaaccgccaaggagguggcccuucuacggaccuacuguaucgaggcaucuaucagcaacauuacgaccgcaacccgcugcccgacgcagggggagcccuaccucaaggaggagcaggaccagcaguacaucugccgacgcgacguggucgaucggggcugggggaacggcugcgggcuguucggcaagggcggaguggugacgugcgccaaguuccugugcucgggaaagaucaccgggaacuuaguccagauugaaaaccuggaguacaccgugguggugaccguccauaacggagacacacacgcggucggcaacgacacuagcaaccacggggugaccgccacaauaacgccgcgcucccccagcguagagguuaagcugccggacuauggcgagcucacccuggauugcgagccccggucggggaucgacuucaaugagaugauccuuaugaagaugaagaagaagaccuggcucguacacaagcagugguucuuagaucugccacuccccuggaccgccggugcugacacuagcgaggugcauuggaacuacaaggagagaauggucacguucaagguuccgcacgccaagcgacaggaugugacaguccugggaucccaagagggcgcuaugcacagcgcccuggccggugcgaccgaaguggacaguggggauggcaaccacauguucgccgggcaccucaaaugcaaggugcgcauggagaagcugagaaucaaaggcauguccuacacaaugugcagcgguaaguucaguaucgacaaggaaauggcugagacacagcacgguaccaccgucgugaaaguaaaguacgagggcgccggggcucccugcaagauucccaucgagauccgggacgucaacaaggaaaagguggugggcaggaucaucaguuccacacccuucgcggagaacacuaauagugucaucaacaucgaacuagaaccgccauucggugacucguacaucgugauaggcguuggugacagcgcucuaacccugcacugguuccggaagggcuccagcauagggaagauguucgagagcaccuaccgcggggccaagcggauggccauccugggcgagaccgcgugggacuuuggcagcgucgggggccucuucacgucacuggggaaggcagugcaccaggucuucggcaguguauacaccaccauguucgggggcguguccuggaugaucagaauccugaucggguuucucgugcuguggaucggcaccaauucucguaacacuuccauggcuaugacauguaucgcugucggcggcaucacucuguuccugggauuuacggugcaagcugacauggguugcguggugagcuggaacggaaaggaguugaagugcggguccggcauuuucguuguggacaacguccacacguggacagagcaguacaaguuccagcccgagagccccgcgcgccuggcgucggcaauccugaacgcacacaaggauggcgucugugggauccgguccaccacccgccucgagaacgugauguggaaacagauuacaaacgagcugaacuacgucuugugggagggcgggcaugaucucaccgugguggcuggcgacguaaagggcgugcuuaccaaggggaagagggugcucaccccgcccgucaacgaucucaaguacagcuggaagacguggggcaaggcgaagaucuucacacccgaggcccgcaauucuaccuuccugaucgacgggcccgacacgagcgagugccccaacgagcggcgagcauggaacuucuucgagguugaggauuauggcuucgggauguucacgacgaacaucuggaugaaguuccgggagggcuccagcgaggucugugaccaccgccugauguccgcagcaauaaaagaucaaaaggccgugcacgcugacauggguuacuggaucgagagcucaaagaaccagacguggcagauagagaaggccucgcucauagagguuaaaacguguuuguggcccaagacacacacccugugguccaacggggugcucgaaucucagaugcugauccccagguccuacgcagguccguuuagccaacauaacuaccggcagggguacgccacccaaacugccggccccuggcaccuggggaagcucgaaauugacuuuggugaaugccccggaaccacggucaagauacaggaagacugcgaccaccgggggcccucccugcgcaccaccaccgccaguggcaagcucguuacgcaguggugcugccgcucuugcaccaugccaccccuccgcuuccugggcgaggacggcugcugguacggcauggagauccgcccccugagcgaaaaggaggagaacauggucaagagccaggucaccgcgggccagggcaccuccgagacguucagcaugggucugcugugccugacccuuuucguugaggagugucugcggagacgggucaccaggaagcacaugaucuuagugguuguaaucaccuucugcgccaucauccucggcgggcugacguggauggaccugcuccgggcgcugaucaugcugggggauaccauguccggccgcaucgggggccagauccaccucgccaucaugaccguguucaaaaugucaccuggcuacgugcuaggcgucuuccugcggaaguuaaccucccgcgaaacggccuugaugguuauagggauggcgaugacaacgguguucagcaucccgcacgaccugauggaacucaucgauggcaucucccuggggcucauccucuugaagauagucacccacuuugacaacacccagguggggaccuuagcccucucucugaccuucauccggucaaccacgccgcuggugauggcguggcgaacuauuauggccgucuucuuuguaaucacucuaaucccucuguguaggaccucaugccuccagaagcagucucacuggguagagauuacagcccucauccugggcgcccaggcucugcccguguaccucaugacccugaugaagggggcgagcagacgguccuggccgcugaacgagggcaucauggccguggggcucgugagcuuacugggcagugccuugcugaagaacgacguaccccuggcagggcccaugguggccgggggacucuugcuggccgcuuacgugaugagcggguccuccgcagaccuaucgcuggaaaaggcagcgaacguccagugggacgagauggccgacaucacuggaucuagucccaucaucgaggugaaacaggacgaggacgggaguuucagcauacgcgacguggaagagaccaacaugaucacccugcucguaaagcuggcacugauuaccgugucuggccucuacccgcuggcgauucccgugaccauggcacugugguacaucuggcaggucaagacccaacgcagcggcgcgcucugggauguacccuccccugccgccacgcagaaggccacccugagcgaggggguguaccgcaucaugcagaggggccuguucgggaagacccaggucgguguggggauccacauggaaggcguguuccacaccauguggcacgucacccgcggcuccguuaucugccacgagacggggaggcucgagccgucaugggccgacguccgcaacgacaugauaucauacggcgggggcuggcgccugggagacaagugggacaaggaagaggacguccagguucuggcgaucgagcccgggaaaaacccccggcacgugcagacaaagcccggccuauuuaagacccugaccggggagauaggcgccgucacacuggacuuuaaaccggggaccaguggcuccccgaucaucaacaagaagggcaaggugaucgggcuauacggcaacggggucgucacgaaaagcggcgacuacgucagugccauaacacaggccgagcgcaucggcgagcccgacuaugaagucgaugaggacaucuuccggaagaagcgccucacgaucauggaccugcacccaggggccggcaagaccaagcgcauccucccuagcaucguccgcgaggcgcugaagcggcgccugcgaacccucauccuagcccccaccagagugguggccgcagagauggaggaggcucugagggggcugccaauccguuaccagacgccggccguaaaguccgagcacaccggucgggagaucguugaccucaugugccacgccaccuucaccacgcgccugcugagcuccacccgcgugcccaacuacaaucugaucgucauggacgaagcccauuucaccgaucccugcagugucgccgcgcgaggguauaucuccacccggguagagaugggcgaggccgccgccaucuuuaugacggccacgcccccaggguccauagaccccuucccccagagcaacagucccaucgaggacauugaaagagagaucccggagcggagcuggaacaccggcuucgacuggaucaccgauuaccaaggcaagacugugugguucgugccgagcaucaaggcggggaaugacauagcgaacugccugcgcaagagcggcaagcgagucauccagcugagucggaaaacauucgacaccgaauaucccaagaccaaacucacggacugggauuucguggugaccaccgacaucagcgaaaugggggccaacuuccgcgcaggcagagucaucgaucccaggagaugcuugaagccugugauccugaccgacgggcccgaacgagugauucuugccggccccauuccugucacgccggcuucggccgcucagaggcgcggccggaucggccgcaaccccgcacaggaagacgaucaauacguuuucagcggggacccccugaagaaugacgaggaccacgcccauuggaccgaggccaagaugcuucucgacaacaucuacacccccgaggggaucaucccgacucuguucggcccagagcgggagaagacccaggcaaucgacggcgaguuucgucuucgcggggagcagcggaaaaccuucguggagcucaugcggcgcggcgaccuccccgucuggcuguccuacaagguggccagcgccgggaucuccuacaaggaccgagaguggugcuucaccggcgagcgaaacaaccaaauccucgaagagaacauggagguggaaaucuggacucgggagggggagaagaagaaacuucgccccaaaugguuagacgcgaggguauaugccgaccccauggcccucaaggacuucaaggaguuugccagcggccgcaaguccacgacccuggacauccugaccgagauugccacccuccccaccuaccucagcuccaaggccaaauuagcacucgacaacaucguuaugcugcacaccaccgagaaagggggucgcgccuaccagcacgcacuuaacgagcuccccgagagccuagagacccugaugcugguggcccugcuaggugcgaugaccgccggcauauuccucuucuuuaugcagggcaagggcaucgguaaacuuuccaugggccugaucgccaucgccgucgcgagcgggcuccuguggguggcagaaauccaaccgcaguggaucgccgcuuccaucauucuggaguucuuucucauggugcuguuaauaccagaacccgagaaacagcgcacgccccaggacaaccaacucaucuacgugauccugacgauucucaccauaaucggccuaaucgccgcgaacgagaugggacugaucgagaaaacuaagacggacuucggcuuuuaccaggugaagaccgagaccaccauccucgacguagaucugcgcccggcaagcgccuggacgcuguacgccgucgcgaccaccauccucaccccaaugcuccggcacacuaucgagaacaccagcgccaaucuuucccucgccgcuaucgccaaccaggccgcgguacucaugggccuggggaagggcuggccccugcaccggauggaccucggggucccccuccuagccaugggcugcuacagccaggucaaccccacgacucucacggcuucccuagugaugcugcucauucacuacgccaucaucgggcccggacugcaagcuaaggcgacucgugaagcacagaaacgcacugccgccggcauaaugaagaaccccaccguggaugggaucacugucaucgaucuggagcccaucuccuacgauccgaaguucgagaaacagcucggccagguaaugcugcugguucucugcgucgggcaguugcugcuuaugagaaccacgugggcacugugugaagugcuuacccucgccacgggccccaucaugacccuuugggaggggaaucccggccgcuucuggaacacaaccaucgccguauccacggccaacauuuuccggggcagcuaccuggcgggugcuggcuuagccuucucccuaaucaagaacgcgcaaacgccccggagaggcacaggcaccacuggggagacccugggcgagaaguggaagcggcaguuaaacagccuggaccggaaggaguuugaggaauauaaacgcuccggcauccuggaggucgaccggaccgaggcaaagagcgcccuccgagacggguccaagauuaagcacgcgguuagccggggaucuagcaagauucgcuggaucgucgagcgggggaugaucaaaccuaagggcaaggugguggaccugggguguggccggggcggguggucuuacuacauggcaacucugaaaaacgugacggaggucaagggcuacacgaagggcggcccagggcacgaggagccgauuccgauggcgaccuacggcuggaaccucgugaaguuacauagcggcguggacguguucuacaagccgaccgagcaggucgauacccugcugugcgacaucggggaauccaguuccaacccaacgaucgaggagggcagaacucugcgaauacugaaaaugguggagccuuggcucagcagcaagccagaguuuuguaucaagguucugaauccguacaugcccacggugaucgaagaacuggagaaacuucaacggcgccacgguggcucacugguacgcugcccccuuucacggaacaguacccacgagauguacugggucagcggggcguccgguaacaucgugagcucgguaaacacgaucagcaagaugcugcucaacagguucacuacccggcaccgcaagccaacuuacgagaaggauguagaccugggggccgggacaagauccgugagcaccgagaccgagaagcccgacaugaccaucaucggacgccgccugcagcguuugcaggaggagcauaaggagacguggcacuacgaccaggaaaaccccuaucggacuugggcguaucacgggucauaugaggcccccagcaccggcuccgccagcuccauggucaacggcguagugaagcugcuuacaaagccgugggacgucaucccuauggugacgcagcucgccaugacugacaccacccccuucgggcagcagcgcguguucaaggagaaggucgacacgaggacgccccaaccgaaacuggggacccgcaugaucaugaccacgaccgcgaacuggcugugggcacucuuggggaagaagaaguccccucggcugugcacucgcgaggaguucaucagcaaagugcgcaguaacgccgccauuggcgccguguuccaggaggagcagggguggaccagcgcgagcgaggccgucaacgacagccgcuucugggagcucguggacaaggagagggcccugcaccaggagggcaagugcgaguccuguguguauaacaugaugggcaagcgcgagaagaagcugggggaauuuggccgcgccaaggggagccgggccauaugguacauguggcuaggcgcgcgcuuccuggaguucgaggcccuaggcuuccucaacgaggaccauugguucucccgggaaaauuccugguccggcguggaaggcgaggggcugcaccgccugggcuauauacucgaggauaucgacaagaaggacggggaccugaucuacgcagacgauacggccggcugggacacccgcaucaccgaggacgaccuacucaacgaggaacugaucaccgagcagauggcuccccaucauaagacgcuugcgaaggccaucuuuaagcucaccuaccagaacaagguggugaagguccugcgccccacccccaagggcgccgugauggauaucaucagcaggaaggaucagcggggguccggccagguggggaccuacggcuuaaauaccuucacgaacauggaaguccagcucauccggcagauggaagccgagggggugauaacccaggaugauaugcaaaacccuaagggccuuaaggagcgaguggagaaguggcugaaagagugcgguguagacagacuaaagaggauggcgauuaguggggacgacugcguggugaagcccuuggacgagcgguuuucaaccucccuccuguuccugaaugacaugggcaaggugcgcaaggacgucccacagugggagccguccaagggguggaagaacuggcaagagguacccuuuuguagccaccauuuucauaaaauauucaugaaagacggccggagcuuagucgugcccugccgcaaccaggacgagcucaucgggcgggcccguaucagccaaggcgccggcuggucccugcgggaaacagccugccuggggaaggcauacgcccagaugugguccuuaauguacuuccaccggcgcgacuuaaggcuggccagcauggccaucuguuccgccgugcccacggagugguuuccgacaagcaggaccaccugguccauccacgcccaacaucaguggaugacuacggaggauaugcuuaaggucuggaaccgaguguggaucgaggauaaucccaauaugacggacaaaacccccgugcacagcugggaggauauccccuaucuuggcaagcgcgaggaccuguggugcggcagccucauaggccugagcucccgggcgacgugggccaaaaacauccauaccgccaucacgcagguccgcaaccugaucgggaaagaagaguacguggacuacaugccggugaugaagcgguacucagcccccuccgagagcgagggcguccucuga

SEQ ID NO: 26300 - RNA, 9867 nt, Artificial Sequence
  derived and/or modified CDS sequence (opt11) from DENV-4__JQ915087__SS-prME
ucgaccaugacccugcucugccuaauaccaacugugauggcuuuccaccuaucaacccgcgauggcgagccguuaaugaucguggcgaaacacgagaggggacgcccccugcuguuuaagacgacugagggcaucaacaaguguacacuaauagcgauggauuugggggaaaugugcgaggacaccguaacguacaaaugcccccugcuagugaacaccgagccagaggacaucgauugcugguguaaccugacgucgaccugggugauguacgguaccugcacccaauccggggaacggcgccgggagaagcggagcguugcccucacgccgcacagcggcaugggccuagaaacccgcgccgagaccuggaugagcagcgaaggggcauggaagcacgcacagaggguggagagcuggauauuacguaaucccggcuucgcgcuucucgccggguuuauggcguacaugauuggucagaccggcauucagcgcaucgucuuuuucgugcugaugaugcuggucgcccccucauacggcaugcggugcgucggcguggggaaccgcgauuucguggagggcgucagcgggggcgcguggguggaccuagugcuggagcacggugguugcguaacgaccauggcccaagggaagcccacccuugacuucgagcucaccaagacaacagcaaaggagguugcucuguuacggaccuacuguaucgaggccagcaucagcaacaucaccacggccacgcgcugcccgacccaaggcgaaccauaccucaaggaggagcaggaccagcaguacaucugccggcgcgacguggucgaucggggcugggggaacggaugcggucucuucgggaagggcgggguggucaccugugcgaaguucuuaugcucgggcaagauaacggggaauuuaguacagauagagaaccuggaauacaccgugguggugacugugcacaauggcgacacccacgcagucggcaacgacacgucgaaucacggggugaccgccacgaucacgccccguucccccuccguggaggugaagcugcccgacuacggagagcucacucuggacugugagccccgauccgggaucgacuuuaaugaaaugauccugaugaaaaugaaaaagaagacauggcuagugcacaaacaaugguucuuggaccugccuuuacccuggaccgccggcgcggacacuagcgaagugcauuggaacuacaaggaacgaauggucacguucaaggugccgcacgccaagcggcaggacgugacgguccuggggucgcaggagggcgcgaugcauagcgcccuugcgggcgcgaccgagguagacagcggcgacgggaaccacauguucgccgggcaccuuaagugcaaggugcgcauggaaaagcugcggauaaagggaauguccuauaccaugugcagcggcaaguucuccauugacaaggagauggcagagacccagcacgggacaaccgucgucaaagugaaguaugagggggcaggcgccccuugcaaaauucccauagagauccgagacgucaacaaggagaaaguggucggcagaauuaucagcucgacccccuuugcggagaacacaaacagcgucaucaacaucgagcucgagccgccauucggggacucauacaucgugauaggcgugggcgacagcgcccucacgcugcacugguuccggaaagguuccagcaucggcaagauguucgaguccacguacaggggggccaagcguauggcuauccugggcgagacagcgugggacuucgggagcgucggcggucucuucaccagccuggggaaagccgugcaucagguuuucggcucugucuacacgaccauguucgggggcguguccuggaugauacguauacugaucggguuccuugugcuuuggaucgggaccaacucacggaacaccagcauggccaugacgugcaucgccguaggaggaaucacauuauuucuaggcuucaccgugcaggcggacaugggcuguguggucagcuggaauggcaaggagcucaaaugcgggucaggcaucuucgugguggacaacguucacaccuggacggagcaguacaaauuucagcccgagagccccgcgcgccuggccagcgccauccuuaacgcccacaaggauggcguaugcgggauccgguccaccacccgcuuggagaaugucauguggaaacagauuaccaacgagcugaauuacguccugugggagggagggcacgaccucacggugguggccggcgacgucaaaggcgugcugaccaaagggaaacgggcguuaacuccgcccgugaacgaccucaaguacagcuggaaaaccugggguaaggcgaagaucuuuacgccugaggcgcgcaacaguaccuuucugaucgacgggccagacaccagugaguguccgaacgaacggcgcgccuggaauuucuucgaagucgaggacuauggcuucgggauguucaccacgaacauuuggaugaaguuccgggaaggcaguagcgagguuugcgaucaccgccugauguccgccgcgaucaaggaccagaaggccgugcacgcugacaugggguacuggaucgaaucuucuaagaaccagacauggcagauugagaaagccucgcucaucgaggucaagacgugccuguggcccaagacccauacgcucuggucgaacggggugcucgagagccagaugcuaaucccacgguccuacgcuggcccuuucagccagcacaacuaucgccagggguaugccacccagaccgccgggcccuggcaccuugggaagcucgagauugacuucggggagugccccggcaccaccgugaagauccaggaggacugcgaccaccggggccccuccuuacgcacgaccacggcgagcggcaaguuagucacccaguggugcugccguucgugcacgaugccgccacuacgauuccugggcgaggauggcugcugguaugggauggagauccgaccgcugagcgagaaagaagagaauaugguuaaaagccaggugacugcgggccagggaaccucagagaccuucagcaugggccuccugugcuuaacccucuucgucgaagagugccucaggagacgggugacccgcaagcacaugaucuuaguaguggugauaaccuucugcgcgaucauucuaggcggguuaaccuggauggaccugcuccgcgcccugaucaugcugggcgacacuauguccggucgcauaggaggacaaauacaccucgccaucaugaccguguucaagaugagccccggguacguucuaggcgucuuccuucgcaagcucaccucgcgcgagacugcccugauggucaucggcauggccaugaccaccguguuuagcaucccgcacgaccuaauggagcucaucgauggcaucucauugggacugauccucuugaagaucgugacccacuucgauaacacccagguggggacgcuggcgcuuucgcugaccuucauccggucaaccacuccccuugugauggccuggcguacgaucauggccguauuuuucgucaucacacucaucccccuauguaggacgagcugcuuacaaaagcagucgcacuggguggagaucacggcccucauucugggcgcccaggcgcugccaguguaccucaugacgcugaugaagggggccagccggcgguccuggccgcugaacgagggcaucauggccgucggacucgucagccugcugggcuccgcccuccuaaagaacgacgugccccuggcgggccccauggucgccggggguuuacugcuggccgcguacgugaugagcggguccucggccgaccucucccuggaaaaggcugcuaaugugcagugggaugagauggcagacaucacuggcagcagcccgaucauugaggucaagcaggacgaggauggguccuuuagcauacgcgacguggaagagacuaauaugauaacucuguuagugaaguuagcccugauaaccguuaguggccucuacccucuugccauccccgugacuauggcguugugguacauauggcaggucaagacccaacggagcggcgcacucugggacgucccgucgccggccgccacccagaaggccacgcugagcgaggggguguaucgcauuaugcagcgcggccuguucggaaagacccaggugggggucgggauccacauggaaggcguguuucacaccauguggcauguuacccgcggcuccgucaucugccacgagaccggcaggcuggagccgagcugggcggauguucgcaacgauaugauaucguauggcggcggcuggcgccugggugauaaaugggacaaggaggaagacgugcaaguccuggccaucgagccugggaagaacccccggcacguucagacgaagccaggccuuuucaagaccuuaaccggggagaucggcgcgguaacacuagauuucaagccggggacgaguggcucccccauaaucaacaaaaagggcaagguuaucgggcucuacggcaacggaguggucaccaagucgggcgacuacgucucugcgaucacccaggccgagcgaaucggugaacccgauuacgaggucgaugaggacaucuuucggaagaaacgccugacaauaauggaccugcacccgggcgcgggcaagacgaagcggauccucccgagcaucgugcgcgaagcccugaaaagacgcuuacgcacccucauacuggcccccaccagagucguggcagcugagauggaggaggccuuacgugggcugcccauccgcuaccagacccccgccgucaagucugagcauacgggccgggagaucgucgaccuaaugugccaugccaccuucacuaccagacugcugagcuccacgcgggugcccaauuacaacuugaucgugauggacgaggcccacuucacagaccccugcagcguagcggcccgcggguacaucucuacucguguggagaugggcgaagccgcagccaucuucaugaccgccacucccccgggaucuaucgacccauucccucagagcaacuccccuaucgaagacauugagcgcgagauuccggagagaagcuggaacaccggcuucgauuggaucaccgacuaccagggcaagacagucugguucgugcccuccaucaaggcggggaacgacauugccaacugccugcgcaagaguggaaagcgcguaauccagcucagucggaagacuuucgacaccgaguaccccaaaaccaagcucaccgacugggacuuugucguuacgacugauaucucugagaugggggcgaacuuccgcgcgggucgggugaucgacccccgacggugucucaagccaguaaucuugaccgacgggcccgagcgcgugauccucgcgggccccaucccugugaccccagccuccgccgcucagcggcgcggcagaaucgggcguaaccccgcgcaggaggacgaucaauacguuuuuagcggcgacccccucaaaaaugacgaagaccacgcccacuggacagaggccaagaugcugcucgacaacauuuacacacccgaggggaucauuccaacccucuucggcccggaacgggagaagacccaggccauagacggcgaguuccgacugcgcggggagcagcguaaaacguucguggagcucaugaggaggggcgaccuccccguuugguuaucguacaaggucgccagcgcggggauuuccuauaaggaccgggaguggugcuucacuggcgagcgcaacaaccagauacucgaggaaaauauggaaguggaaauuuggacccgggagggggagaagaagaagcugcgacccaaguggcuggacgcccggguguacgcggauccgauggccuuaaaggacuucaaggaguucgccagcgggcgaaaaagcaccacauuggacaucuugacugagaucgcgacccugcccaccuaccugagcucgaaggccaagcuggcccucgacaacaucgucaugcuacacacgacugagaaaggcgggcgugcuuaccaacacgcgcugaacgaacugcccgaaucgcucgagacgcugaugcucguggcgcugcugggcgcgaugaccgccggaaucuuucucuucuucaugcagggcaagggaauugguaagcucuccaugggucugaucgcaaucgcgguggcuucagggcugcuuugggucgccgagauccaaccgcaauggaucgccgccucgaucauccuggaguucuuccucauggugcugcuuauccccgagcccgagaagcagcguacgccacaagauaaccaguugaucuacgugaucuugaccauauugaccaucauaggccuuaucgccgcgaaugagauggggcucaucgagaagacgaagacggacuucggauucuaucagguuaagacggaaaccaccaucuuggacguggaucuccgcccggcuucggccuggacccuguaugccguggcgacgaccauccugacccccaugcuccggcacaccaucgagaacacgagcgccaaccuuucucuggccgccaucgcuaaccaggccgcuguacucaugggacucgguaagggcuggccgcugcaucgcauggaccucggggugccucugcuggcaaugggcuguuacucacagguaaacccgacgacccucaccgcuucccuggucaugcugcucauucacuaugcuauuaucggaccuggucugcaggcgaaggccacacgggaggcccagaagcgcaccgcagcugggaucaugaagaaccccaccguagacggaauuaccguaaucgauuuggagcccauuuccuacgauccgaaguucgaaaagcagcugggccaggugaugcuguuagugcucuguguggggcagcugcugcucaugagaacgaccugggcucugugcgaggugcugacccuugccaccggacccaucaugacgcugugggaagggaaccccggccgcuucuggaauaccaccaucgcgguguccaccgccaacaucuuucggggcagcuaccucgcaggggcaggacucgcauucucccugaucaagaacgcccagacgcccaggcgggguaccggcaccaccggggagacccuaggugaaaaguggaagaggcaacucaacagcuuagaccggaaggaauuugaggaguacaaacgcucgggcauccuggagguggaccggaccgaggccaagucagcgcuccgcgacggauccaaaaucaagcacgccgugagccggggcaguuccaaaauccgcuggaucguggagcgggggaugauaaaaccaaagggcaaaguggucgaccuuggguguggccgcggcggaugguccuauuacauggcuacccugaagaacgugacggaggugaaggguuacacuaagggcggacccggccacgaggagcccauccccauggcuacguauggguggaaccuugucaagcugcacagcggcguugacguguucuacaagccgacugaacaggucgauacucuguuaugcgacaucggcgaguccagcuccaaccccaccaucgaggagggccguacgcugcggauccugaagaugguggaaccguggcucucgaguaagccggaguuuuguaucaaagugcugaauccuuauaugcccaccgucaucgaagaacuggaaaaguugcagcgccgucaugggggcucccuggugcgcugcccccugagccgaaacuccacccacgagauguauugggugucgggcgccuccggaaacauagucuccuccgugaauacaauuagcaagaugcugcucaaccgcuucaccacucggcacaggaagcccaccuacgagaaggaugucgaccuaggcgcgggcacccgcaguguuucuacggaaaccgaaaagccagacaugaccaucauaggccgccgacugcagcgacuccaggaggaacacaaggagacuuggcauuacgaccaggaaaaccccuauaggacgugggcguaccacggauccuaugaggccccguccacaggcuccgccagcuccauggugaacggugucgugaaacugcuuacaaagccgugggaugugauacccauggucacccagcucgcgaugacggauaccacaccguucgggcagcagcgcguauucaaggagaagguggacacccggacgccacagccgaagcugggcacucgcaugaucaugaccaccacggccaauugguuaugggcacuccuggggaagaagaagucgccgagacuguguacccgcgaggaguuuaucuccaagguccggagcaacgcagccaucggcgcuguguuccaggaggagcagggguggaccucggcaucagaggccgugaacgacagccgcuucugggaacucgucgacaaggagcgugcccugcaccaagaggggaagugcgaguccugcguguacaacaugauggggaagcgcgagaagaagcugggggaauucggcagagccaaggggagccgggcgaucugguauauguggcuaggcgcuagauuccuggaguucgaggcccugggguuccucaacgaggaccauugguucucccgggagaauagcuggucgggcguugaaggcgaggggcugcacagccugggcuacauccucgaagacaucgacaagaaggacggcgaccuuaucuacgccgacgacaccgccggaugggacacgcguaucaccgaggacgaccuguugaaugaagagcuuaucacagagcagauggcgccgcaucacaagacacuggccaaggccaucuuuaaauuaacguaccaaaacaaagucgugaaggugcugcggccgacccccaagggcgccgucauggacaucaucucccgcaaggaccagcggggcagcggccagguggggacguacggccucaacaccuucaccaacauggaggugcaguugauacgccagauggaggcggaaggggucaucacgcaggacgacaugcagaaccccaagggcuuaaaagagagaguggagaaauggcucaaggaaugcggcguggaccgcuuaaagaggauggcaaucuccggggacgauugcguaguaaagcccuuggacgagagauucagcaccucccuccuguuccugaacgacaugggcaaaguccggaaggaugucccccagugggaaccaucaaagggguggaagaauuggcaggagguucccuuuuguagccaucacuuccacaagauauucaugaaggauggacgcucgcugguggugcccugucggaaccaggacgaguuaauugggcgugccagaauaucccaaggggccggcuggucacugcgcgagacagccugccuugggaaggcguacgcacagauguggucgcugauguauuuccaccggcgcgaucuccgccuugcuucaauggccauuuguagcgcagugccgacugagugguucccgacaucgcggaccacauggagcauacacgcgcagcaucaguggaugaccacggaggacaugcucaagguguggaaccgcgucuggauagaggacaaccccaacaugaccgacaagacccccgugcauucuugggaggauauccccuaucuggguaaacgggaggaccuguggugugguucacucaucggccuguccucgcgcgccaccugggccaagaauauccauaccgccaucacacagguucggaaccuaaucgggaaggaggaauacguggacuacaugccggugaugaaaagguacuccgcccccagcgagucugagggagugcucuga

SEQ ID NO: 26301 - RNA, 9867 nt, Artificial Sequence
  derived and/or modified CDS sequence (opt11) from DENV-4__JQ915089__SS-prME
ucgaccaugacgcugcuaugccuaauccccaccguaauggccuuccaucuuuccacccgcgauggcgagccguugaugauuguggccaagcacgagcggggacgcccucugcuuuucaaaaccaccgagggcaucaacaagugcaccuuaauugcaauggacuuaggggagaugugcgaggacaccgugaccuauaagugcccccuccucgucaacaccgaacccgaggacaucgauugcuggugcaaccuuacgucuacuugggucauguacgggaccuguacccaguccggggagcggcgcagagagaagcgcagcguggcccugacgccgcacuccggcaugggccucgagacgcgagccgaaacauggaugagcuccgaaggggcguggaagcacgcccagcgaguggagucguggauccugagaaaccccggcuucgcgcugcucgcaggauucauggccuacaugaucggccagaccgggauccagcgcacggucuuuuucgugcugaugaugcugguugcgccuaguuacggcaugcggugcgucggcguggggaaccgcgauuucguggagggcgucagcgggggcgcgugggucgaccucgugcuggaacacggggggugcgucacuaccauggcccaaggcaagcccacccuggauuuugagcucaccaaaaccacagccaaggaaguggcgcuucugcggaccuauuguaucgaggccuccaucucgaauauaacgaccgcgacccgcugcccuacacagggggagcccuaccucaaggaggagcaggaccagcaguacaucugccgacgcgacguggucgaccggggcugggggaauggcugcggccuauuugggaagggggggguggugacgugcgccaaguuccugugcuccggcaagaucacggggaaucuuguccagauugagaaccuggaauacaccguuguagucaccgugcacaauggugacacgcacgccguuggcaacgauacuagcaaccacgggguuaccgccaccaucacgccacgcucccccagcguggaaguuaaacuaccugacuacggagagcucaccuuagacugcgaaccccgguccggaaucgacuucaaugagaugauccuuaugaaaaugaagaagaagaccuggcucgugcacaaacagugguuccuagaccugccccuucccuggaccgccggcgcggacaccagcgaggugcacuggaacuacaaagagcgcaugguaaccuuuaaggugccgcacgccaagaggcaggacgugaccgugcuggggagccaggaaggcgcaaugcacagcgcccuggcuggagcgaccgagguggacagcggggacggcaaccacauguucgcugggcaucuaaagugcaaggugcgcauggagaagcugcgcaucaagggcauguccuacaccaugugcagcggcaaauuuuccauagacaaggagauggccgagacacaacauggaaccaccgucguaaaggugaaguacgagggagcgggggcccccugcaagauuccuaucgaaauucgggacgucaacaaggagaagguagugggccgcaucaucagcagcacccccuucgcggagaacacgaauagcgugaucaacauagaguuggagccgcccuuuggggacucguacauugugauuggcgugggcgacagcgcccucaccuuacacugguucaggaaaggguccagcaucggcaaaauguuugaguccacauaucgcggggccaagcguauggcaauccugggcgaaaccgccugggacuucgggagcguaggcggccucuucacaucccuggggaaggccgugcaccaaguguuuggaagcgucuauaccaccauguucgggggcgucuccuggaugauccgcauccugaucggguuccucguacuguggaucggcacuaacucgagaaacacgagcauggccaugacgugcaucgccgucggcgguauuacucuguuccugggguucaccguacaagccgacauggggugcguggucagcuggaauggcaaggagcucaaauguggauccggcaucuuugugguggacaauguccacacguggaccgagcaguauaaauuucaacccgaaagcccagcgcguuuggccagcgccauccugaacgcccacaaagacggcgugugcgggauccgguccacuacccgccuugagaaugugauguggaagcagaucacaaaugagcuuaacuacguacucugggagggugggcacgaccucaccguuguggccggcgacgucaaaggcgugcugaccaaagggaagcgggugcugaccccgcccgucaacgacuuaaaguauagcuggaaaacguggggcaaagcaaagaucuucacccccgaggcgcgcaacucaaccuucuugauagacggucccgacaccagcgagugcccgaacgagcgccgcgccuggaacuucuucgagguagaagacuauggcuucgguauguucaccaccaauaucuggaugaaguuccgggagggguccucugagguaugcgaucaucgccugaugagcgcugccaucaaagaccaaaaggcugugcacgcagacaugggcuacuggaucgagagcucgaaaaaucagaccuggcagaucgagaaggccagccucaucgagguuaagaccugccuguggccuaagacacauacgcuguggucuaacggugugcucgagagccagaugcugaucccgcgauccuaugccggcccguucagccaacauaacuauagacagggguacgcgacccagaccgccggacccuggcaccucggcaagcucgagauagacuucggagagugcccaggcaccacggucaagauccaggaggacugcgaucaucgcggaccgucacugcgcaccacuaccgcaagcgguaagcuugugacucagugguguugccguucuugcaccaugccucccuuacgguuccugggggaggacggcugcugguaugggauggagauccgccccuugagcgaaaaggaggagaauauggugaaaucccaggucacugcgggccagggcacauccgagacguucagcaugggacuccugugcuuaacccucuucguggaggagugccugcggcgccggguaacccgaaagcauaugauccuuguagugguuaucacguucugcgcaaucauccucggcgggcugacguggauggaccugcuccgggcccugaucaugcugggcgacaccaugucggggcgcaucgggggccagauacaccuagccaucaugaccguguucaaaaugagcccgggguacguacugggaguuuuccugcggaagcucacaucccgcgagacggcgcuaauggugaucgggauggccaugaccacaguguucagcauaccccacgaucugauggagcucaucgacggcaucucccuaggccugauacuccuuaagaucgucacccauuuugauaauacucagguagguacccuggcccucagccuaacauucauccggucaaccacacccuuagugauggcuuggagaaccaucauggccgucuucuucgugaucaccuugaucccccucugccggaccagcugccugcagaagcagagucacuggguggagaucacggcccucauccucggcgcccaagcccugccugucuaucuaaugacccugaugaagggugcgagcucacgcucauggccgcucaacgaggggaucauggccguggggcucgugagucuguuagggagcgcacuccugaagaacgacgucccccuggcaggccccaugguggccgggggccuccuccuggccgcuuacgugauguccggaucguccgccgaccucagccuggagaaagccgccaacguccagugggacgagauggccgauaucaccggcaguucccccaucaucgaggugaagcaggacgaggacggcagcuucaguauacgggacguggaggaaaccaacaugaucacgcugcucgucaaacucgcccugauaacuguguccggguuguacccgcuggccauuccagucacuauggcauuaugguacaucuggcaggucaagacccagcgcuccggcgcgcucugggacgugcccagcccggcagccacgcagaaagccacccuguccgaggggguguaccggaucaugcagcgcggccuguuugggaagacgcagguuggcgugggcauccacauggagggcguguuccacaccauguggcacguuacacggggcagcguuauuugucacgagacggggcgccuggaaccguccugggccgacguacggaacgacaugauuucguauggcgggggcuggcgccugggugacaaaugggacaaggaggaagacguccaggugcuggcgaucgaaccugggaagaacccccgccacgugcaaaccaagccaggacuguucaaaacccugacaggggagauuggggccgucacccuggauuuuaagccgggcaccuccggcagccccaucaucaacaagaagggcaaggugaucggcuuauacggcaaugggguugucaccaaguccggcgacuacgucagcgccaucacccaggccgagcguaucggagagcccgauuacgaaaucgacgaggacauauuccgcaagaagagacugacgauaauggaccugcacccgggcgcaggaaagaccaagagaauccuccccagcauagugagggaggcacugaagcgccggcugcgcacgcucaucuuggcccccacccgggucguggcagcugagauggaggaggcgcugcgagggcugcccauccgguaucaaacgccggccgucaagagcgagcacaccggccgagaaaucgucgaccucaugugccacgccaccuucaccacgcggcuccuuucaagcacccgcgugcccaacuacaaccucaucgugauggacgaggcccacuucaccgauccguguucugucgccgcgagaggguacauaagcacacgcgucgaaaugggcgaggccgccgcaauuuuuaugacggccacgcccccugguucgaucgacccuuuuccccaguccaacagccccauagaggacaucgagcgggagaucccggagcgauccuggaacaccggcuucgacuggaucacggacuaccaggguaagacgguuugguucgugcccagcaucaaggcggggaacgacauagcaaacugccuucguaagucuggcaagcgcguuauccagcugagccgcaagacauucgacacagaguacccuaagacaaagcucacggacugggacuucgucgugaccaccgacauuuccgagaugggggccaacuuccgggccggucgcguuaucgacccccggcgcugccugaagccgguaauccugacagacgggccggagcgggugaucuuagccggccccauacccgugacgcccgcaagcgccgcacagcgccggggccgcaucggucgcaaccccgcgcaggaggacgaccaguacgucuucuccggcgacccccugaagaaugaugaggaccacgcucacuggaccgaggccaagaugcugcucgacaacaucuacacccccgaggggaucauaccaacccuguucggcccagagcgcgagaagacgcaggccaucgacggcgaguuucggcugcgcggggagcagcggaaaaccuucguggagcucaugcgccguggugaccugcccguguggcuaaguuacaaggucgccuccgccgggauaagcuacaaagaccgcgagugguguuucaccggcgagcggaauaaccagauccuggaggagaacauggaaguggagauauggacccgagaaggggagaagaagaagcugcggccaaaguggcuugacgcgcgcguguacgccgacccgauggcccucaaggacuucaaggaguucgccaguggucgcaagagcacgacuuuggauaucuugaccgagaucgccacccuccccaccuaucucucaaguaaggcgaaacuugcacucgacaacaucgucaugcuacacacgaccgaaaagggcgggcgggccuaucagcacgcccugaacgaguugccugagucccuggagaccuuaaugcucguagcccugcuuggcgcgaugaccgccgggaucuuccucuucuucaugcagggcaaggguaucggcaagcuaaguaugggccugaucgccaucgcaguugcguccggccuccugugggucgccgagauccagccgcaauggaucgccgccagcaucauccuugaguucuuccucauggugcuuuuaaucccggagcccgaaaagcagcgcacaccccaggauaaccagcucauuuacgugauacugaccauccugacuaucaucggccucauagccgcuaaugagauggggcugaucgagaaaaccaagacggacuucggcuuuuaccaggucaagaccgagaccaccauccucgacguggaccuccggccagccucugcuuggacgcuuuacgccguggccaccaccauccugaccccaaugcuccgacacacgaucgaaaauaccuccgcgaacuugucucuggccgccaucgcaaaccaggccgcggucuugauggggcuagguaaaggcuggccccugcaccggauggaucucgggguaccccugcucgccaugggaugcuacucccaggugaacccaacuacccucacggcuaguuuggucaugcugcucauacauuacgccaucaucggccccggucugcaagcgaaggcgacccgcgaggcccagaagcguacugccgcaggaauaaugaagaaccccaccguggacgggaucaccguuaucgaccuggagcccaucuccuacgacccgaaguuugagaagcagcuuggacagguaaugcugcuggugcucugcgugggccaacugcuacucaugcgcaccaccugggcguuaugcgaaguccucacccuugccacgggacccauaaugacccugugggaggggaaccccggccgcuucuggaacaccaccauugccgucagcacugccaauaucuuccgcggcuccuaccucgccggcgcuggccuagccuucagccugauuaagaaugcccagacuccccggcgcgggacuggaaccaccggggagacccuaggggagaaguggaagagacagcucaacucccuggaccgcaaggaguucgaggaguacaaacguaguggcauccuggagguggaccgcacagaggcaaagucagccuuacgggacgggucaaagaucaagcacgcggucucccgcggcagcuccaaaauccgguggaucguggagcgcggaaugauaaagccuaagggcaagguggucgaccuagggugcggccggggcggguggucuuauuauauggccaccuuaaaaaacguaacagaggugaagggcuacacuaagggcggccccggucacgaggagcccauccccauggccaccuacggcuggaaccucgucaagcugcacuccggcguggacguguucuacaagccgacugagcaggucgacacccugcucugcgacaucggggagagcuccagcaacccuacaauagaggagggccgcacauugcgcauccugaagaugguggagccuugguugucuuccaagcccgaguucugcauaaaggugcugaacccguacaugcccaccgugaucgaggaguuggagaagcuucagcgucgccacggaggcucacuuguacggugcccacugucccguaauagcacccaugagauguacugggugucuggcgccagugggaauaucgucaguuccgucaauacaaucuccaaaaugcuccucaaccgguucaccacucgccaccggaagcccaccuaugagaaggacgucgaccugggugccgggacgcgcagcguguccaccgagaccgaaaagccggacaugacgaucauaggccggcgccugcagcggcuccaggaagagcacaaggaaacguggcauuacgaucaagagaaucccuaucgaacuugggcguaccacggcuccuacgaggccccuuccaccggcagcgcguccagcauggugaacggugucgucaaguuacugacaaagccuugggacgugauaccgauggucacgcagcucgccaugaccgacaccacccccuucgggcagcagcggguguuuaaggaaaagguggacacaaggacgccccagccgaaguugggcacccggaugaucaugacuacgaccgccaacuggcugugggcccuccugggaaaaaagaaguccccgcgguugugcacgcgagaggaguuuauuaguaaagugcgcagcaacgccgcuauaggcgcuguguuccaggaggagcagggguggaccucggcaucugaggcugugaaugacuccagguuuugggagcucgucgauaaagagcgcgcauuacaccaagagggcaagugcgaaagcuguguguauaauaugauggggaagcgggagaagaaacugggcgaguucggccgagccaagggcucucgcgccauuugguauauguggcuuggcgcgcgguuccuggaauucgaagcuuugggguuccugaacgaggaccacugguucucgagagagaacucaugguccggcguggagggcgagggacugcaccggcugggcuauauccucgaggacaucgacaagaaggacggggaucugaucuaugcugacgacacggccggcugggauacacgcaucaccgaggacgacuuacucaaugaggagcugaucaccgagcagauggcgccccaccauaaaacucuggcgaaggcaaucuucaagcucacauaccagaacaaggucgugaaggugcugcggcccacccccaagggugccgucauggacaucaucucccguaaggaucagcgggggagcggccaggucggaacauacggccuuaacaccuucacgaacauggaggugcagcucauccgucagauggaggccgaagggguaaucacccaggacgacaugcagaacccgaagggccuuaaggaacggguggagaaguggcugaaggagugcggcguggaccgccucaagaggauggcgaucagcggggacgacugcgucgugaagccccuggacgagcgcuucagcaccucucuccuguuccugaacgacauggguaaagugcggaaggacguaccccagugggagccgagcaagggauggaaaaacuggcaagaggugcccuucuguagucaccacuuccauaagaucuucaugaaggacggccgcagccuggugguaccgugccggaaccaggacgaguuaaucgggagggcccggaucagucagggugccggcuggucccugagggaaaccgcaugccugggaaaagcuuacgcucagauguggucccucauguacuuccaucggcgugaccugcgccuggccagcauggccaucugcagcgcugugccuacggagugguucccuaccuccaggacuacuuggagcauacacgcccagcaccaguggaugacgaccgaggacaugcucaagguguggaauagaguauggauagaggacaaccccaacaugaccgacaagacccccgugcacuccugggaggacauccccuaccuggguaagagagaggaccuauggugcggaagccucaucggccucuccucgcgugcgacaugggccaagaauauucacacggccauaacccagguucggaaucugauugggaaagaagaguaugucgacuauaugccgguuaugaaacgcuacuccgcgccauccgaguccgagggcgugcucuga

SEQ ID NO: 26302 - RNA, 9867 nt, Artificial Sequence
  derived and/or modified CDS sequence (opt11) from DENV-4__JQ915082__SS-prME
ucuacaaugacccugcucugccuuauuccaacggugauggcuuuccaucucagcacccgcgacggcgagccucucaugaucguggccaagcacgagcggggccguccgcuguuguuuaagaccaccgagggcauuaacaagugcacccucaucgcgauggaccugggggaaaugugcgaagacaccgugaccuacaagugcccccugcuuguaaacaccgagcccgaggacaucgacugcugguguaaccugacaagcaccuggguuauguacgggaccugcacccagucuggggagagacggcgggagaaaagaagcguggcgcuaacaccgcauucggguauggggcucgagaccagggccgaaacguggaugucuucugagggagccuggaaacacgcccagcgcguugagagcuggauucugcggaaccccggcuuugcgcugcucgccgguuucauggccuauaugauuggacagacggggauccagcgcaucgucuucuuuguacugaugauguuaguggcgccauccuacggaaugcggugcguuggcguggggaaccgcgauuucguggaaggggucagcggcggcgcguggguggauuuggugcuggagcacggcggaugcguuacgaccauggcccagggcaaaccaaccuuagacuucgagcucaccaaaacgaccgcuaaagagguggcccugcugcggacuuacugcauagaggccagcaucucaaacaucacgacggcgacuagaugcccgacccagggggaacccuaccucaaggaggagcaggaccaacaguacauaugccgucgagacguaguggaccgggggugggggaacggcuguggccuguuuggcaaagggggggucgugaccugcgcaaaguuccuguguaguggcaagaucacugggaaccucgugcagaucgagaaucuggaguacacuguagugguuaccguucacaacggggacacccacgccgucggcaacgauacgagcaaccacggagugacagcaacaaucacgcccagauccccaaguguggaggucaagcugccggacuauggcgaacucacguuagauugcgagcccaggucagggaucgacuucaacgagaugauccugaugaagaugaagaagaagacuuggcucguccacaagcagugguuccucgaccugccccuccccuggaccgccggcgcggacacaagcgaggugcacuggaacuacaaggagcgcauggucaccuuuaagguaccacacgcaaagcggcaggaugugacggucuuggguucccaggagggcgccaugcacagcgcccuggccggugcgaccgaggucgauuccggggacggcaaccacauguucgccggccaccuaaagugcaagguucggauggagaaacuaaggaucaagggcauguccuacaccaugugcuccggcaaauucucgaucgacaaggaaauggcugagacccagcacgguacgacugucgugaaagugaaguacgagggcgccggcgcccccuguaaaauccccauagagauucgggaugugaacaaggagaagguggugggccgcauaaucagcaguacgcccuuugcggagaacaccaauucagugaucaacauagaacuggagccgcccuucggggacucauauaucguaaucggcguuggugacagcgcccucacgcuucacugguuccggaagggguccucgaucggcaaaauguucgagaguaccuaccguggggccaagcggauggccauucugggagagaccgcgugggauuucggguccguagggggccuguucaccucccuggggaaggcuguccaccagguguuugguagcgucuauacgaccauguucggggggguaucauggaugauccgcauccugauuggguuucucguucuguggaucggcaccaauagucgaaacaccucgauggccaugacgugcauagcagucggugggaucacccuguuccuaggcuucaccguucaggccgacauggggugcguagugagcuggaacggcaaagaguugaagugcggguccggcaucuuugucguagacaacgugcauaccuggacggagcaguacaaauuucagccagagucuccagcccgcuuagccagcgccauccugaacgcccacaaggacggcgugugcgggauccggaguacuacccgccucgagaauguaauguggaaacaaauaaccaaugagcugaauuacguccugugggaggguggucaugaucucacgguaguggccggcgacgucaagggcgugcugaccaaggggaaacgggcacugacgccgcccgugaaugaucuaaaguacucuuggaaaaccuggggcaaggccaagaucuucacucccgaggcccgcaacuccacuuuccugaucgacgggccugacaccagcgagugcccgaacgagcggcgcgccuggaauuuuuucgaggucgaggacuacggcuucgggauguucaccacaaacauuuggaugaaguuccgggagggguccagcgagguuugcgaccacagacugaugagcgcagcgauuaaagaccagaaggcgguacacgccgacaugggcuauuggauagaaagcuccaaaaaccagaccuggcaaauagagaaggccagucucaucgaggucaagaccugccuguggcccaagacccacacacucuggagcaacgggguucuagaaucccagauguugaucccccgguccuaugcgggcccguucagccaacauaauuaccgccagggguacgccacacagaccgccgggcccuggcaccuggguaagcucgaaaucgacuucggcgagugccccggcacaacagucaagauccaggaggacugcgaucaccgcgguccgucauugcgcacgaccaccgccucaggcaagcuagugacccaguggugcugucgcuccugcacaaugccgccccuccguuuucuuggagaggacggcugcugguauggaauggagaucagaccgcugucugagaaagaggagaacaugguaaaaucgcaggugacugccggccaaggcacuucugagacauucagcaugggccuccugugucugacucucuucgucgaagagugccugagacguagggucacccgcaagcacaugauccuggucguggugaucaccuuuugugccaucauccucgggggguuaacguggauggacuuacuccgggcccugaucaugcugggcgacacgauguccgguaggauagggggccagauccaucucgccaucaugaccgucuucaagaugagccccggcuacgugcuuggcgucuuccugagaaaacucaccuccagagaaaccgcucuuaugguuaucgggauggccaugacuaccguguuuaguaucccacacgacuugauggaguugaucgacggcaucucccugggccugaucuuguuaaagaucguaacccacuucgauaacacccaggucgggacccuggcgcugagccugaccuuuauccgcuccacuacgccccuggugauggcguggcgcacgaucauggccguguucuucgucaucacccucaucccccugugucggaccagcugccugcagaagcagucccacuggguggaaaucaccgccuuaauucucggggcacaggcgcugccgguguaccuaaugacacuuaugaagggggcaagccgccggucauggccucuaaacgagggcauaauggccguuggguuggugagccuacugggcuccgcccuccugaagaacgacgugccgcuggcaggccccaugguggccggagggcuacuccuugccgccuacgugaugagcggcucgagugccgaccucucucuggagaaggcggccaacguacagugggaugagauggcggauauaacuggaucaagccccaucaucgagguaaaacaggacgaagacgggucauuuucgauccgcgacgucgaggagaccaacaugaucacucugcucgugaaauuggcccugaucacugucucugguuuguacccgcuggccauccccgugaccauggcgcuuugguacaucuggcaggucaagacccagcgcagcggcgcacucugggacguacccuccccugcugccacccagaaggccacgcugagcgagggcgucuaccgcauaaugcaacgcggacuguucgggaagacacaagugggcguagggauccacauggagggcguguuccacaccauguggcacgugaccagaggcaguguaauuugccacgagaccggucgacucgaaccgagcugggcggacgugcggaacgacaugauuuccuaugguggcgguuggcgccugggcgauaagugggauaaagaagaagacguacaggucuuagcgaucgagccuggaaagaacccccggcacguacagacgaaacccggccucuucaaaaccuugaccggugaaaucggcgcgguuacccuggacuucaaacccgguacgagcggcucuccgauaaucaacaaaaaggguaagguaaucgggcucuacggaaacggggugguaacuaaaagcggcgacuacgucucagccaucacgcaggccgagcguaucggggaacccgacuacgagguggacgaagacaucuuccggaaaaagcgccugacaaucauggaccugcacccgggugcgggcaagacgaagagaauucuccccaguaucgugcgggaggcccucaaacggaggcugcggacgcucauacuggcccccacgcgcgucguugccgcggaaauggaagaggcccugcggggccugcccaucagauaucaaaccccugccguaaaaucagagcauacggguagggagaucgucgaccucaugugccacgcgaccuucaccacccgccugcuuagcaguacucgcgugccaaauuacaaucucauagugauggacgaggcacauuucaccgaccccuguagcgucgcagcucgaggauauaucucuacgcggguagagaugggugaggcggccgcaaucuucaugacugcuacgcccccggggagcaucgaccccuucccccagaguaacucucccaucgaagacaucgaacgcgaaaucccggagcgcucguggaacacgggauucgauuggaucaccgacuaccagggcaaaaccgucugguucgucccaucgauuaaggcggggaaugacaucgccaacugucugagaaagucuggcaagcgaguuauccagcuuucccggaagacguucgacacagaguaccccaagacuaagcuaaccgacugggacuuuguugucaccaccgacaucucagagaugggggcuaacuuucgcgcaggccgggugauugacccacgacggugcuugaagccggugauacugaccgacggucccgagcgcgugauucucgcaggccccaucccuguaacaccggcuuccgccgcccagcggcgcgggcggauagggcgcaaccccgcgcaagaggacgaccaguacguauucagcggggacccccugaagaaugacgaggaucacgcccacuggacggaagccaagaugcuguuggacaacauauacacucccgaaggaaucaucccaacccuguucggccccgaacgagaaaagacccaggccaucgacggggaguuuagacuccgaggggagcaacggaagacguucguggaacucaugcgacgcggagaccugcccguguggcuaucguacaaagucgccucagcggguauuagcuacaaagaccgagaguggugcuucaccggcgagcgcaacaaccagauauuggaggagaacauggagguggaaaucuggacucgcgagggggagaagaaaaagcugcgccccaaguggcuggaugcccggguguaugccgacccgauggcauuaaaggacuucaaagaguucgcgagcggccgcaaaucuacuacguuagacauccugacagagaucgcgacccuucccaccuaucugagcuccaaagcaaagcuggcccucgacaauaucguuaugcuccauaccacggaaaaagggggccgcgccuaccagcacgcgcugaaugagcuccccgagucuuuggaaacccugaugcuuguagcguuacugggcgccaugaccgccgggaucuuccucuucuuuaugcagggcaaggggauaggcaagcuuuccaugggucugaucgccaucgcgguggcgucgggcuuacugugggucgcggagauccaaccgcaguggaucgccgcaaguauaaucuuagaguucuuccucaugguacugcuuauucccgaaccugagaaacagcggacgccccaagauaaccaguugaucuacguaauccugacuauccugaccaucauaggccucaucgcggccaacgagauggggcugauugaaaaaaccaagacagacuucggguucuaucaggucaagacggagaccacgauauuggacguagaccuccgcccugccucggccuggacccuauaugcaguggccacuacgaucuuaacgccaaugcuucgccacaccauugaaaacaugagcgccaaccuauccuuagccgcuaucgccaaccaggcggcagucuugaugggacuggggaagggguggccucugcaccgaauggaccucggggugcccuuguuggccaugggcugcuauagccagguuaacccgaccacccucacugcgucccuggucauguugcucauccacuacgccaucauugggcccggcuugcaggcgaaggcaacucgggaggcccagaagcgcacagcugcgggcaucaugaaaaaccccaccguggacgggauuacugugauugaccuggagccaaucagcuaugacccgaaguucgagaagcaacucggacaggugauguugcuggugcucugcguggggcaguuguugcucaugcggacaacgugggcccugugcgaaguccugacucucgcuaccggccccaucaucacgcugugggaggguaauccaggccgauucuggaacacgaccaucgcgguguccaccgccaacaucuuucggggcagcuaucuugcgggggccggccucgccuucucccuaaucaagaacgcgcaaaccccccgccgagggacgggcaccacgggggagacccuaggagagaaguggaaaaggcaacucaacuccuuagaccggaaggaguuugaggaauacaagcgcuccggcauccuggagguagaucggacggaggccaagagcgcgcuucgcgacgggucaaagaucaagcacgcugucagucggggcucgucaaaaauccgguggaucguggagcgggggaugaucaaaccgaaaggcaaggugguggaccuggggugcggccgcggcgggugguccuauuauauggcuacccugaagaacguuacggaagugaagggcuacaccaagggcggaccagggcacgaggagccaauucccauggccaccuacggcuggaaccucgucaagcugcacuccggaguagacguauucuacaagccgacggagcaagucgauacuuuauuaugcgacaucggagaguccagcucuaaucccacuaucgaggaaggccguaccuugcggauucucaagaugguggagcccuggcuaucgucgaagcccgaguucugcaucaaagugcugaacccguauaugccaaccgucaucgaagaacuggagaagcuacagcgccgucacggcggguccuuagugcgcugcccguuaagccgaaacaguacccaugagauguacugggugaguggcgcaucaggcaacauagucagcuccgugaauacuaucagcaagaugcugcucaaucgguucaccacccggcaccgcaaaccuaccuacgaaaaggaugucgaucugggagcaggcacccggucggugagcaccgagacggagaagcccgacaugacaauaaucggcagacggcugcaaaggcuccaggaggagcacaaggagacauggcacuacgaccaagaaaauccauaccgcaccugggccuaccacgggaguuacgaggcccccagcaccggcuccgcuucaagcauggugaacggcguugugaagcuccugaccaagccgugggaugugauucccauggucacccagcucgcgaugaccgauaccaccccuuucgggcagcaaaggguguucaaagagaagguugacaccaggacgccccagccgaagcuggguacgaggaugaucaugacaacaacugccaacuggcuaugggcccucuuggggaagaagaagucccccagacugugcacgcgcgaggaauucaucaguaaggugcgcagcaacgccgccaucggggcaguguuucaagaggagcagggguggacauccgccagcgaggccgugaacgauagccgcuucugggagcuagucgacaaggagcgggcccugcaucaggaaggcaagugcgaaaguuguguguacaacaugaugggcaagagggagaaaaagcugggggaguuuggccgcgccaaggguucccgggcaauuugguacauguggcuaggcgcccgcuuccucgaguucgaggcgcugggguuccucaacgaagaucauugguuuucccgggaaaauucuuggagcggcguggaaggcgaagggcuccaucggcugggauacauccucgaagauauagauaaaaaggacggggaccugauuuaugccgacgacaccgcaggcugggacacuagaaucacugaagacgaccugcucaacgaggaacuaauaaccgaacagauggcgccccaccacaagacccuggccaaagcgaucuucaaacuaaccuaccagaacaaggucgugaaggugcuucgcccaacgcccaaaggcgccgucauggacaucaucucacggaaggaucaacgcggguccggccagguaggaaccuauggccugaauaccuucacgaauauggaggugcagcucauccggcagauggaggcggaggguguaauaacccaggacgauaugcagaaccccaaggguuugaaggaacguguggagaaauggcucaaggagugcggcguggaccggcuaaaacgcauggccauuuccggggacgauugcgucgugaagccacuggacgaacgguucuccaccagccuccuguuccugaaugacaugggcaaggugcguaaggacguaccacaaugggacccgucaaagggguggaaaaauuggcaggagguccccuucugcagccaccacuuucauaagaucuucaugaaggacggucgaucccucguagucccgugcagaaaccaggacgaguuaauuggacgcgcacgcauuagccaaggcgccggauggucccuccgggagacagccugcuuagggaaggcguacgcccagauguggucccucauguacuuccacaggagagaccugcggcuugccuccauggccauuugcucggccgucccaacagagugguucccgaccagccgaacgacauggaguauccacgcgcaacaccaguggaugacgaccgaggacaugcucaaggucuggaaccgugucuggaucgaagacaaccccaauaugacggacaaaacgcccgugcacucgugggaggacauaccauaccuugggaaacgcgaagaucuguggugcggaucucucauaggccuguccucccgggccaccugggccaagaacauccacaccgcuaucacgcaggugcgcaaccugaucgggaaggaggaauaugucgacuacaugccggugaugaagcgguacagugcccccuccgagucugaaggcguguuauga

SEQ ID NO: 26303 - RNA, 9867 nt, Artificial Sequence
  derived and/or modified CDS sequence (opt11) from DENV-4__JQ915081__SS-prME
agcaccaugacccugcucugcuuaauacccaccguaauggccuuccaccugaguacccgcgauggagagccgcucaugaucguggccaagcacgagcgggggcgcccccuguuauucaagaccaccgagggcaucaacaagugcacacucaucgcgauggaccuuggggaaaugugcgaggacaccguuaccuacaaguguccccugcucguaaacaccgagccggaggacaucgauugcuggugcaaccugaccagcacgugggugauguacggcaccugcacccaauccggggagcgucgaagagagaagcgaucuguggcccugaccccgcacucgggcaugggccucgagacccgggccgagacuuggaugagcuccgagggcgccuggaaacacgcucagcgcguggagucauggauacuccggaaccccggcuucgcacugcucgccggguuuauggccuacaugaucggccagaccgggauccagagaauugucuucuucguucugaugaugcugguggcccccuccuacggcaugcggugcgucgggguggguaaccgggauuucguggaaggcgucucggggggcgcauggguggaccuagugcuggagcacggcggaugugucacgaccauggcccagggcaagcccaccuuagacuucgagcucaccaaaacgaccgccaaggagguggcccuucugcggaccuauugcauagaggccuccaucucuaacaucaccacggcgacccgcugcccgacccaaggagagcccuaccuaaaggaggagcaagaccagcaguacaucugccggcgagacguagucgaccguggcugggggaacggcuguggccuguucgguaagggcggaguggugacuugcgccaaguuccugugcuccggcaagaucaccgggaacuuaguccaaauugagaaccucgaguacaccgugguggucaccgugcacaauggcgacacccacgccgucggcaacgacacuagcaaccauggggugaccgcuaccauuacgccccggucccccagcguggaggucaagcucccggacuacggcgaauugacgcucgauugcgagccccggucgggaauugauuucaacgagaugauccuuaugaagaugaagaagaaaaccuggcucgugcauaagcagugguuccuggaccuccccuuacccuggaccgccggcgcggacaccagcgaggugcacuggaauuacaaggagcgcauggucacauucaagguuccgcacgcuaagcggcaggacgugacgguccugggaucccaagagggcgccaugcauagcgcccuagccggagcgaccgagguggacucaggggacggcaaccacauguucgccggucaccuuaaauguaaggugcgcauggaaaaguuaagaaucaagggcaugagcuauaccaugugcagcggcaaauucuccaucgacaaggagauggcagagacccagcacgggacgaccguggugaaagugaaauacgagggagcgggggcccccugcaagauccccaucgagauccgggaugucaacaaagagaaggugguuggccggaucaucagcucaaccccuuucgcagagaacaccaauagcgucaucaacauagagcuggaaccgccauucggugacuccuacaucgugaucggagugggcgacagcgcccucacacuacauugguuccggaagggguccagcaucggcaagauguucgaguccaccuaucgcggcgcgaagcggauggccaucuugggcgagacagcuugggacuucgggagcgucggaggcuuauucacuuccuuagggaaggccgugcaucagguguucggcagcguguacacgaccauguucgggggaguuuccuggaugauccgcauccuuaucggguucuuagugcuguggaucggcaccaacagcagaaacaccucaauggccaugacuugcaucgcgguaggcgggaucacccuguuccucggcuucaccgugcaggcggacauggguugcguggucagcuggaacggcaaggagcuuaaaugcggguccggcaucuucguaguggacaauguccauacauggacggagcaguacaaguuccaacccgagagcccagcgcgccuggccagcgcaauccugaacgcccacaaggacggagugugcgggauacgguccacuacucgccucgagaacgugauguggaagcagaucacaaaugagcugaacuacguccugugggaaggcgggcacgaccucacgguaguggcaggcgacguuaagggcgugcuuaccaagggaaagcgggcgcugaccccgcccgugaacgaccucaaguacagcuggaagacuuggggaaaggccaagaucuucacgcccgaggccaggaacuccaccuuccugaucgacggccccgacaccagcgagugcccgaacgagcggcgcgccuggaacuucuucgaagucgaggacuacggcuuugguauguucaccacgaacaucuggaugaaguuucgcgagggcagcagcgaggucugugaccaccgccugauguccgccgcgaucaaagaccagaaggccgugcacgccgacaugggcuacuggauagagagcucgaaaaaccagaccuggcagaucgagaaggccagccucaucgaggucaagaccugccuguggcccaagacgcacacgcugugguccaauggggugcucgaaucucagaugcugauuccgcgguccuaugcggggccguucagccaacacaacuaccgccagggguacgccacccagaccgccggccccuggcaucuggggaagcucgagaucgacuucggcgaaugccccggcaccaccgugaagauccaagaggacugcgaccaccggggacccucccuccgcacgaccaccgccagcggcaagcuggucacccaguggugcugccgcuccugcacgaugccgccgcugcgguucuuaggggaggacgggugcugguacgggauggaaauccguccccuaucugagaaggaggagaacauggucaagagccaggugaccgccggccaaggcaccucagagaccuuuucgauggggcuccugugccuaacauuauucguggaggaaugccugcggcggcgggugacgcgcaagcacaugauccucgucguggugaucaccuucugcgcuaucauccucggagggcugaccuggauggaccugcuccgggcucugaucaugcugggugacacgaugucagggcgcaucgggggccagauccaucucgcaaucaugaccgucuucaagaugagccccggguacgugcugggcguguuccugaggaagcucacaucccgcgagacugcccugaugguuaucgggauggcuaugacgaccguguucagcauaccucacgaccucauggaacucaucgacggcaucucccugggccugauccuacugaagauagugacucacuucgacaacacccagguagggacgcuggcgcuuagccugacauucauccggucgaccacaccccuggugauggccuggcgcacgaucauggcuguguuuuuugucaucaccuuaaucccacugugccggaccagcugcuuacagaaacagucccacuggguggagauaaccgcccucauucugggcgcacaggcgcugccuguguaccucaugacgcugaugaagggugccagccgccggucauggccacugaacgagggcaucauggccguagggcucgugagccugcuggggagugcccuccugaaaaacgacgugccacuggcuggccccauggucgccgggggccuccugcucgccgcauacguuaugagcggguccagcgcagaccucucccuggagaaggcggccaacgugcagugggacgagauggccgacaucaccggcagcagccccaucauugaagucaagcaggacgaggacgggaguuucagcauucgggacguggaggaaaccaacaugaucacccuguuggugaaacuggcccucaucacggucuccggccuguacccgcuugccauccccguaacuauggcgcuaugguacaucuggcaggucaagacccagcggucaggugcccucugggacguucccagccccgcggccacccagaaggccacacugagugaggggguguaccggaucaugcagcgggggcuguucgggaagacccaggugggggucgggauccauauggaggggguguuccacaccauguggcacgugacccgcggcuccgucaucugucacgagaccggccgacuggagccaagcugggcggacgugagaaacgauaugaucuccuacggcggcggcuggagauugggcgacaagugggacaaggaggaggacguccagguccuagccauagagccgggcaagaacccccggcacgugcagaccaagcccggccucuucaaaacacuuacuggggagaucggugccgucacacuggacuucaagccggggacgucaggcuccccuaucaucaacaagaaaggcaaggucaucgggcucuacggcaacggcguggugacaaagagcggcgacuaugucuccgccaucacgcaggcggagagaaucggggagccggacuacgagguggacgaggacaucuuccggaagaagcgauuaaccauaauggaccugcacccgggcgcgggcaagacgaagaggauuuuaccaagcaucgucagggaggcccuuaagcggcgccuacggacccucaucuuggcccccacccguguaguggcagcggaaauggaagaagcgcuacgugggcuacccauccgcuaucagacaccggccgugaaguccgagcacacgggcagagagaucgucgaccucaugugccacgcaacuuucaccacucgccugcugagcuccacccgugugcccaacuauaaccucauagugauggaugaggcccacuucaccgaccccugcucagucgcagccaggggguacaucagcacccgaguagaaaugggcgaggcggcugccauauucaugaccgcaacgcccccggggagcaucgacccauucccccaaagcaacucgcccaucgaggacaucgagcgcgagaucccggagcggagcuggaacacaggcuucgacuggaucaccgacuaccagggcaagaccgucugguuugugcccuccaucaaggccgggaacgacaucgccaacugucugcgcaagagcggcaagcgcguaauccagcuaucccggaagacguucgacaccgaguaccccaaaacuaagcugaccgacugggacuuuguagugacgaccgauaucagcgagaugggggcuaauuuccgcgccggacgggugauugacccccgccgguguuuaaagccggucaucuugacagacgguccggagcgcgugauacucgcuggaccgauccccgucacuccugccuccgccgcccagagacgcggccggaucgggcguaaucccgcacaggaggacgaccaguacguauucagcggcgacccccucaagaacgaugaggaucacgcccacuggacggaggccaagaugcugcucgauaacaucuacacgcccgaggggaucaucccgacccuuuucggccccgagcgggagaagacccaggcaaucgacggcgaguuccgccugcggggggagcagcgcaagaccuucguggagcucaugcggcgcggagaccugcccguuuggcuguccuauaaggucgcuagcgcgggaaucuccuacaaggaccgagaguggugcuucacaggcgagcggaacaaccagauucucgaggagaacauggagguggaaaucuggaccagagagggagagaagaagaagcugcgcccgaagugguuagacgcccggguguacgcugacccgauggccuugaaggacuucaaggaguucgccagcggccgcaaguccaccacgcuggacauccuuaccgaaaucgcgacccuccccaccuaccugagcucuaaagccaagcuggcucucgauaacauagucaugcugcacaccacggagaagggcgggcgcgccuaccagcacgcccugaacgaguuacccgagucacuagagacgcugaugcuagucgcacugcugggcgcuaugaccgccgguaucuuccucuuuuucaugcagggcaaagggaucgguaagcuguccaugggccugaucgcuaucgcgguggccagcgggcuccugugggucgccgagauacagccgcaguggaucgcagccuccaucauccuggaguuuuuccucaugguacugcugauccccgagcccgaaaagcagcguacgccccaggacaaccagcuaaucuacgugauccugacgauacucaccaucauuggccucaucgcggcgaaugagauggggcugaucgagaagaccaagaccgacuucggcuuuuaccaggucaagacggagaccacuauccuggacguggaccuccgcccggcuagcgccuggacccuguaugccguggcaaccaccauucugacccccaugcuccggcacacgaucgagaacaugagcgccaaccugucccuggccgccaucgccaaccaggcggccgugcugauggggcuggggaagggcuggccccugcacaggauggauuuagggguaccucugcuggccaugggcugcuauucccaggugaacccgacgacccucaccgccucgcuggucaugcugcucauccacuacgcuaucaucgggcccggccugcaggccaaggccacccgggaggcccagaagcgcacggccgcgggcauuaugaagaaccccacaguggacgggaucacugucaucgaucuggagcccaucuccuacgacccaaaguuugagaagcagcuaggccagguaaugcuccucgugcucuguguggggcagcugcugcucaugcggaccacgugggcgcugugcgagguacugaccuuggccacuggccccauaaucacccugugggaggggaaucccggacgcuuuuggaacacgacgaucgcgguguccaccgccaacaucuuccguggcuccuaccuggccggggccggccucgccuuuucccugauaaaaaacgcccagacgccccgccgggggacgggcaccaccggggagacccugggcgagaaauggaagcgucagcucaacucccuagacaggaaggaguuugaagaguauaagcgcuccggcaucuuagagguggaucggacggaggccaaaucagcucuccgcgacggguccaagaucaagcaugccgucucucgggguuccagcaagauccgcuggaucguggagcgggggaugaucaagccgaagggcaagguggucgaccugggauguggccgcggcgggugguccuauuauauggccaccuuaaagaacgugaccgaggugaagggcuacaccaaggguggccccgggcacgaggagccaauccccauggccaccuauggcuggaaccucgucaagcugcacagcggcguggacguguucuacaaaccgacggagcagguagacacccugcuaugcgacaucggggaguccagcuccaaccccaccaucgaggagggcagaacccugcggauccucaagaugguggagcccuggcucagcagcaagccagaauucugcauaaaggugcugaacccguacaugcccacggucaucgaagagcuggagaagcuacagcgccggcaugggggaucccuggugcgcugcccccugagccggaacuccacccacgagauguacugggugagcggugcauccggcaacaucgucagcuccgugaacaccaucagcaaaaugcugcuaaacagguucaccacccgccaucgcaagccgacauacgagaaggacgucgaccugggcgcggggacccgguccgugagcaucgagaccgaaaagccggacaugacgaucaucggccgccggcuacagcgucuccaagaagagcauaaggaaaccuggcacuacgaccaagagaaccccuaccggaccugggccuaucacggguccuacgaggcccccagcaccggcuccgccagcagcauggugaacggggucgugaagcuccugacgaagccgugggaugugauccccauggucacccagcuugcgaugaccgacaccacgccguucgggcaacagcgcgucuucaaggagaaggucgacacccggacgccccagccgaagcugggcacucgcaugaucaugacgacgaccgccaacuggcugugggcccuccuggggaagaaaaaguccccgcggcucugcacuagggaggaguucaucuccaagguacggagcaacgccgccaucggugcgguuuuccaggaggagcagggcuggacguccgccuccgaggccgugaacgauagccgcuucugggaacucgucgacaaggagcgggcccugcaccaggagggcaagugcgaauccugcguguacaauaugaugggcaagcgcgagaagaaacugggggaguuugggcgcgccaaggggagccgggcuaucugguacauguggcucggcgcccgcuuccucgaguucgaggcccugggguuccucaacgaggaccacugguucucacgggagaacagcugguccggcguggagggcgagggucuccaccgcuugggcuacauccucgaggacaucgacaagaaggacggggaccuaaucuacgccgacgacaccgccggcugggacacccggauaacggaggacgaccugcuuaaugaggaguuaaucacggagcagauggcgccccaccacaagacccuggccaaggccaucuucaaacucaccuaucagaacaaggucgugaaagugcugcgccccacucccaagggagccgucauggacauuaucagccggaaagaccagcggggguccggccaaguggggacguacggccugaauacguucaccaacauggaggugcaguuaauccgccagauggaagcggagggggucauaacccaggacgacaugcagaacccaaaaggacugaaggagcgcgucgagaagugguugaaggaaugcggcguugaccggcucaagcgcauggcaauaagcggcgacgacugcgucgugaagccccuggacgaacgguucuccaccucgcuccuguuccugaacgauaugggcaaggugcgcaaggacgucccccagugggacccgagcaagggguggaagaacuggcaagaggugcccuucuguucucaccacuuccacaagaucuucaugaaagacggccggucccuggugguccccugucgcaaucaggacgaauuaaucggucgggcacgcaucucacagggcgccgguuggucccugcgggagacggccugccuggggaaggcguacgcccagauguggagccuaauguacuuccaccgacgagaccugcgccuggcaucaauggccaucugcagcgccgugccuaccgagugguuuccgaccucucgcaccacguggaguauccacgcacagcaccaguggaugaccaccgaggacaugcucaagguguggaaccgggucuggaucgaggauaaccccaauaugacugacaagacaccggugcacucgugggaagacaucccauaccugggcaagcgcgaggaccuguggugcggcucgcucaucggccuaagcucccgcgcaaccugggcuaaaaacauucacaccgccaucacccaggugagaaaccugauagggaaggaggaguacgucgauuauaugccggugaugaagcgguacagugccccguccgaaagcgagggcgugcucuaa

SEQ ID NO: 26304 - RNA, 9867 nt, Artificial Sequence
  derived and/or modified CDS sequence (opt11) from DENV-4__JQ915084__SS-prME
agcaccaugacccugcucugccugaucccgaccgugauggccuuccaccugaguacccgcgacggcgagccgcucaugaucguggccaagcacgaacgggggcgcccgcugcuguucaaaaccacagagggcaucaauaagugcacccucaucgcgauggaccugggggaaaugugcgaggacacggugaccuacaagugccccuugcucgucaacaccgagcccgaggacaucgacugcuggugcaaccugaccagcaccuggguaauguacgggaccugcacccaguccggggagcggcgccgggagaagcgcagcguggcgcugacgccacacuccggcaugggccucgagacccgggccgagaccuggauguccucugaaggggcguggaagcacgcccagcgugucgagagcuggauccuacggaaucccggcuucgcacugcuagccggauuuauggcuuacaugauuggacaaaccgggauacagcgcaucguguucuucgugcugaugaugcuaguggcccccagcuauggcaugcgcuguguagggguagggaacagagacuucguggaaggcgucucggggggcgcguggguggaccucguguuagagcacggcgggugcgucacaaccauggcccagggcaagcccacccuggacuucgaacucaccaagacgacagccaaggagguggcccuccugcggaccuauugcaucgaggccuccaucaguaacaucacgaccgcgaccagaugcccuacccagggggagcccuaccucaaggaggagcaggaccagcaguacauuugccggcgcgacguggucgacagaggcugggggaacggcugcggacuguuugggaagggcggcguggugaccugugccaaguucuugugcuccggaaagauuacggggaaucuaguacagaucgaaaaccuggaauacaccgugguggucacaguucacaacggggacacucacgccgucggcaacgacacgagcaaucacggggugacagcuaccaucacgcccagaucccccagcguagaggucaagcugccggacuacggggagcucacgcuggacugcgagccccgguccgggaucgauuucaacgaaaugauccugaugaagaugaaaaagaaaacauggcucgugcauaaacagugguuccuggacuugccccuccccuggacagccggcgcggauaccagcgagguucacuggaacuauaaggagcgcauggucacuuucaaggugccucaugcaaagcggcaggacgucacgguccuagguagccaggagggcgcaaugcacagcgccuuagcaggcgcgaccgagguagacuccggggacgggaaccacauguucgccgggcaucucaagugcaaggugaggauggaaaaguuacgcaucaagggcaugucuuacaccaugugcagcggcaaguuuuccaucgacaaggagauggcggagacccagcaugggacgaccgucgugaaggugaaguacgagggcgccggggcccccuguaagauucccauagaaauucgggacgucaauaaggagaaggugguaggccgcaucaucagcaguacccccuucgcggagaacaccaacagugucaucaauaucgagcuggagccgccguucggagacuccuauaucgugauuggugugggcgacagugcccucacacugcacugguuccgcaaggggucaucaaucggaaagauguucgaguccaccuaccgcggggccaagcggauggccauccugggcgagaccgcgugggacuuugggaguguaggcggccuguucaccucccuggggaaggccguucaccagguuuucggcagcguguacacuaccauguucgggggcgugagcuggaugauccgcauccugaucggguuccucguccuguggaucggcacuaacagccggaacacuuccauggccaugacgugcaucgcagucggcgggauaacccuguuccuuggcuucaccgugcaggccgacauggggugcgucgucagcuggaauggcaaggagcucaagugcggguccggcaucuucgugguugacaauguccacacuuggacggagcaguacaaguuccaacccgagagccccgcgcgccuggccagugccauccuaaacgcgcacaaggacggcgugugcgggauacgguccaccacccgucucgagaacgugauguggaagcagaucacuaacgagcugaauuauguccugugggaaggugggcacgaccugacggugguggcaggcgacgucaagggcguguuaaccaaggggaagcgggcgcuuacaccgcccgugaacgaucucaaguauucauggaagacguggggcaaggccaagaucuuuacgcccgaagcccgcaacucuaccuuucugaucgacgggcccgauacgucggaauguccgaaugagaggcgcgcauggaacuucuucgaggucgaggauuacggcuucgguauguucaccacgaacauuuggaugaaguuccgggagggcucaagcgaggugugcgaccaccgacugaugagugccgcgaucaaggaccagaaggcggugcacgccgauaugggcuacuggaucgagagcuccaaaaaccagaccuggcagauugagaaggccagccucaucgaggucaagaccugccuguggccaaagacccacacguugugguccaacggggugcucgagucucagaugcugaucccccgguccuacgcggggccguucagccagcacaacuacaggcagggcuacgccacccagacugccggccccuggcaccuggggaagcuggagaucgauuucggagagugccccggcaccaccguaaagauccaggaagauugcgaccaccgggggcccagucugcgcacgacaaccgcaagcggcaaacuggucacccaguggugcugucgcuccugcacgaugccgccccuccgguuccuaggggaggacggcugcugguacggaauggagauucgcccccugagcgaaaaggaggagaacaugguaaaaagccaggugaccgcggggcagggcaccuccgagaccuuuagcauggggcuccuuugccugacccucuucgucgaggaaugccugcggagaagagugacccgcaagcacaugaucuuagucguggugaucaccuucugcgcgauuauccuuggcggccucaccuggauggaccugcuccgggcgcugauaaugcugggcgacacgauguccggccgcaucgggggccagauccaccuggcgaucaugaccguuuucaagaugagccccggguacgugcugggcguguuccugcggaagcucacaucacgagagaccgcacugauggucaucgggauggccaugacgaccguguucucuaucccucaugaccugauggagcucaucgacggcauuucccugggacugauccuacugaagaucgugacccacuucgacaacacccaggucgggacgcuggcgcuuagccugaccuucaugcgguccaccacgccccuggugauggcuuggcgcaccaucauggccguguucuucgucaucacacucaucccgcugugccggacaagcugucugcagaagcagucccacuggguagagauaaccgcccucauccuuggcgcccaggcgcugccaguguaucucaugacguuaaugaaaggggccagcaggcgguccuggccacugaacgagggcaucauggcaguuggccucgugagcuugcugggcucggcccuccugaagaacgaugugccacuggcgggcccgauggucgccgggggucuccugcuggccgccuacgugaugagcggguccagcgccgaucuaucccuggagaaggcggccaacgugcagugggacgaaauggcugacaucaccggcagcagucccaucaucgaggucaagcaggacgaggacggaucauuuagcaucagggacguggaggagacgaacaugauaacccugcucgugaagcuggcccugauuacggucuccggccucuacccgcucgccauccccgugaccauggcgcugugguacaucuggcaggucaaaacucagcggucgggagcacucugggacgucccuucccccgccgccacccagaaggccacucugagcgaggggguguaccggaucaugcagcggggccuuuuugggaaaacccaggugggcgucgggauccacauggagggcguguuccacaccauguggcacgucacccggggcuccgucaucugccacgagaccgggcgacucgaaccgagcugggcggacgugcgcaacgacaugaucuccuacggggggggcuggcgccugggggauaagugggacaaggaggaggaugugcagguucuggccaucgagccugggaagaacccccgucacgugcaaacgaagcccggauuguucaagacccugaccggggagaucggagcgguuaccuuagacuucaaacccggcacguccggcucucccaucauuaacaagaaaggcaaagugauagggcucuacggcaacgggguggugaccaagagcggcgacuacgucuccgcaaucacccaggccgagcguaucggggagccugacuaugagguagacgaggacaucuucagaaagaaacgccuaacaaucauggaccuccacccgggcgcgggcaagacgaagagaauccucccguccauugugagggaggcccugaagcggcgccugcggacccucauccuggcccccacccgcgugguggccgcggagauggaggaggcacugcgugggcugcccaucagguaccagacgccggcugugaaguccgagcauacgggucgggagaucgucgaccucaugugccacgcuaccuuuaccacccgccuacugucgucuacgcgggugcccaacuauaaccuuaucgugauggacgaggcccacuucaccgaccccugcagcgucgcggcucgcggguacaucuccacccggguggagaugggggaggcugccgccaucuuuaugaccgccacgccgccggggagcauugacccguucccccagucuaauucccccauagaggacaucgagcgggagauuccggagcggagcuggaauaccggcuucgacuggaucaccgauuaccagggaaaaacagucugguucgugcccuccaucaaggccgggaacgacaucgccaacugccugaggaagucaggcaaacgcgugauccagcucucccggaaaacguucgacaccgaguaccccaagaccaagcugaccgacugggacuucgucgugacgaccgauauaagugaaaugggggccaacuucagagccggccgggugauugacccccgccggugcuugaagccggucauccuaaccgacgggcccgagcgcgugauccucgccggccccauccccguaaccccggcauccgccgcccagcggcgcggacggaucgggaggaaccccgcgcaggaggaugaccaguacgucuuuagcggagacccauugaagaacgacgaggaccacgcacacuggacggaggccaagaugcugcucgacaacaucuacacccccgagggcaucauaccgacccuguucggcccugaacgggagaagacccaagccaucgacggcgaguuccgcuugcgcggggagcagcgcaagacguucguggagcucaugcggcgcggcgaccugcccguguggcuguccuacaagguagccagcgcggggaucuccuauaaggaccgggaguggugcuucaccggcgagcgcaacaaucagauccucgaggagaacauggagguggagauuuggacccgggagggggagaaaaagaaacugcgccccaaguggcuggacgcucggguguacgccgacccgauggcccucaaggacuucaaggaguuugccagcgggcgcaagucaaccacacuggauauccugaccgaaaucgcuacccuccccacauaccugucuuccaaggccaagcuggcccucgacaacaucgucaugcugcauacaacugagaaaggcgggcgcgccuaccagcacgcccugaacgagcucccagagagccuggagacccuaaugcucguggcgcuucugggcgccaugaccgcagggaucuuucucuucuucaugcagggcaaggggaucggcaagcucucuaugggccugaucgcgauagcggucgcgagugggcuccugugggucgccgaaauccagccgcaauggaucgccgccuccauaaucuuggaguucuuccucauggugcugcugauccccgagcccgaaaaacagagaacgccccaggacaaccagcucaucuacgugauccugacgauccuggcgaucaucggccucaucgccgccaaugaaauggggcugauagagaaaaccaagacggacuucgguuucuaccaggucaagacggagacgacuauccuggacguagaccuccgcccggccagcgccuggacccuauacgcgguggcgaccaccauccugacccccaugcuacggcacaccaucgagaacaccagcgcuaaccugucccuggcagccaucgcgaaccaggccgcaguucucauggggcugggcaagggcuggccccuacaccgcauggaccucggggugccccugcuggccauggggugcuacucccaggugaacccgacgacccuaacagcaucccuggucaugcuccuaauccacuacgccauaaucgggccgggccuacaagccaaagccacccgggaggcccagaagcgaacggcggccggcaucaugaagaaccccaccguggacgggaucaccgugaucgaccucgagcccaucagcuacgaccccaaguucgagaaacaacucggccaggucaugcuguuagugcucugcguggggcagcugcugcucaugcgcaccacgugggcccugugcgaaguccugacccucgccacaggccccaucaugacccugugggaggggaaccccggcagauucuggaacacgaccaucgcugugagcaccgcaaacauauuccgggggaguuaccuggcuggugcaggacucgccuucucccugaucaaaaacgcccagacgccccgccgggguacgggcaccaccggagagacccucggcgagaaguggaagcgccagcucaacagccuggaccggaaagaguucgaggaguacaagcguuccggcauccuggagguggaccgcacagaggcuaagagcgcucuccgcgaugggagcaagaucaagcacgcugucagccggggguccaguaagauucgcuggaucguagagcgggggaugaucaagccgaagggaaagguggucgaccuuggguguggccgcggcgggugguccuacuacauggccacccugaagaacguuacagaggugaaaggcuacaccaagggaggccccgggcacgaggaacccauccccauggccaccuacggcuggaaccucgucaagcugcacagcggcguggacguguucuacaaaccuacggagcaggucgacacacugcucugcgacaucggggaguccagcagcaaccccacaaucgaggagggccgcacacugaggauccugaagaugguggagcccuggcucaguucuaaaccugaguucugcauuaagguucugaauccguacaugcccacggucaucgaggagcuggagaagcuacagcgccggcacggggggucccuggugcgcuguccccugucgcggaacuccacccacgagauguacugggugagcggcgcguccgggaauaucgucagcuccgugaacacuaucucaaagaugcugcuuaaccgcuuuacaacgaggcaucgcaagcccaccuacgagaaggacguagaucugggcgcagggacccgguccgugagcaccgaaacggagaagccggacaugaccaucauuggccgccgucugcagcgccuccaggaagagcacaaagagaccuggcacuacgaccaggagaacccuuaccggacuugggccuaccacgggucuuacgaagcgcccagcacgggcagugcgucauccauggugaacgggguagugaagcuuuuaacgaagccuugggacgugauaccgauggucacccagcucgccaugaccgacacgacccccuucgggcagcagcgcguguuuaaggagaaaguagacacccggacgccccagccgaaaaucgguacgcgcaugaucaugacaaccaccgccaacuggcuaugggcccugcucgguaaaaagaaguccccgcggcuuugcacucgggaggaguucaucuccaaaguccggagcaaugcagcuaucggcgccguguuucaggaggaacagggcuggacgagcgccagcgaggccguaaacgacagccgcuucugggaguuagucgacaaggagcgggcccuccaccaggagggcaagugcgaguccuguguuuacaauaugauggggaagagggagaagaagcugggggaguucggccgcgcgaaagguucuagagccaucugguacauguggcugggggcccgcuuccuagaguucgaggcccugggguuccugaacgaggaucacugguucucccgggaaaacagcugguccggcguggagggcgaggggcuccacagacugggcuauauccuggaagacauugacaagaaggacggggaccugaucuacgccgacgacaccgcaggcugggacacccggaucacggaggacgaccuacugaaugaggagcucauuaccgagcagauggcgccccaccacaagacccuagccaaggccaucuucaagcuuaccuaccagaauaaggucguaaaggugcuccgccccacgcccaaaggcgcggucauggacaucaucagccggaaggaccagcgcgggagcggccagguaggaaccuacgggcugaacaccuuuaccaacauggaagugcagcugauucgccaaauggaggcggagggggucaucacccaagacgacaugcagaaccccaagggccucaaggagcguguggagaaguggcugaaggaaugcggcguugaccggcugaagcgcauggcaaucagcggggacgauugcgucgugaagccccucgacgaacgguucuccacgagccugcuauuccucaacgacaugggcaaaguacgaaaggaugucccccagugggagccuucaaagggguggaagaacuggcaggaagugcccuuuuguagccaccauuuccauaagaucuucaugaaggacggccgaucgcugguuguccccugccgcaaucaagaugagcugaucgggagagcccgcauaagucagggugcuggcuggucccuccgggagacugcgugccuugggaaagccuacgcacaaauguggagcuugauguacuuccaccgccgugaccuccggcucgcuuccauggccaucugcagcgcggugcccaccgagugguucccgacgagccgcacgacaugguccauccaugcccaacaccaguggaugaccaccgaggacaugcugaagguuuggaaccgugucuggaucgaggacaaccccaauaugacggauaagacccccguucacagcugggaggacauccccuaccucggaaagcgcgaggaccuguggugcgggucccugaucggccucucaucccgggccaccugggccaagaacauccacaccgccaucacgcaggugcgcaaccugaucgggaaggaggaguacgucgacuacaugccggugaugaaaagguacagcucccccucggaaucagaaggcgugcuguag

SEQ ID NO: 26305 - RNA, 9867 nt, Artificial Sequence
  derived and/or modified CDS sequence (opt11) from DENV-4__KM190936__SS-prME
agcaccauaacccuguuaugccugauucccaccguuauggccuucucccuguccacccgcgacggggagccgcucaugauuguggcaaagcacgagcgggggcggccgcugcuguucaaaaccaccgagggaaucaacaaguguacacuaaucgcgauggaccucggggagaugugcgaggacaccgugaccuauaagugcccccugcuggugaacacggaaccggaagacaucgacuguuggugcaaccugaccagcaccugggugauguauggaaccugcacgcaaagcggugagcggcgccgggagaagcguaguguggccuugaccccgcacucuggaaugggccucgaaacccgggcggagacguggaugagcagcgagggcgcuuggaagcaugcccagcgcguugaauccuggauccuucggaauccuggcuuugcgcuacucgcagguuucauggccuacaugauuggccagaccggcauacagcgcaccguguucuucguacuuaugaugcuaguugccccgagcuacgggaugcgguguguuggcgugggcaacagagauuucguggaaggcgucuccggcggcgcguggguggacuuaguacuggagcauggggggugcgucacaacgauggcgcaaggcaaacccacccuggacuuugaacuaacuaagaccacggcaaaagagguggcccugcugagaaccuacuguauugaagccuccauuuccaacaucacgaccgcgacucgcugucccacccaaggagaaccguacuuaaaggaagaacaggaccagcaauacaucugucgcagggacgucgucgaccgaggcugggggaauggcugcggacuauucggcaaaggcgggguggucacuugcgccaaguucucgugcagcggcaagaucaccgguaaucuuguccagaucgagaauuuagaguauaccgugguggucaccgugcacaacggggauacccaugccguuggcaaugacaccucuaaccacggggugacggccaugaucacgccgcgguccccuagcguagaggucaaguuaccggacuacggugagcucacguuagacugcgaaccacgcucggggaucgacuucaacgagaugauccucaugaagaugaagaagaagacuugguuagugcacaagcaaugguuccucgacuugccccugcccuggaccgccggcgcagacaccucugaggugcacuggaacuacaaggagaggauggugaccuucaagguuccccacgccaagcgccaagacgugacaguccucgggagccaagaaggggcuaugcauuccgcccuugccggcgcgaccgagguugacagcggggacggcaaccacauguucgccggucaccugaaaugcaaagugagaauggagaaguugaggauuaagggaauguccuauaccauguguagcggcaaauuuuccauugacaaggaaauggcagagacucaacacgggaccaccgucgugaaggugaaauacgagggagccggggcccccugcaaaguuccgaucgagauucgagauguaaacaaagagaaggugguaggcagaaucaucagcucgacgccccucgcggagaauacgaacagcgucacgaacaucgagcucgagccucccuucggggacuccuauaucgugaucggcgucggcaacagcgcccucacccuucacugguucagaaagggguccagcauuggaaagauguucgaauccaccuaucgcggcgccaaacggauggccaucuuaggcgagaccgcuugggacuucggaagcgucggcggcuuguucaccucccugggaaaagccgugcaccaggucuucggaagcguguacaccaccauguucggcggcguguccuggaugauuaggauacugaucgguuucuugguccuuuggaucgggaccaacagccggaacaccucgauggcaaugaccugcaucgccgugggcgggauaaccuuauuccugggguucacuguccaagcagacauggguugcgugguaucguggagcggaaaggagcucaaguguggguccggaauuuucguggucgacaacgugcacacauggacggagcaguauaaguuccagcccgaaagcccagcccgccuggccucugccauccugaacgcccacaaggauggcgugugcgggauacggagcacuacccgccucgagaacgucauguggaagcaaaucacgaaugagcuaaacuacgugcugugggagggagggcaugacuugaccguaguagcuggagacgugaaaggcgugcuuacuaagggaaagcgggcucucacgccucccgucucagacuugaaauauaguuggaagacguggggcaaagccaagaucuucacccccgaagcacgcaauagcacguuccugaucgacgggcccgacacgucugaguguccuaacgagagacgugcguggaacucccucgagguggaggacuacggguucgggauguucacgacaaacauauggaugaaguuccgcgagggcucuuccgagguuugugaccaucggcucaugagcgccgcaaucaaggaccagaaggcgguccaugccgacaugggcuacuggauugagucuagcaagaaccagaccuggcagaucgagaaggcuucgcuaaucgaaguaaagaccugccuguggcccaaaacacacacccucuggagcaacggggugcuggagucgcagaugcugauccccaagaguuacgcggggccguucucccagcauaauuaccgucagggguacgccacacaaacggucggacccuggcacuuaggaaagcuggagaucgacuucggcgaguguccgggcacaacggugaccauacaggaggauugcgaccaucgcgggccgucccucaggaccaccaccgcuucugggaagcucgugacccaguggugcugccgcagcugcacuaugccgccccugagguucuugggggaagauggcugcugguacgguauggaaauccggcccuuauccgaaaaggaggagaauauggucaagagucaggugacugccgggcaaggaacuuccgagacguucuccauggggcugcugugcuuaacacuguucgucgaggagugccugcggcggcgcgugacccggaagcacaugauccucguugucgugaucacguugugcgcgauuauacuaggcgggcucaccuggauggaccuguugcgcgcgcuaauaaugcuuggcgacaccaugagcggccggauaggcggccagauccaccucgccaucauggccguuuucaagaugucuccaggcuacguccuuggcguguuucuucgcaaguuaaccagccgugaaacugcgcucauggugaucgggauggccaugaccacgguacugucuaucccgcacgaccugauggagcucaucgauggcaucagccugggucugauccuccuuaagauugugacacaguuugacaacacucaaguggggacucuagcguugucccugacauucauccgcagcaccaugccccuaguuauggcguggcggacaaucauggccguccuauucguugugacccucaucccccugugucggaccucuugccuccaaaagcagagucauuggguggagaucaccgcccugauucuuggcgcgcaggcucuaccuguguauuugaugacacugaugaagggggcgucacggcgcagcuggccccucaaugaaggcauaauggccguagggcuugugucucugcuaggcagugcccugcugaagaaugacguuccccucgcgggcccuauggucgccgguggccugcuccuagcagccuaugucaugagcggauccuccgcugaccuaagccuagagaaggcugccaacgugcagugggacgaaauggccgacaucaccggcagcucccccaucaucgagguaaaacaggacgaggacggguccuucuccauccgggacgucgaagagaccaacaugaucacccucuuggugaagcuggcccuuauuacggucagcggccuguacccucuugcuauuccggugaccaugacccugugguacauguggcaagugaagacucagcgcucuggcgcgcugugggacgugccgagccccgcggccacgcagaaggccgcgcuguccgaggguguauaccggaucaugcaacgaggccuauucgggaaaacccaggugggcgucgggauccauauggagggcguuuuccauaccauguggcauguuacucggggaagcgucauuugccacgaaaccgggcggcuggaaccauccugggcggacguacggaaugacaugaucuccuacggggggggcuggcgccuaggcgacaagugggacaaagaggaggacgugcagguccuagccauugagcccggaaagaaucccaagcauguucagacgaagcccggccuauucaagacacugaccggggagaucggcgcugugacccuggacuucaagccggggacuucgggaagcccaaucaucaaccgcaagggaaaggucauaggauuauacgguaacgguguggugaccaaguccggcgacuacgucucggccauuacccaagccgagcguaucggagagcccgacuacgagguggacgaagauaucuuccgcaagaagcggcucaccaucauggaucuccauccgggcgcgggcaagacgaagcgcauccugcccucaaucguaagagaggccuuaaaacggcggcugcguacccucauucuugcccccacucguguggucgccgcggagauggaagaggcccugcguggacuaccuauccguuaucagaccccggccgucaaaucugagcauacaggccgcgagauugucgaccugaugugccacgccaccuucaccacgcgguugcucagcuccacgagagugccuaacuacaaccugauugucauggacgaggcgcauuucaccgauccgagcuccguggccgcccguggcuacaucagcacccgcgucgagaugggggaggcugccgccaucuucaugacggcuacaccaccgggcgccaccgacccguucccccagucaaacagccccaucgaagacaucgagcgggaaauuccggaacgcuccuggaacacuggcuuugacuggaucacagacuaucagggcaagacggucugguucgugccaagcaucaaagcggguaacgacaucgccaauugccugcgaaaguccggcaagaaagucauacagcucagucgcaaaacuuuugacaccgaguacccaaagacuaaacugacggacugggacuucgucguaacgaccgacaucuccgagaugggggccaacuuccgcgcgggccgggugaucgacccccgccggugccuaaagccaguaauccucacggaugggcccgaacgcguuauccuggccggccccauccccgugacgccggccuccgcugcgcagaggagaggcagaauaggucgcaaccccgcccaagaggacgaccaguacguguucuccggggacccacuaaagaacgacgaggaccacgcccauuggaccgaggccaagaugcucuuagacaauauuuacaccccggaggggaucaucccgacucuuuucggacccgagcgggagaaaacgcaggccauugauggagaguuccgccuccggggggaacagagaaagaccuucguagagcugaugcggcgcggcgacuugccugugugguugagcuacaaggucgcuagugccgggaucagcuacaaggacagggagugguguuucacaggcgagcgaaauaaucagauccuggaggagaacauggagguggagaucuggacccgggaaggggagaagaagaaacugcgcccccgguggcucgacgcccgcguguaugccgacccgauggcgcuuaaggacuucaaagaguucgcgucggggcguaaauccaucacacuggauauccuuaccgagaucgcaagucuucccaccuacuuaagcaguagagccaagcucgccuuggacaacaucgucauguugcacaccaccgaaaggggcgggcgggccuaccaacacgcgcuuaacgaacugcccgaaucacuggagacgcucauguugguggcccuucuuggcgccaugaccgcaggcaucuuccucuucuucaugcaagggaagggaauuggaaagcugagcaugggccugaucaccaucgcgguggcuagcggccuucugugggucgccgagauucagccgcaauggaucgccgccaguaucauucuagaguucuuucugauggucuugcucauccccgagcccgagaagcaacgcacgccccaagacaaccagcugaucuacgugauccugacgauacucaccaucauaggccugauugcggcuaacgagaugggccugauagagaaaacgaagacugauuucggguucuaccaggucaagacagagaccacuauccuugauguggaccucaggccagccucugccuggacacuguaugcagucgcgacgacgauccucacccccaugcuccgccacaccaucgaaaauacgucagccaacuuaucacucgccgccaucgccaaccaggcugccguucugauggggcugggcaagggguggccccugcaccggauggaccuaggggugccccugcucgcgaugggcugcuacucucaggugaacccgaccacacucaccgccucccugguaaugcuccuugugcacuacgcgauaaucgggcccggccugcaagcgaaggccacacgugaggcccagaaacggacugcggcgggcauaaugaagaacccaacaguggacgggaucacagugauagaucucgaacccaucucauaugacccgaaauucgagaaacagcuuggccagguaauguuacucguguuaugcgccgggcagcugcuccugaugcgcacgaccugggcauuuugcgaggugcugacccucgcgacuggcccuauccugacguuaugggaggguaaccccggcagguuuuggaacacaaccaucgcaguguccacagcuaacaucuuccggggcuccuacuuagccggggcgggccuggccuuuucccucaucaagaaugcacagacaccccgacgcggcaccggcacgacaggggagacgcucggugagaaguggaagagacagcugaacagucuggaccgcaaagaguucgaggaauacaaacgcuccggcauccucgagguggaccgcacggaggccaagucugcccugaaggacgggucuaaaauuaagcacgccgucucucggggcagcagcaagauccgauggauaguagagcgggggaugguaaagccuaagggcaaggucgucgaccuggguugcggccgcggcgggugguccuacuacauggccacacuuaagaacguaaccgaggucaagggcuauacgaagggugggcccgggcaugaggagcccauccccauggccacauacggguggaacuuggugaagcugcauaguggaguggaugucuucuauaagccuaccgagcaagucgauacacuucugugcgacaucggagagagcuccucuaaccccacaauagaggaaggacgcacgcugcgggugcucaagauggucgagccaugguuaaguagcaagcccgaguucugcaucaaagugcuaaacccguacaugcccaccguaaucgaggagcucgagaaacuccagcgcaagcaugggggcaacuuaguccgguguccccugagucgcaacucaacacacgaaauguacuggguguccggcgcgagcgggaauaucguuuccagcgugaacaccacauccaagaugcuccucaacagauuuaccacccgccaccgaaagccgaccuacgaaaaggauguggaucugggcgcagggacgcgcucugucuccaccgaaaccgagaagccugauaugaccaucaucggccgacgacuccagaggcugcaggaagagcacaaggagacauggcacuacgaccaggagaacccauaccgcaccugggcauaccacgggagcuaugaggcaccuuccaccggcagcgcuucuagcaugguaaacggcgucgugaagcuccucaccaaacccugggacgugauuccuauggugacccaauuggcaaugaccgacaccaccccauucggccagcagcgaguguucaaggagaaggucgacacaaggacgccccagccgaagccagguacccggauggugaugaccacgacagccaacuggcugugggcccuccuggggaagaaaaagaacccccgccucugcacccgcgaggaguucaucagcaagguccgcuccaacgcggcgaucggcgccguuuuucaggaggagcagggguggaccucagccuccgaggcuguaaaugacucccgcuucugggaguuaguggauaaggaacgcgcacugcaucaggaaggcaagugcgagucgugcguguauaacaugauggggaagcgagagaagaagcugggggaguucggacgcgcgaaggggagccgcgccauuugguacaugugguugggcgcgcgguuccuggaauucgaggcccuuggguuucucaacgaggaccacugguuuggccgcgagaacucauggagcggcguagagggggagggacugcaucgguugggguauauccucgaagagaucgacaaaaaggacggcgacuuaauguacgcugaugauacggcgggaugggacacccgaaucacagaggacgaccugcagaacgaagagcuuaucacagaacagauggcuccccaucacaagauccuggccaaagcgaucuucaagcugacguaucaaaacaagguggugaagguguugaggccgacgccccgcggcgccgucauggacaucauaucccggaaggaccagcggggaagcggucaggugggaacguacggguugaacaccuucaccaauauggaggugcagcugauucggcagauggaggccgagggcgucaucacccaggacgacaugcagaaccccaaaggccucaaggagcgaguagagaaauggcugaaggagugugggguagaccggcucaagcgaauggccaucuccggagacgacugcgucguaaagccucuagaugagagguucggaacgagccugcuuuuccuaaaugacaugggcaagguccggaaagauaucccgcagugggagccuuccaaaggcuggaagaacuggcaggagguccccuucugcagccaucacuuccauaaaaucuuuaugaaagauggccggucccucguggugcccugccgcaaccaggacgagcugauaggccgggcccggaucagccagggggccgguuggucccuccgggagaccgcgugccuugguaaggccuacgcacaaauguggagccucauguacuuccaccgcagggaccuacgccuugccucgauggcaauauguucggcggucccaaccgaaugguuccccacgagccgcacuacguggucgauccacgcccaucaccaauggaugacgacggaagacaugcugaagguauggaacagaguuuggaucgaggacaaucccaacaugaccgacaaaacccccguccacagcugggaggacaucccguacuuaggcaagcgcgaagaccuguggugcggcucccugaucggacucucaucaagagccaccugggcaaaaaacauccacacggccaucacccaggugagaaaucugaucgguaaggaagaguaugucgacuacaugccggucaugaagcgguacucagcuccuagugagagcgagggggugcuauag

SEQ ID NO: 26306 - RNA, 9867 nt, Artificial Sequence
  derived and/or modified CDS sequence (opt11) from DENV-4__JQ915090__SS-prME
agcacuaugacccucuuaugcuuaauucccaccgugauggcauuccacuuguccacacgcgacggagagccgcuaaugaucguggccaaacaugagcgggggcgucccuugcuguuuaagaccaccgagggcaucaacaagugcacccucauagccauggaccugggggagaugugcgaggacaccguuaccuacaaaugccccuuguuggugaacaccgagcccgaggacauugacugcugguguaaccugaccucaaccuggguaauguacgggaccuguacccaguccggggagcggcgccgggaaaaacgcagcguagcccugaccccgcacucaggcaugggcuuggaaacucgugccgagaccuggaugaguuccgagggggccuggaagcacgcacaacgaguggagagcuggauccugcggaaccccggauucgcgcugcucgccggguucauggccuauaugauuggccagaccgggauccagcgcauugucuucuucgugcugaugaugcugguugccccuuccuacggcaugcguuguguaggcguggggaaucgcgacuucguggagggcgucagcgggggcgcguggguggaccuggugcuggaacacggugggugcgucaccacgauggcucagggcaaaccaacccuggacuucgagcucgcuaagacuacggccaaagagguggcccugcucagaaccuacugcaucgaggcguccaucucgaacauaaccaccgcgacaaggugcccaacacagggggagccguaccucaaggaagagcaggaccagcaguacaucugccggcgagacgucguugaccggggcugggggaacggcugcggucuguucgggaaaggagggguugugacaugcgccaaguuccugugcucaggcaagauuaccgggaaucuagugcagaucgagaacuuagaguacacggugguggugaccgugcacaacggggauacacacgccgugggcaaugacaccaguaaccacggagucacugcuaccaucaccccccggucccccagcguggagguuaaacugccggacuacggcgagcucacccuugacugcgagccucgcuccgggaucgacuucaacgaaaugauccugaugaagaugaagaagaagacguggcugguacacaagcagugguuucuagaucugccccuccccuggacagcgggcgccgauacuucugagguccacuggaacuauaaggagagaauggucacguucaaggugccacacgcgaagagacaagauguuaccguucugggaucccaggagggcgcgaugcacagcgcccuggcaggagccacagaaguggacagcggggacggaaaccacauguuugcuggccaccucaagugcaaagugcggauggagaagcugaggauuaagggaauguccuacacgaugugcagcgguaaguucaguaucgacaaagagauggccgagacccagcacgggaccacggucgugaaggugaaauaugagggcgcuggggcucccuguaagauaccuaucgaaauacgggacgugaacaaggagaagguggugggccguaucaucagcucuacccccuucgccgagaacaccaauagugucauuaacaucgaacuggagccgcccuucggggacaguuacaucgugauuggcguuggagacucggcccucacucugcauugguuccgaaagggauccagcaucggcaaaauguucgaguccacguaccgcggggccaagcggauggcgauucucggcgagaccgcaugggacuucgguagcgucggcgggcucuucacuucccucggaaaggccgugcaucagguguucggcagcgucuacaccacuauguucggaggcguguccuggaugaucagaauccuaaucggguuccucgugcuguggauaggcaccaacaguagaaacaccucgauggccaugacgugcauagcuguuggcgggaucacacucuuucuaggcuuuacaguccaggcggacauggggugcguuguaaguuggaauggcaaggaguugaagugugggucuggcaucuuuguaguugacaauguacacaccuggaccgagcaguauaaguuccagcccgagagcccagcacgccuagcgucggccauccugaacgcccauaaggacggcguuugcgguauccgguccaccacgcgccucgagaacgugauguggaagcagaucaccaacgaguugaauuacguucugugggagggcgggcacgaccucacugugguggcuggggacgucaaaggcguccugacgaaaggaaagcgggcccugaccccaccugugaacgaccuaaaguacaguuggaaaaccugggguaaggccaaaaucuucaccccggaggcccgcaacuccacguuccugaucgacgggccggacaccagugagugcccaaacgaacggcgcgccuggaauuucuucgagguagaggauuacggcuucgggauguucaccaccaacaucuggaugaaauucagagagggcuccucagaggugugugaccauagacugaugagcgccgccaucaaggaccaaaaggccgugcacgccgacaugggguacuggaucgagagcuccaagaaccagacguggcaaauagagaaggcgucacuaaucgaggugaagacaugccucuggccuaagacacacacccuguggucgaacggcgugcucgagagucagaugcugauuccccgauccuaugcagggccguucagccagcacaacuaccgccagggauaugccacacaaacagccggcccauggcaucuggguaaacucgagaucgacuucggcgaaugccccggcaccacugugaagauccaggaagacugugaccauagggggccgucgcugcgcacaacaacugccagcggcaagcuugucacccaauggugcugccgcuccuguacuaugccaccgcuccgguuccugggggaggacgguuguugguacgggauggagauccggccacugagcgaaaaggaagaaaacauggugaagucccaggugacggcgggccaaggcaccagugagacauucucuaugggucuccugugccuuacccucuucgucgaagagugccugcggaggcgggugacucgcaagcacaugauccuggucguggugaucaccuucugcgccaucauccuuggcgggcugaccuggauggacuugcuccgggcucugauuaugcucggcgacacaaugucaggucgaauagguggucagauccaucucgcaaucaugacggucuucaagaugagcccgggguacguucuaggcgucuuccugaggaagcucaccucccgggagaccgcccugauggucaucgggauggcgaugacuacagucuucagcaucccgcacgaccugauggaguugaucgacgggauuucccugggccucaucuuacugaagaucgugacccacuucgauaacacccagguugggacccuggccuugagccuuacguucaugcggaguaccaccccauugguuauggcguggcggacgaucauggccguguucuucgugauaacucucaucccccugugccggaccagcugccugcagaaacagucccacuggguggagaugaccgcccugauccuaggcgcgcaggcucugccgguguaccucaugacucugaugaagggggccagucgccgguccuggccgcugaacgaggggaucauggcugucggacucgugagccugcugggaucugcgcucuuaaagaacgacgugccucuagccggccccaugguugccgggggccuccugcuggccgccuacguaaugagcgggagcucagcggacuuaucucuggaaaaggccgccaacgugcagugggacgagauggcugauaucacgggaagcagccccauuaucgaagucaagcaagacgaggacggguccuucucaauccgggacguggaggaaaccaacaugaucacacuuuuggugaagcucgcccucaucacggucuccggccucuauccgcuggcgauucccgugacgauggcccuuugguacaucuggcaggugaaaacccagcgguccggagcccucugggauguccccucccccgccgcuacucaaaaggcgacccugagcgaggggguguaccgcaucaugcagagaggauuguuugggaagacccaggugggcguugggauucacauggaaggcguuuuccacaccauguggcacguuacccguggcucugucaucugccacgagaccgggcggcucgagccgagcugggccgaugugcgcucagacaugauaagcuacggcgggggauggcgccugggugacaaaugggauaaggaagaggacguacagguccuggccaucgagcccgguaagaacccccgccacgugcagaccaagcccggucucuucaagacgcugaccggggagaucggcgccgucaccuuggacuucaagccgggaacuuccggcagccccauaauuaacaagaaggguaaggucaucgggcucuauggcaacggggucgucaccaaguccggcgacuacgucagcgccaucacgcaggcugagcguauaggugaacccgauuacgagguggaugaggacaucuuccgcaagaagagguuaaccaucauggaccugcacccgggugccggcaagaccaagcggauccuccccagcauugugagggaagcucugaagcggcgacuccggacgcucauucuggcgccaacacgcguaguugcugcagaaauggaggaggcccuuagggggcugcccauccgguaccagacaccggcgguuaagucugagcauacaggaagagagauugucgaccucaugugccacgccacguucaccacgcgccuucucucaucaacucgcgugcccaacuacaaccucaucgugauggacgaggcgcacuucacggaucccugcucggucgccgccagaggguacaucagcacacgaguggagaugggcgaggcugccgcgaucuucaugaccgccacgccgccuggcucgaucgaucccuucccccaguccaacagccccaucgaggacauagaacgcgagauuccggaacggaguuggaauacgggauucgacuggaucacugacuaccaaggcaagaccgucugguucgugcccucaauuaaggcggggaacgauaucgccaacugccuuaggaagagcggcaagcgcgugauccagcugagccggaaaacuuucgacacggaguacccuaagaccaaguugaccgacugggacuuuguggugacgacggacaucuccgaaaugggggccaacuuccgcgcuggcagagugauugaccccaggcggugucugaagccgguaaucuugaccgacgggcccgagcgcgugauucucgccggucccauacccgugaccccugccagcgccgcgcagcggcgcggucgcaucggucgcaauccagcccaggaggacgaucaauacgucuucucgggggaccccuuaaagaacgacgaagaucacgcccacuggaccgaggcuaagaugcugcucgacaauaucuacacucccgaggggaucaucccgacccuuuucggccccgagcgugagaagacccaggccaucgacggcgaguuccgccugaggggugaacaacgcaagacuuucguggagcuuaugcggcgcggugaccugcccguguggcucucuuauaaggucgcguccgccgguaucagcuacaaggacagggaguggugcuuuaccggugaacggaacaaucaaauccucgaggaaaacauggaaguagagauauggacuagggagggggagaagaagaaguugcgacccaaguggcuggacgcacggguuuacgccgacccgauggccuugaaggacuuuaaagaauucgcgaguggccggaagagcaccacucuggacauccugacagagauagcaacccucccuaccuauuuguccagcaaggcuaaauuagcuuuagacaacauugugaugcuacacaccaccgagaagggcggucgcgccuaccagcaugcguugaaugagcuccccgaaucccuggagacgcugaugcucguggcccugcugggcgccaugacggcggggaucuuccuguuuuucaugcaaggcaagggaauuggcaagcucagcaugggccugaucgcgaucgccguagcuucuggauuacugugggucgccgagauccagccgcaguggauagccgcgagcaucauccucgaguucuuucucauggugcugcucauccccgagcccgagaagcagcgcacgccccaggacaaccagcuaauauacgucaucuugaccauucuaacaaucaucggccugauagccgccaacgagauggggcuuaucgagaagacgaagacggacuucggcuucuaucaggucaagacggagacuaccauacuagacguggaccuccgcccggccucagcuuggacucuguacgcaguagccacgacgauccugaccccuaugcuccggcacaccaucgagaacauguccgccaaccugagccuggccgccauugcaaaccaagccgccguucuuauggggcugggcaaggguuggcccuugcaccguauggaucuaggugucccacugcuggccauggggugcuauucccaagugaacccgaccacgcucaccgccagcuuagucaugcuuuuaauccacuacgccaucaucgggcccggccugcaagcaaaggccacccgggaggcacagaagagaacugcggccggaauuaugaaaaaccccaccguggacgggaucacggugaucgaucuggagcccaucuccuacgacccgaaguucgagaaacagcucggccaggucaugcuacugguccuaugcguggggcaacuauuacucaugcggaccaccugggcccuuugcgaggugcuuacguuagcuaccggccccauaaugaccuugugggaggggaaucccggccgguucuggaacaccacgaucgccgugaguaccgcuaacaucuuuagaggcucuuaccucgcuggugcaggcuuggcauuuagccuuaucaagaacgcccaaacgccccgccgggggacgggcacaaccggcgaaacccugggcgagaaguggaagcgccagcuuaacucccuggaccggaaagaauuugaagaauauaaacgaagcggcauccuggagguggacagaaccgaagcgaaauccgcucuccgcgacggcagcaagaucaagcacgccgucagucguggcagcuccaagauccguuggauagucgagcgggggaugaucaagccuaagggcaagguggucgaccucggcuguggcaggggcgguuggagcuacuacauggccacgcugaagaacgugaccgaggugaagggcuacaccaaaggcggccccgggcacgaggaaccaaucccaauggcuaccuauggcuggaaccucguaaagcugcauuccggcguggacguguucuauaagccuaccgagcagguugacacgcugcucugcgacaucggggagagcuccagcaaccccaccaucgaggagggacgcacguuacggauccuaaagaugguggagccuuggcucagcucuaagccagaguucugcaucaagguucucaacccguacaugcccaccgucauugaggagcuggagaagcuccagcgccggcacgggggcagccuggugcgcugccccuuguccagaaacaguacgcacgaaauguacuggguauccggcgcaagcgggaacauugucuccagcguaaacaccaucuccaagaugcugcuuaaccgcuucacuacccggcacaggaaaccuacguacgagaaggacguggaccugggcgcggggacccggagcguguccacagagaccgagaagcccgacaugacgaucauaggccggagacugcagagacuccaggaggagcacaaagagaccuggcacuacgaccaggagaaccccuaccggaccugggccuaucacgggagcuacgaagcccccuccaccggcucggcguccagcauggugaacggcgucgugaagcugcugacgaagccgugggacgugauccccauggucacccaguuagcgaugaccgacaccacgcccuucggucagcagcgcguguucaaagagaaaguugacacccggacaccccagcccaaacugggcacccgcaugauuaugacgacgaccgccaacuggcugugggcccuucucgggaagaagaaguccccuagacugugcacccgcgaggaguucaucagcaagguccggagcaacgccgcgauuggugcaguguuccaggaggagcagggguggacauccgcgaucgaagccguaaacgacagccgguucugggagcucguggacaaggaacgggcccugcaccaggagggcaagugcgaguccugcguguacaauaugauggguaagcgcgagaagaaguugggugaguucggccgcgcgaaggggucgcgggccaucugguacauguggcucggcgccagguuccuggaguucgaagcuuuaggguuccugaacgaggaccauugguucucacgggagaacagcuggagcggcgucgagggcgaagggcuacaucgcuuaggcuacauccucgaagauauugacaagaaggacggggaccugaucuacgcggacgacacagcggguugggacacucgcaucacugaggaugacuugcucaacgaggagcugaucacggaacagauggccccgcaccauaagacccuggccaaagccaucuucaaacucacguaccagaacaagguggugaagguccugagaccuacucccaagggcgcggucauggacaucauauccaggaaggaccagcgcggcuccggucagguggguacguacggccugaacacauucaccaacauggaaguccaacuaauccgccagauggaggccgagggagucaucacacaggacgacaugcaaaaccccaagggccucaaggagagaguggagaaguggcugaaggaauguggcguugaccgucucaagcgcauggcgaucucaggggacgacugugucgugaagccccuugacgagcgguuuuccaccagccugcuguuccugaaugacaugggcaaggugcgcaaggacgucccgcagugggagccauccaagggguggaagaacuggcaagagguccccuucugcagccaccacuuccauaagauuuuuaugaaagacggcagaucccugguggucccaugccgcaaccaggacgagcuaaucgggcgggcgcggaucagccagggcgcuggcuggucccugcgagaaacggcaugccuggggaaggccuaugcccagauguggagccucauguacuuucaccgccgagaccuccggcuggccuccauggccaucuguagcgcggugccuaccgagugguucccgaccagccggacaacgugguccauccacgcccaacaucaauggaugaccaccgaggacaugcucaagguuuggaaucggguauggauugaggacaacccuaacaugaccgauaagacgcccguucacagcugggaggacauuccuuaucugggcaagcgcgaggaccuguggugcgggucguugauaggccugaguagcagagccacuugggccaagaacauccacacugcuauuacccaggugcgcaaccugaucgggaaggaagaauaugucgacuacaugccggugaugaagcguuauagcuccccuagcgaguccgagggcgugcucuga

SEQ ID NO: 26307 - RNA, 9867 nt, Artificial Sequence
  derived and/or modified CDS sequence (opt11) from DENV-4__KJ160504__SS-prME
ucuaccaucacauuacucugccugauucccacugugauggcauuccaccuguccacucgugauggcgagccgcucaugauaguggcuaagcacgaacgggggcgaccccuuuuauucaagacgaccgaaggcaucaauaaauguacgcucauagccauggacuuaggggagaugugugaggacaccgucacuuacaagugucccuuacugguuaacacugaacccgaggacaucgacugcuggugcaacuugacaagcaccugggugauguacgggaccugcacccaguccggcgagagaaggcgggagaagcgcagcguugcccucacgccccauagcggcaugggccucgagacccgggccgagacguggaugagcagugagggggccuggaagcacgcccagagaguggagagcuggauacuucgcaaucccggguucgcgcugcuagccggguucauggccuacaugaucgggcaaaccgggauucagcgcacagucuucuucgugcugaugaugcugguggcgcccuccuacgggaugcguugcgucggcguagggaaccgcgacuucguagagggcgucagcgggggcgcguggguggaccucguguuggagcauggcgggugcgucacuaccauggcccagggaaagccuacccuggacuuugagcucacuaaaacgacagcgaaggagguugcccugcuucggaccuauugcauugaggccucuaucucuaacaucacgaccgcuacccggugcccgacccagggggagcccuaccucaaagaggagcaggaccaacaguacauuugccgucgcgacguggucgaccgagggugggggaacggcugcggucuguucgggaagggcgggguggugacgugcgccaaguucuccugcucugguaagauaaccggaaacuugguccagauugagaaccucgaauacaccgugguagugaccgugcacaacggggacacgcacgcagucgguaaugauacauccaaccauggggugaccgccacuaucacgcccagaagccccuccguggagguuaaauugcccgacuacggugagcuaacguuggauugcgaaccccggaguggaauagauuucaacgagaugauccuaaugaagaugaaaaagaagaccuggcuagugcauaagcagugguuccucgaccugccucugccuuggacugccggggcggacacaagcgaggugcacuggaacuacaaggaacgcauggucacuuuuaaggugccacacgcaaagaggcaggacgugaccguucucgggagccaggagggcgccaugcacagcgcacuggccggagcgaccgagguggacuccggggacggcaaucacauguucgcggggcaccuuaaauguaaggugcgcauggaaaagcugcgcauaaagggcaugagcuacacgaugugcuccggcaaguucagcaucgacaaggagauggccgagacccagcaugggacaacggucguaaaggugaaguacgagggcgccggagcgcccuguaaaguccccaucgagauccgggauguaaacaaggagaagguagucgggcgcgucaucagcuccaccccccuugcggagaacacgaacucugugacuaacaucgagcuggagccacccuucggcgacagcuacaucgucaucggcguaggcaacuccgccuuaacccugcacugguuccggaaggggagcuccaucggcaagauguucgaaagcacuuacaggggggccaaaaggauggccaucuugggagagacggccugggacuuuggcuccgugggcggccucuucacgagcuuaggaaaggcaguucaccaaguuuucgggucggucuacaccaccauguucgguggcgucucguggaugaucagaauccugaucggguuccucgugcuguggaucgggacgaacucccggaauaccucaauggccaugaccugcaucgcugugggagggauuacacuguuucugggguucacgguccaggcagacaugggaugugugguguccuggucugggcgggaguuaaagugcgggagcgggauuuucgucguggacaacgugcauaccuggaccgagcaguacaaguuccagcccgagucccccgcgcgacuggccagcgccauucugaacgcccacaaggacggcgucugcgggauacguuccaccaccagauuagaaaacgugauguggaagcagaucaccaaugagcugaacuacguccugugggagggugggcacgacuugaccgugguggccggugacgugaagggggucuuaaccaaggggaagcgcgcucugacgccgcccgucagcgaccugaaguauaguuggaagacguggggcaaggcaaagauuuucacccccgaggcccgaaacagcaccuuccucauagacgggcccgacacguccgagugcccgaacgagcgacgggcauggaacagccuagaaguugaagauuacggcuuugggauguucaccaccaauaucuggaugaaguuccgagaaggcagcagugaggucugcgaucaccgcuuaauguccgccgcgaucaaggaucaaaaggcgguacacgccgacaugggcuacuggaucgagaguucuaagaaccagacguggcaaaucgagaaggcaucgcugauagaggugaaaacgugucuauggcccaaaacgcauacccuuugguccaaugggguacuggagagccagauguugauuccaaaguccuacgcagggccguucagccagcauaacuaccgccaaggauacgccacucaaaccguaggccccuggcacuugggcaaacuagaaaucgacuucggcgaaugccccggcacgacggugacaauacaggaggacugcgaccaccgagggcccagcuugcgcaccacgacugccagcggcaaacucgucacccaauggugcugcagaucuugcaccaugccgcccuugcgguucuuaggggaagacggcugcugguacgguauggagauccgcccccugucugaaaaagaggagaauauggucaagagccaagucaccgcgggccagggcacguccgaaacuuuuuccaugggccuguuaugucucacccuguucguggaggagugucugagacgcagaguuacgcguaagcacaugauccucgucguggugauuacgcugugcgcuauaauacugggcggacuaaccuggauggaccugcugcgagcguuaauuauguugggcgacaccaugagcggccgcaucgguggacagauacaccuggccaucauggccgucuucaagaugagccccggguacguacucggcguguuucugcggaaacugacgucccgcgagacagcccuuaugguaaucggcauggccaugaccacggugcugagcaucccgcacgaccugauggaguugaucgauggcaucucccugggccugauccugcugaaaaucguuacgcaguucgauaacacccaggucgggacccucgcgcucagccugacuuucauacgguccacuaugcccuuagugauggccuggcgcaccauaauggccguauuauucgucgugacauugaucccgcucugccggacguccugucuccagaagcagucccacuggguugaaaucacggcccuaauccugggcgcccaggcgcucccuguauaccugaugacccucaugaagggggcuagcagacggaguuggccacucaacgagggcaucauggccguuggccuaguaaguuuacucggcuccgcacugcugaaaaacgaugucccccucgcaggccccaugguggccggcggccugcuucucgccgccuacguaaugaguggcagcucggccgaccugagccuggagaaagccgccaaugugcagugggacgagauggccgacaucacaggauccagucccaucaucgaagugaagcaggacgaggacggguccuucagcauccgugauguggaggagacuaacaugauaacgcucuuggugaaguuggcccucaucacugugucaggucuguacccccuggccauccccaucacaaugacccuuugguacauguggcaggugaagacacagcggagcggcgcauugugggauguuccuuccccugccgccacccagaaagccgcccuuucagaggggguguaccgaauaaugcagagaggccucuucgggaaaacccaagugggcgucggaauacacauggagggcguauuccacacaauguggcacguaacccgcggcuccgucauuugccacgagacggggcggcucgagccgucuugggcggacgugcgaaacgacaugaucuccuacggagggggcuggcgcuugggagacaagugggacaaagaagaggacgugcaggugcuugcuauugagcccgggaagaauccgaagcacguucaaacuaagcccggccuuuuuaagacccugacuggagagauaggagccgugacucuagacuucaagccggguaccucgggcagccccaucaucaaccgcaaggguaagguuaucgggcuguacggcaacggaguggugaccaagagcggcgauuaugugucugccaucacgcaggcggagcgcauuggggagcccgauuaugagguggacgaggacaucuuccggaaaaagcgccuaacgauaauggaccuccacccgggcgccggcaagacuaagcggauccugccaaguaucgugcgcgaggcccugaagaggcguuugcggacacucauccuggcacccacccgcgucguggccgcggagauggaggaggcccugaggggguuacccauccgcuaccagacgccggcggugaagucagagcauacaggccgcgagaucgucgaccugaugugucaugccaccuucaccacgcgccugcucuccucgacgcggguacccaacuacaaucuuaucgucauggacgaggcccacuucacagaccccuccagcguagcggcacgcggguacauauccacuagaguggagaugggagaggccgcugcgaucuuuaugaccgcgacacccccgggcgccaccgaucccuuuccccagucuaacucccccauugaagacaucgaacgcgagauaccggaacggagcuggaacaccggauucgacuggauuaccgacuaccagggcaagacagucugguucgugcccuccauuaaggccgggaacgacaucgccaacugccugcgaaagagcggaaagaaagugauacagcucagccgcaagacuuucgggacggaauauccaaagacgaagcugaccgacugggacuucgucguuaccacagacauuagcgagaugggcgccaacuuccgggcaggacgugugauagacccccggcgcugcuuaaagcccgucauccugacggacggcccagagcgggugauccuggcaggcccgauccccgugaccccagccuccgccgcgcagcgcagagggcgcgucggccgaaacccugcucaggaggacgaucaguaugucuucagcggggacccccugaagaacgacgaagaccaugcccacuggaccgaagccaaaaugcuccuugacaacauauacacgcccgaggguaucaucccgacgcuuuucggccccgagcgcgaaaagacccaggccaucgauggagaguuucgucuccgcggagagcagcggaagaccuucguggaguuaaugcgccggggagauuugcccguauggcucuccuacaagguagcgagcgccggaauauccuacaaggaccgcgaguggugcuucaccggcgagcggaauaaucagaucuuagaggagaacauggagguggagaucuggacgagagaaggugagaagaagaagcugcggccucgcuggcuugaugccagaguuuacgcugacccgauggcccuaaaggacuucaaggaguucgcgagcggucgcaagagcauaacccuggauauccucaccgagauugcgucacugccugccuaccuguccagucgcgccaagcucgcgcuggacaacaucgugaugcugcacaccaccgaacgggggggccgcgcguaccagcacgcccucaacgaguugcccgagagccuggagacgcucaugcugguggcccuacucggugcaaugaccgcgggcaucuuccuguucuucaugcaggguaaggguaucggcaagcugucgauggggcucauaaccaucgccgucgccagcggauuauuauggaucgcagagauccagccgcaguggaucgccgcuagcaucauccucgaguucuuucugauggugcugcucauccccgaaccugagaagcagcggaccccccaggauaaccagcucaucuacgugauccuaacggugcucaccauuaucgggcugauugccgccaaugaaaugggccugauagaaaagaccaagaccgacuucggguuuuaucaggugaagacggagaccacuauuuuagacguugaccugcgaccugcguccgccuggacccuguacgcaguugccacgacgguacucacccccaugcugagacacaccauagagaacacaucagccaaccugagccuugcagcuaucgcgaaucaagcugccgugcugaugggccugggcaaggguuggccccuucaccgcauggaccugggcgucccccugcucgcgaugggauguuauucccagguaaauccuaccacgcugaccgcuucacuggugaugcucuucguccacuaugccauuaucggacccggccugcaggccaaagccacgagagaagcucagaagcgcacugcagccgggaucaugaagaaccccacaguggaugguaucacugugaucgaccuggagccuauuuccuacgacccgaaguuugagaaacagcucggccaagucaugcugcuuguccucugcgcuggccagcugcugcucaugcggacgaccugggccuuuugcgaggugcugacgcuggcaacagggcccauauugacucugugggaaggcaaccccggacguuucuggaacaccaccaucgcggucuccaccgccaacaucuuuagagggucauaucuggcgggcgcaggguuggccuuuagcuugaucaaaaaugcgcagacgccucgcaggggcaccggcaccacaggcgagacgcuuggagaaaaguggaagcgccaguugaacucccuggaccggaaggaguuugaggaauacaagcgcagcgggauccuagagguugacaggaccgaagcuaaguccgcccucaaagauggcagcaagaucaagcacgccgugagucgcgggagcucaaagauuagauggauagucgagaggggaauggugaagccgaaggggaaggucgucgaccugggcugcggaagggggggcuggagcuacuacauggccacccucaagaaugugacggagguaaagggguauacaaagggagggcccggucacgaggagcccauacccauggcgacguacggcuggaaccucgucaagcuucauucggggguggaugucuucuacaagccgacggagcaggucgacacacuucucugcgauaucggcgaguccucguccaaccccaccaucgaggaggggcgaacacuacgcgugcugaagauggucgaaccaugguuguccuccaagcccgaguucugcaucaagguucugaacccguacaugccgaccgucaucgaagagcuggaaaagcugcagcggaagcauggugggaaccuugucaggugcccccugucucgaaacucuacacaugagauguacugggugagcggugccucgggcaauaucgugaguuccgucaacacaaccagcaagaugcugcucaaccgauuuacgacacggcaccguaagcccaccuaugagaaggacguggauuuaggggccggcacucgguccgugucgaccgaaaccgagaagccggacaugaccaucaucgggcgccggcugcagcgccuccaggaggaacacaaagagacguggcacuacgaucaggaaaacccauaccguaccugggcuuaccauggcucuuaugaagcaccaagcaccggcuccgccucuucuaugguaaacgguguggugaagcugcugaccaagccgugggaugucauacccauggugacgcagcucgcuaugaccgauacaaccccauuuggccagcagcgcguauucaaggagaaggucgauacacggacgccucagccgaagcccgggacccgcauggugaugaccacgacagccaacuggcugugggcucuguugggcaagaagaagaacccacgccuguguacccgggaagaguuuaucagcaaagugcgcagcaacgcagcgauaggggccgucuuccaagaggagcagggcuggacaagugcuucggaagcugugaacgacucacgcuucugggaauuaguggacaaagagagggcgcuccaucaggaagguaagugcgagucuuguguuuauaacaugaugggaaagcgcgagaagaaauuaggcgaguucggacgcgcgaagggcagccgggcgaucugguacauguggcugggggccagauuucuagaguucgaagcccuggguuuccuuaaugaagaccauugguucggucgggagaacucuugguccggggucgagggugaggggcuccacagacuuggcuauauucuggaggagaucgauaaaaaggauggggaccucauguacgcggacgacacagcagggugggacacacggaucaccgaggacgaccugcagaaugaggaguugaucaccgagcagauggccccccaccacaagauucucgccaaagcgauauucaagcugacguaccagaauaagguugucaagguguugaggccgaccccccgaggggccgucauggacaucauuagucgcaaagaccagcggggguccggccagguagggacguacgggcucaauaccuuuacgaacauggaagugcagcuaauccggcagauggaggccgagggcgugaucacacaggaugacaugcagaacccuaaggggcugaaggaaagaguugaaaaguggcuccgcgaguguggcguggaucggcucaaacgcauggccaucagcggugacgauugcguggugaaaccgcucgacgagcgguucgguaccucccuccuguuuuugaacgacauggggaaggugcgaaaggauaucccccagugggagcccucuaaaggcuggaagaacuggcaggaggucccuuucugcucccaucacuuccacaagaucuucaugaaggacgggcggucauugguggugcccugccgcaaccaggacgagcugaucgggcgggcccgcaucucccagggcgcaggguggagucugcgcgagacggcaugcuugggcaaggcauaugcgcagaugugguccuugauguacuuucaccggcgcgaucuacggcuagccuccauggcgaucugcucggcagugccgacugagugguuccccaccucccgcacgaccuggucaauacaugcccaccaccaguggaugaccacggaggauaugcuaaaggucuggaacagaguguggauagaagacaaucccaacaugacagacaagacuccugugcacaguugggaggauauccccuaccuggggaaacgagaggaccucugguguggcagccuuaucggccuguccucacgggccacgugggcuaaaaauauucacacggcuaucacccaaguccgcaaccucaucgggaaggaggaauauguggacuacaugcccgugaugaaacgguauucagccccuagcgaguccgagggcguauuguga

SEQ ID NO: 26308 - RNA, 9867 nt, Artificial Sequence
  derived and/or modified CDS sequence (opt11) from DENV-4__GU289913__SS-prME
agcaccaucacccugcugugucugauucccaccguaauggccuuccaccuguccacgcgggacggggagccccucaugauaguggccaagcacgagcgggggcgcccccuucuguucaagaccacagaaggcaucaacaagugcaccuugaucgcgauggaccugggggagaugugugaggacaccgugaccuacaaaugcccccugcuugugaauaccgagcccgaagacaucgacugcuggugcaaccugaccagcacgugggucauguacgggaccuguacccaguccggcgagcgucgccgggagaagaggucuguggcacugaccccgcacuccggaaugggccucgagacccgugccgaaaccuggaugagcuccgagggggcguggaagcacgcccagcgcgucgagucuuggauccugcggaaccccggcuuugcgcugcucgccgguuucauggccuacaugaucggccagaccgggauccaaaggacgguguucuucgugcugaugauguugguugcucccuccuacgggaugcggugcgucggcguuggcaaucgcgauuucguggagggagucagcgggggcgcguggguggaccuugugcuggagcacggcgggugcgucaccaccauggcgcaaggaaagcccacccuggauuucgaacucacgaagaccacggccaaggagguugcgcugcuccggacguacugcauugaggcguccaucuccaacauaacgacugcgacgcguugcccaacccaaggggagcccuacuugaaagaggagcaggaccagcaguacauuugccggcgugacguggucgaccggggcugggggaacggcugcggccucuucggaaagggaggaguggucacgugcgcaaaguucuccuguaguggcaagaucacggggaacuuaguccagaucgaaaaccucgaauacacaguaguggucaccgugcacaacggcgacacacacgccguaggcaacgacacgucaaaccacggggugaccgccaugaucacgccaagaagcccuuccguggaggucaagcugccggacuacggcgaacugacgcucgacugcgagccccgguccgggauugacuucaacgaaaugauccugaugaagaugaagaagaaaacauggcuuguacacaagcaaugguuccuugaccugcccuugcccuggacugccggcgcggacacauccgaggugcacuggaacuauaaagaacguaugguaacuuuuaaagucccacaugcuaaacggcaggacgugacagucuuagggagucaggagggugccaugcacagcgcgcuugcuggcgccaccgagguggauucgggugacggcaaccacauguucgcgggacaucugaagugcaagguaaggauggagaaguuacgcaucaagggcaugagcuacaccaugugcucuggcaaguucucgaucgauaaagagauggccgaaacccagcaugggacgaccgucgugaaagugaaguacgagggggccggggccccaugcaagguucccaucgaaaucagagacgugaacaaggagaagguggugggccgcaucaucuccucaacgccccuggcugagaacacuaauuccgugacaaacaucgagcuggagccgccuuucggggauaguuauauugugaucggcgugggcaacuccgcccucacccugcacugguuccggaaggggagcuccaucggcaagauguucgagagcaccuaucgcggggccaagcggauggcgauccugggcgagacggcgugggacuucgggucggugggcggcuuauuuacgagcuugggcaaagcaguccaucaaguuuucggcaguguguacacuaccauguucggaggcgugaguuggaugauccgcauccugaucggguucuuaguccuguggaucgguacaaacucgcggaacacgagcauggcaaugaccugcaucgcugugggcgggauuacccuguuccuaggcuucacugugcaagccgacauggggugcgucguguccuggaguggcaaggaacucaagugcgggagcggcauauucgucgucgacaacguucacacguggaccgagcaauauaaguuccagcccgaaucccccgcgcgccuggccagcgccaucuugaacgcccacaaagacggcgugugcgggauucgguccaccaccaggcucgaaaacgucauguggaagcagaucacuaacgagcugaacuauguucugugggaaggugggcaugaccucacaguagucgcgggcgacgugaaaggcgugcugaccaagggcaagcgagcgcugaccccgcccgucagcgaccucaaauacuccuggaagaccuggggcaaggccaagauuuucacccccgaggcgagaaacucuaccuucuugaucgacgggccugacacaagcgagugcccgaacgagcggcgcgcauggaacagccuggaaguggaggacuacggcuucgggauguucacgaccaacaucuggaugaaguuucgggagggcaguucugaaguuugcgaccaccgccucauguccgcagcgaucaaggaccagaaggcgguccacgccgacauggguuacuggaucgaaagcagcaagaaccagaccuggcaaaucgaaaaggccagccugauagaggugaaaaccugucuguggcccaagacgcacacccucugguccaacggggugcuggagucgcaaaugcugauucccaaguccuacgcgggcccguuuagccagcacaauuaccgccaaggguacgcuacccagaccgucggccccuggcaccucgggaaguuggaaaucgacuuuggcgagugcccuggcaccacggugaccauccaggaggauugcgaccaccgcgggcccucacuucggacaacuaccgccuccggcaagcuugugacccaguggugcugccggaguugcacaaugccgccauugagguuccugggggaggacggcuguugguacgggauggaaaucagaccuuuauccgagaaagaggagaacauggucaaaucacagguuaccgccggccagggcacguccgaaaccuucagcaugggguuguugugccucacccuguucgucgaggaaugccugcgccggcgcgugacacgaaagcacaugauccugguggucgugaucacucugugcgcaaucauccugggcgggcucacuuggauggaccugcuccgcgcgcucaucaugcugggcgacacgauguccggccggaucgguggccaaauccaccuggccaucauggcagucuucaaaaugagccccggguauguccucggcguguucuuacgcaaacugacgucccgugagacagcccuuauggugaucgggauggcgaugaccaccguccugagcauaccgcacgaccugauggagcucaucgacggcaucucccugggccugauccuccuuaagaucgugacccaauuugacaacacccagguggggacccucgcgcucagccugacguucauccgcuccaccaugccccuggucauggccuggcggacgaucauggccguccucuuuguugucacgcugaucccccuaugccgcaccagcugccuccagaagcagucccacuggguggagauuaccgcccugauacucggcgcucaagcgcuacccguguaucugaugacgcugaugaaaggggcaagccgucgcuccuggccgcuuaacgagggcaucauggcagucgggcuggugagccugcucgggagcgcccuccuaaagaaugacguaccccuggcgggcccaauggucgccgggggccugcugcuagcugccuacgugaugagcgguagcucagccgacuuaagccuggagaaggcggcuaaugugcagugggacgagauggccgauauaacaggcuccagcccgaucaucgaggugaagcaagacgaagacggguccuucuccauccgggacguggaagaaacgaacaugaucacgcuccugguaaagcuggcacucauuacagucucaggccuguacccgcuagccauccccgucaccaugaccuuaugguauauguggcaggucaagacucagagaagcggcgcgcuuugggacguccccucaccagcugcuacccagaaggccgcccugucagaggggguguauaggauuaugcaaagaggccuuuucgggaagacccaggugggcgucgggauccacauggagggcguguuccauacaauguggcacgugacccgcggcucggucaucugccacgagaccgggcgcuuagagccuagcugggccgacgugcggaacgacaugaucuccuacggcgggggguggcggcugggcgacaagugggacaaggaggaggacguucagguacucgccauugagccugggaagaaccccaaacacgugcagacgaagcccggccuguucaagacucugaccggagagaucggcgccguaaccuuagacuucaaaccggggacgagcggaagcccgaucaucaaucgcaagggcaaggugauagggcuguacggcaacgggguggugacuaagagcggcgacuacgucuccgccaucacccaggcugagcgaauaggggagcccgacuacgaaguagacgaggacauuuucagaaagaagcggcuaaccaucauggaucuccacccgggcgcgggcaagacgaaacgcauccucccaagcaucgugcgggaggcccucaagcgccggcugcgcacccuaauccuggcccccacucggguuguugccgcggagauggaggaagcccuccgugggcuccccauccgguaccagaccccggccguuaaguccgagcacacggguagagagaucgucgaccucaugugccaugccaccuucaccaccaggcugcucagcucgacgcgugugcccaacuacaaucugauugucauggaugaggcccauuuuaccgaccccuccagcguggcggcccgaggguauaucuccacaagaguggagaugggcgaggccgccgccauuuuuaugaccgcgacgcccccgggggcaaccgaucccuucccccagaguaacucaccaaucgaggacaucgaacgggagaucccggagcgcagcuggaacaccggcuucgacuggauaaccgacuaccagggcaagacggucugguucgugcccucgaucaaggccgggaacgacaucgccaacugccugcgcaagagcggcaaaaaggugauccagcucaguaggaagaccuucgacaccgaguauccgaagaccaaguugaccgacugggacuucgucgugaccaccgauaucagcgagaugggggccaauuuccgcgccggccgggugaucgacccccgccggugccugaagccagucaucuugaccgacggcccugagcgcgucauccuggcaggccccauccccgugacgccggccuccgccgcgcagcggcgcgggagaaucgggcgcaauccugcccaggaggacgaucaguacgucuucagcggcgacccccucaagaacgacgaggaccacgcccacuggaccgaggccaaaaugcuccuggacaauaucuacacacccgaggggaucauuccgacgcuauucggcccugagcgggagaagacgcaggccaucgacggagaguuccgccucaggggggagcagcgcaagaccuuugucgagcugaugcggcgcggcgaucuccccgugugguuguccuacaaggucgcgagcgccgggauuuccuacaaagaccgggaguggugcuucaccggugagcguaauaaccagauccuggaagagaauauggagguggagaucuggacccgggagggagagaagaagaagcugcgaccgagguggcuggacgcccgcguguacgccgacccgauggcccugaaggauuuuaaggaauucgcgagcgggaggaagucuaucacguuggacauccucaccgagauugccagucugcccaccuaccuauccucccgcgcgaagcucgcccuggacaauaucguuaugcugcacaccaccgagcgaggcgggcgggcuuaccagcacgcgcuaaacgagcugcccgaaagccucgagacgcucaugcugguugcucugcucggcgccaugaccgcagggaucuucuuguuuuucaugcaagggaaggggauuggcaagcuguccaugggccucaucaccaucgcuguggccagcggacugcugugggucgccgagauucagccccaguggauagccgccucuaucaucuuggaauucuuccugaugguucuucucaucccggaacccgagaaacagcgcacuccacaggauaaucagcuaauauacgugauccuuacgauccucaccauaaucggccuuauugcggccaaugaaauggggcugaucgagaagaccaagacagacuuuggcuucuaccaggucaagacggagaccaccauccucgauguugaccugaggccggccagcgcguggacccuuuacgcaguggcgacgaccauucucacccccaugcugagacacacgaucgagaacacgucagccaaccugagccucgccgccaucgccaaccaggcagccguccugaugggguugggcaagggcuggccccuacaccggauggaccuuggggucccacuacucgccauggguugcuacucucaggugaacccgaccacccugacugccaguuuggucaugcucuccgugcacuacgccaucaucggaccugggcugcaagcgaaggccacgcgcgaggcccagaagcggaccgccgcgggcaucaugaagaacccaaccguagacgggaucaccguaaucgaccuagaaccaaucagcuacgacccuaaguucgagaagcagcucggccaggugaugcugcuaguccucugcgcggggcaguuacugcuaaugcgcacgaccugggccuucugcgagguccugacgcuggcaaccggccccauccuaacgcugugggaaggcaaccccggccgguucuggaacacuaccaucgccguguccaccgcgaauaucuuccggggcucuuaccuggccggggccggccucgccuucucccuuaucaagaaugcccaaacccccaggcgcgggaccggcaccacuggggagacgcugggagaaaaguggaaacgucaauuaaacucccuggaucgcaaggaauucgaggaguacaagcguucaggcauccuagagguggaucgcacugaagccaaguccgccuuaaaggacggauccaaaaucaagcacgccgucagccggggauccagcaagauccgcuggaucguggagcgggggauggugaagccgaaggguaaggucguggaccuugggugcgggaggggaggguggagcuauuacauggccacccugaagaacguuacggaaguaaaaggcuacaccaagggcgggcccgggcaugaggagcccauccccauggccacguacggcuggaaccucguaaagcugcacuccggaguggacgucuucuacaagccgacugagcaagucgacacccuucucugcgacauuggugaaagcagcaguaacccgaccaucgaggaaggacgcacucugcguguccugaagauggucgaacccuggcucuccagcaagcccgaauuuugcaucaaggugcugaacccguacaugcccaccgucauugaagaguuggagaagcuacagcggaagcacggaggcaaccucgugcgguguccccuuucccgcaauuccacccaugaaauguauugggugaguggcgcaagcgguaacaucguguccagcguuaacaccacauccaagaugcuguugaaccgguuuaccacucgccaccggaagcccaccuacgagaaggacguggaccugggcgccggaacgcgcagcgucaguaccgaaaccgagaagccggacaugaccaucauuggccggcgauugcagcgucuccaggaggagcacaaggaaacuuggcacuacgaccaagagaaccccuaccgcaccugggccuaucacggaagcuacgaggccccauccacgggcagcgcuuccucgauggugaacggcguggucaagcuacuaaccaagccgugggacguuauccccauggugacgcagcucgccaugaccgacaccaccccauucggucagcagcgggucuucaaggagaagguggauacacgcacgccccagcccaaacccggcacccgcauggugaugacaacgacagccaacuggcucugggcccugcucggcaagaagaaaaacccccggcugugcacccgggaggaguucaucucuaagguccgcuccaacgcggcgaucggugccguguuccaggaggagcagggguggacaagcgccuccgaagcugugaacgauagccgguucugggaacuggucgacaaggagcgcgcccuccaucaggagggcaagugcgaguccugcguguacaacaugaugggaaagcgggagaagaagcugggcgaguuuggccgagcgaagggguccagggcgaucugguacauguggcugggcgcccgauuucucgaguucgaggcccugggguuucugaacgaggaccacugguucggccgcgagaauuccuggagcggcguagagggagagggucuacaccggcucggauacauacuggaggagaucgacaagaaagacggcgaccugauguacgcggacgacacggcgggcugggacacccgcaucacagaggacgacuugcagaacgaggaguugaucaccgaacagauggcgccccaccacaagauccucgccaaggccaucuucaaacugacguaccagaacaaggucguaaaggugcuccggccaacgccccggggggcggucauggacaucauuucccggaaggaccaaagaggcagcggccaaguaggcaccuacgguuugaacaccuuuaccaacauggaggugcaacuuauccggcagauggaggccgagggcgucaucacacaggacgacaugcagaacccgaaaggccucaaggagcgaguggagaaauggcucaaggagugcggaguggaccggcugaagcgcauggccaucuccggcgaugauuguguggugaagccccuggacgagcguuucgggaccagccuccuguucuugaacgacaugggcaaggugcgcaaggacaucccgcagugggagcccaguaagggguggaaaaacuggcaggagguccccuucuguucccaccacuuccacaagauauuuaugaaggacggcaggucccucguggugccgugucgcaaccaggacgaauugaucggcagagcccgcauuagccagggggcgggcuggagucugcgggagaccgccugccucgggaaggccuacgcccagauguggagccugauguacuuccaccggcgcgaucuucggcucgccagcauggccauauguuccgcgguuccuacagagugguuccccacaagccgcaccaccugguccauacacgcccaccaccaguggaugacgacggaagacaugcugaagguguggaauaggguguggaucgaggacaaccccaacaugaccgauaagacgcccguacacuccugggaggacauaccguaccucgguaagcgcgaggacuuguggugugggucucugaucgggcugucaucccgggccaccugggccaagaacauccacacggccauuacccaggugcggaacuugaucggcaaggaggaguacguggacuauaugcccgucaugaagcgcuacagcgccccauccgagagcgagggugugcucuaa

SEQ ID NO: 26309 - RNA, 9867 nt, Artificial Sequence
  derived and/or modified CDS sequence (opt11) from DENV-4__KJ579243__SS-prME
ucuacuauaacgcuucucugccucauaccaacgguuauggcauuccacuugagcacaagggauggagaaccacucaugauaguagcaaaacacgaacguggccgcccgcuguuguuuaaaaccaccgaagggauuaacaaauguacccuaauugcaauggaucugggggaaaugugcgaggacacuguuacauacaaaugcccgcuccucguaaacaccgaacccgaagacaucgauugcugguguaaccuaacguccaccuggguuauguacgggacuugcacccaauccggcgagcggcgucgugaaaaacggagcguggcacuaacgccucacucgggcauggggcucgagacgcgcgcagaaacuuggaugagcucugagggcgcguggaaacaugcccaacgaguggaauccuggauauuaaggaaccccggauucgcgcugcucgcuggauuuauggcauacaugauagggcaaacaggaauccaacggaccguguuuuucguccuuaugaugcucguagccccaagcuacgggaugcgaugcgugggaguugggaacagggacuucgucgaagggguaucgggaggagcauggguagaccuggugcuggaacacggagguugugucaccacaauggcacaaggaaaacccacccuggacuucgaacuaaccaaaacaaccgcgaaagaaguagcgcucuuacgaacguacugcauagaggcccucauuagcaacauaaccacagccacacgcugcccaacccaaggggaaccuuacuuaaaagaagaacaagaucaacaauauaucugcaggagggaugucguagaccgcggcuggggcaacggaugcggacuauuuggaaaaggcggcgucgugaccugugcuaaauucagcuguucgggaaaaaucacugggaaccugguccaaaucgaaaaccuggaauacacggugguggucacaguccacaacggcgauacccaugcagucggaaacgacacuuccaaccauggugugacggccacgaucacaccccggucaccgucaguagagguaaaacucccggauuacggugaacugacacuagacugugagccgcggagcgggauagacuucaaugagaugauauugaugaaaaugaagaagaaaaccuggcucguccauaagcaaugguuucucgaccucccguuaccguggaccacaggugcugauacaagugaaguacauuggaacuacaaagaacguaugguaacauucaagguaccccaugcaaagcggcaagacgucacaguccuuggcagucaggaaggagcaaugcacagcgcucuugcaggagcaacggaaguugacaguggagauggaaaccacauguucgcagggcaccuaaaguguaagguacggauggaaaaacuacgcaucaaagguauguccuacaccauguguucggggaaauucucuauagacaaggaaauggcggaaacacagcacggaacaacagugguaaaaguuaaguacgaaggggccggugcuccguguaaaguccccaucgaaauaagggacgucaacaaagaaaagguugucggucgcguuaucuccgcaacgccccuagcagagaacacaaacagcguuacgaacaucgagcuggaacccccauucggggauucauacauugugaucggaguagguaacucagcacucaccuuacacugguuccgaaaggguaguuccauaggaaagauguucgagagcacuuacagaggggcgaaacggauggcgaucuugggcgaaacggccugggacuuuggcaguguaggugggcucuuuacaagucugggaaaggcaguacaccaaguguuuggcagcgucuacacgaccauguucggcggaguaagcuggaugauccgaauauugauaggcugucuaguacuuuggaucggaacgaacagucgcaacacguccauggcaaugacuugcauagccgucggagggauaacacuguuccuaggcuucacuguacaggccgauaugggaugcgucgugagcuggaguggacgagaacuaaaaugcgggagcgggaucuucguaguggacaauguccauacguggacagaacaguacaaguuccaacccgagaguccagcgcgucucgcgucagcuauacuuaacgcgcacaaagaugguguaugcggaaucaggagcacuacucgccucgaaaacguuauguggaaacagaucaccaaugaacuaaacuacguauuaugggaaggcggacaugaucuaacaguaguagccggugacgucaagggagugcuaacuaaaggcaaacgcgcccuaacaccuccugcgaguggacuuaaauauuccuggaaaacaugggggaaggcuaaaauauucacaccagaagcccgaaauucaaccuuccucauugauggaccugauaccuccgaaugcccgaaugaacgaagggcuuggaacaguuucgaggucgaagacuacggauucggcauguucacuaccaauauauggaugaaguuccgcgagggaagcuccgaaguaugcgaccaccgguugaugagcgcagcuauaaaggaucaaaaagcaguccacgcggacaugggauacuggaucgagagcuccaaaaaccagacuuggcagaucgaacgagccucuuuaauagaggugaagacaugccuauggccgaaaacacacacccucuggucgaauggggucuuagagagccagaugcuaauuccaaaaucauacgcgggaccauucagccagcacaauuaccggcaggguuacgcgacccaaaccguaggcccauggcaccuaggaaaguuagaaauagauuuuggggaaugccccgggacgaccguaacuauucaggaaaauugugaucauaggggcccgagccugcgaacaaccacugccagcgguaaacucgucacacaguggugcugccgaucuuguacaaugccaccacuacgcuuccuaggcgaagauggcugcugguacggcauggaaaucaggccccuuagcgagaaagaagaaaacauggucaagucacagguaaccgccggccagggaaccucggaaaccuucucaaugggccugcuaugccucacacuguucguagaagaaugucuccgccggcgugugacacgcaagcacaugaucuuagcgguggucauaacacucugcgcgauaauacuaggaggguuaacuuggauggaucuucuccgggcguuaaucauccucggagauaccauguccggcagaauaggaggccaaacacaccuagcaaucauggcuguuuucaagaugagccccggguauguacucggcguauuccuaaggaaguugacaagcagagaaacggcucugaugguaaucggaauggcuaugacaacaacgcuauccauaccccaugaccucauggaacuaauagauggcaucucacucggccugauacuucucaagauaguaacacaauucgauaauacucaaguuggaacucucgcccuaucgcuaacauucauaaggagcacaaugagccucgugauggcauggcgcaccauaauggcaguucuauucguggucacacuuauaccguugugccguaccaguugccuacagaagcagagccacuggguagagauaacggcucugauucuuggggcacaagcacuccccguguaccucaugacccucaugaagggagccagcagacgcucauggccucuaaacgaaggaaucauggcaguggggcugguaucccugcuggguagcgcucuacucaaaaacgauguaccccuggcagggccaaugguagccggcgggcuauugcucgcggcguacguuaugagcggaucaagcgcagauuuaucacuugaaaaggcagccaacguacaaugggacgaaauggccgacaucacgggcagcagcccgaucaucgagguuaaacaggacgaagauggcagcuuuagcaucagggacguggaagaaacgaacaugauaacgcucuuggucaaguuagcacugauaaccgugucggggcuuuacccccuagcgauuccaaucacaaugacccugugguacauguggcaagugaaaacccaacgaaguggcgcacucugggacgugccuagccccgcagcaacacaaaaagcagcgcucagcgaaggcguguaccgcaucaugcagcguggccuauucggcaaaacacaggucggcgucggcauccauauggagggcgucuuccacacuauguggcacgucacacgaggauccguaaucugccacgaaacgggucgccuggaaccgaguugggcggacguaaggaaugauaugauauccuaugggggcggguggagacuaggagacaaaugggacaaagaagaagacguacaggugcuggccaucgagcccggcaagaacccaaaacacguccaaacaaaaccaggucuauucaagacuuuaacaggcgagaucggugcaguuacgcuagacuuuaagccggggaccucaggaaguccgauaauaaaccgaaaaggcaaaguaaucgggcuauacggaaacggggucgucacaaaguccggcgacuacguaagcgcaauaacacaggccgagcggauaggcgaaccagacuaugaagucgacgaggauaucuuccgcaaaaagagacuuaccaucauggaccuacauccgggcgcuggcaaaacaaaacgcauacuacccuccaucguaagggaagcgcugaaaaggcgacugaggacccuaauccuagcucccacaagaguggucgcagcagagauggaggaggcucuccgaggccucccgaucagauaccaaaccccugcggugaaaagugagcacacgggaagggaaaucguagaccuaaugugucaugccacauucacgacucgacucuuaaguucaacucgcguccccaauuacaacuugaucgucauggacgaggcacacuuuaccgaccccucuagcgucgcagcacgaggcuacaucaguacgcgaguagaaaugggcgaggcggccgccauauucaugacggcaacacccccgggugcgacugacccauucccccaguccaacagcccgauagaagacaucgagcgagagauaccagagcgcucguggaacaccggguuugacuggaucaccgauuaccagggcaagacggucugguucguaccauccaucaaggcaggaaacgacauugcaaacugccugcggaaaucggggaaaaagguaauucaacugucacgcaagacguucgacacagaguauccaaaaacgaaauuaacggacugggauuucguugugacuacagacauaucggagaugggagcaaauuuuagagccggacgagucauagacccgagacgaugucuaaaaccuguaauacugacugacggaccagaacgcguaauacuagcgggcccaauuccagucaccccugcgagcgcagcgcagcgccguggccggauuggucggaacccggcccaagaggacgaccaguacguguucucaggagacccgcuaaagaacgacgaagaccacgcucacuggacagaagcaaaaaugcuacuugacaacauauacacacccgaaggcauaauacccacacuguucggucccgagagagagaaaacgcaagcaauagacggagaguuuaggcugcguggcgagcaacggaaaacauuuguagaauuaaugcgucgaggggaccuaccgguaugguuaaguuacaaggucgcuuccgcaggcaucagcuacaaagacagagaauggugcuucaccggagaacgcaacaaccaaauccuggaggaaaacauggaaguugaaauuuggacccgggaaggggagaagaagaaacugcguccuaaaugguuagaugcucgcguguacgcagacccgauggccuuaaaagauuucaaggaauuugccuccggacguaaaucaaucaccuuggacauauuaacagagauagccucacuaccaaccuauuugagcuccagagcaaaacuggcucucgacaacauagugaugcuccacacaaccgaaaggggaggccgugcguaucaacacgcauuaaacgagcuuccggaaucccucgaaacauuaaugcuuguagccuuauugggcgcaaugaccgccgguaucuuccuauuuuucaugcaaggcaaggggaucgggaaguuauccaugggacuaauaacuauagcaguggcauccggccuacucuggguagcagaaauacagccgcaauggauagcggcgucuauaauacucgaauuuuuccucaugguacuacucauaccagaaccugaaaaacaacgcacaccacaagacaaucaacucaucuauguaauucucacuauucuaaccaucauuggacuaauagcagccaacgaaaugggccuaaucgagaagacgaagacggacuucggcuucuaucaagugaaaacagaaacgaccauacuagacguugauuuacggccugcaucggccuggacacucuacgcaguagcaaccacgauccugacgcccaugcuccggcauaccauagaaaacacgagcgcgaacuugucgcuggccgccauagcuaaccaggccgcagucuugaugggacuuggcaaaggguggccacuacaccgcauggacuuaggcgucccacuucuugcuaugggcugcuacucacagguaaacccaacgacccucacagccagccucguaaugcugcuuguacauuacgccauaaucggaccuggacuacaagcgaaagcaacacgggaagcacaaaagaggacagcagccggaauaaugaaaaacccgacaguagacgguaucaccguuauagaccucgaacccaucucuuacgacccgaaauuugagaaacagcucggacagguaaugcugcuuguucucugcgcgggucaacuccuacuuaugcgaacgacuugggccuucugcgagguacucacgcuggccacgggacccauccucacccugugggaagggaacccgggacgauucuggaauacaacaauagccguaaguacggcaaacauauuucgcgggaguuaccuagcuggcgcaggacuggcauucucauuaauuaaaaacgcacaaaccccgcgccgagggaccggcaccgcgggggaaacacucggggaaaaguggaaacggcaacugaacucacuggaccgcaaggaguucgaagaauauaagcggaguggcauucuagaggucgaccggacggaagccaaguccgcgcucaaagacgggagcaaaauuaaacacgccguuagucggggauccaguaaaauacguuggaucguugaacguggaaugguaaaacccaaagggaaagugguagaccucggauguggccgcggaggguggucuuacuacauggcaacgcucaaaaacgugaccgagguuaagggauacacaaagggagguccugggcacgaagaaccgauccccauggcgacuuacggcuggaacuuaguaaagcuccauagcggaguagacguauuuuacaagcccacagagcaagucgacaccuugcucugcgauauaggggaaucaagcuccaaccccaccauagaagaaggccgaacccuaaggguucucaaaaugguggaaccguggcuuucaucaaagccagaguucuguaucaaaguccugaacccguacaugccaacugucaucgaagaacuagagaagcugcaacguaagcaugggggcaacuuaguaagaugcccacugagccgcaacagcacgcacgagauguacugggucucgggcgccagcggcaacaucguaagcucuguaaacacgaccagcaaaaugcugcucaaccgauuuaccacacgacacaggaagcccaccuaugaaaaagauguugaucucggagcggguacgagauccguaagcaccgaaacagaaaaacccgacaugacaauuauaggaaggcgcuuacaaagacuacaggaagaacauaaagagaccuggcauuacgaccaagaaaacccguaccggacgugggccuaccauggcagcuacgaagcaccgucaacaggcuccgcgaguucuaugguuaacggcguagugaagcuccugaccaaaccaugggacguaauucccauggucacccaauuagcaaugaccgacacgacacccuucggacaacagaggguauuuaaagagaaagucgacaccagaacaccgcagcccaaaccaggcacgaggauggucaugacgaccacggcuaacuggcucugggcacuacuaggcaagaagaaaaaucccaggcugugcacgcgagaggaguucaucucaaaagugcgguccaacgccgccauuggggcaguguuccaagaggagcaaggguggaccagcgcaucagaagccguaaacgacucaagguuuugggaacuggucgacaaagaacgcgcgcugcaccaggaaggaaaaugcgagucgugcguauacaacaugaugggcaaacgagagaagaaacuuggagaauuuggucgagcaaaaggaucgcgagcuauaugguauauguggcugggagcaagauuccuagaguuugaggcccugggguuccucaacgaggaucauugguucggaagagagaacucuugguccggagucgaaggggagggauuacaccgacuuggcuauauauuggaagagaucgacaagaaagacggcgaccucauguacgcugaugauacugcgggcugggacacgcguauaacagaagacgaccuacaaaacgaggaacugauaacggagcagauggcaccucaccauaagauacuugcaaaggcgauauucaagcuaacauaucaaaacaaaguaguaaagguccuacgacccacgccgagaggggcgguaauggacauaauaucgagaaaagaucaacgagggucuggacaaguaggaaccuacggacugaauaccuucaccaacauggaagugcaacugauccgccaaauggaagccgaaggggucaucacucaggacgacaugcaaaacccgaaaggccucaaggaaagaguggagaaauggcuccgcgaguguggcguagaucgacucaagcggauggccaucagcggggacgacugcgucgucaagccauuggacgagcgauucgggacaucauugcuauuccugaaugauaugggcaagguccgaaaagacauuccccagugggaacccucaaaaggcuggaaaaauuggcaagaggugccauucugcucucaccacuuccacaagauauucaugaaagacggaagauccuugguaguaccaugucgaaaccaggaugagcugauaggacgagcaagaauaagccaaggcgcgggauggagccuccgcgaaacggcaugcuuaggcaaagccuacgcccagauguggagucucauguacuuccacagacgagaccuccggcuagcgagcauggcaauaugcucagcaguacccacggaaugguuccccacgucacgcacuacaugguccauucacgcccaucaccaguggaugacaacagaagauaugcugaaggucuggaaccgagucuggauagaagacaacccaaacaugauagacaagacgccuguucacagcugggaagacauucccuaccucggcaaaagagaagaucugugguguggaucacuuauuggacucuccagccgagccacgugggccaagaauauccauacagcaauaacccaaguccgaaacuuaauaggaaaagaagaguauguggacuacaugccggugaugaagcgguacagcgcgccgucagaauccgaagggguacuauag

SEQ ID NO: 26310 - RNA, 9867 nt, Artificial Sequence
  derived and/or modified CDS sequence (opt11) from DENV-4__KJ579246__SS-prME
agcaccaucacgcugcucugccugauccccacggugauggccuuccaucugucgacgcgcgacggcgagccgcugaugaucgucgccaagcacgagcgggggcgccccuuauuauucaagaccaccgagggcaucaacaagugcacacucauagcgauggaccugggggagaugugcgaggacacagugaccuacaaaugcccccuucucgugaauaccgagcccgaagacaucgacugcuggugcaaccugacgaguaccugggucauguacggcacaugcacccaguccggggagcggcgccgggaaaagcgcagcguggcccugacgccgcacucgggcaugggccucgaaacucgggccgagaccuggauguccucugagggggccuggaaacacgcccagcgcguggagagcuggauccugcggaacccaggcuucgcgcugcucgcaggguuuauggcuuacaugaucgggcagacugggauucagcggacggucuucuucguucugaugaugcugguggcccccuccuacgggaugcgcugcgucggcguggggaaucgcgauuucguggagggcguauccgggggcgccuggguggaucucgugcuggaacacggcgggugugucaccaccauggcccagggcaagcccacccuggacuucgaguugacgaagaccaccgccaaagagguggcccugcugcggaccuacugcaucgaggcccucauuuccaauauaaccaccgccacccgcugcccgacccagggggaacccuaccugaaggaggagcaggaccaacaauacauuugccggcgcgacguggucgaccgggguugggggaacggcugcggcuuauuuggcaagggcgggguggucacgugcgccaaguuuagcuguuccgguaagaucaccgggaaccucguccaaaucgagaaccuggaauauaccgugguggucaccgugcacaauggcgauacgcacgccgucggcaacgacaccagcaaccacggggugacggccaccaucacgccccgcucccccagcguggaagucaaacucccggacuauggcgagcucaccuuggacugcgagccccgguccgggaucgacuucaacgagaugauccugaugaagaugaagaagaaaacauggcucgugcauaaacaaugguuccucgaccugccucuaccuuggacaaccggagccgacacgucugaggugcacuggaacuacaaggaacgcauggucaccuucaaagugccacacgcgaaacggcaggacgugaccguccuggggucccaggagggcgccaugcacagcgcgcuggccggcgcaaccgagguggacagcggggacggcaaccauauguucgcggggcaccucaagugcaaagugcgcauggagaagcugcgcaucaagggcauguccuacacgaugugcagcggcaaguucagcaucgacaaggagauggcugagacccagcaugggaccaccgucgugaaggugaaguacgagggcgccggggcccccugcaaggucccuauagagauccgggacgugaauaaggagaagguggucggacgcgugaucagcgccacgccccuggcggagaacaccaacagcgugaccaacaucgaacucgagccucccuucggagacagcuauaucgucaucggcgugggaaacuccgcccugacucugcacugguuccggaagggguccuccaucggcaagauguucgaaagcacguaccgcggggccaagcggauggccauccucggcgagaccgcgugggacuucggguccgugggcggccuguuuaccagccuggggaaggccguccaccaggucuucggcuccguguacacaacgauguucgggggugugucuuggaugauccgcauccucaucggguuccuggugcuguggaucggcaccaacucccggaacaccucaauggccaugaccugcaucgcagugggcgggauuacgcucuuccugggguuuaccguccaggcggacauggggugcgugguguccuggagcggccgcgagcugaagugugggucuggcauauucgucguggauaacgugcacaccuggaccgagcaguacaaguuccagcccgagagccccgcucgccuagcuucagccaucuugaacgcgcacaaggacggcgucugcgggauccgcuccacgacccgguuggagaacgugauguggaagcagaucaccaacgagcugaacuacgugcucugggagggcgggcacgaccugaccgucgucgccggcgacgugaagggcguccugacgaaggggaaacgggcgcucaccccucccgccagcgacuuaaaguacuccuggaagaccuggggcaaagccaagaucuucacacccgaggcccggaacagcaccuucuugauugacgggcccgacacuuccgagugcccgaacgagcgacgggccuggaauagcuucgagguggaggacuacggcuucgggauguucaccaccaauauauggaugaaguuccgcgagggcuccagcgaggugugcgaccaccggcugauguccgcggccaucaaggaccagaaagccguccacgccgacaugggcuacuggaucgagucauccaagaaucagacauggcagaucgagagagccagccucaucgaggugaaaaccugcuuauggcccaagacccacacccucugguccaacggaguucuggagagccagaugcugauccccaaguccuacgccggaccuuucagccagcacaacuaccggcagggguacgccacccagacggucggccccuggcauuuggguaagcuggagaucgacuucggcgagugccccggcaccaccgugacuauucaggagaacugcgaccaccgcgggcccucccugcgcacgaccaccgcaagcggcaagcucgugacacaguggugcugucggagcugcacgaugccgccccugcgcuuccugggggaggacggcuguugguacgggauggagauccggccccuauccgagaaggaggagaauaugguaaaaagccaagugaccgccggccagggcacauccgagaccuucagcaugggucugcucugccucacgcuguucgucgaggagugccugaggcgacgcguaacccggaagcacaugauacucgcgguggucaucacccugugcgccaucauccuuggcgggcucacguggauggacuuacuccgcgcccugaucauccugggcgauacgauguccggacggaucggaggccagacccaucuggcuaucauggcgguguucaagaugucgcccggguacgugcucggcguauuccugcgcaagcugaccucccgggaaaccgcgcucauggugaucggcauggccaugacgaccacccucagcaucccgcacgaccugauggaacucaucgacggcaucucccugggucugauccuucugaagaucgugacccaguucgacaacacgcaggucgggacccuggcgcucucccuuaccuucauacgcagcaccaugagccuggugauggcauggcggacgaucauggcaguacucuucgucguaacccugauccccuugugccgcaccuccugcuuacagaagcagagccacuggguggagauuaccgcgcugauacugggcgcccaagcccuccccgucuacuuaaugacgcugaugaagggcgccucccggcgcucuuggccucucaacgaaggcaucauggccguggggcuggugucucugcucggcagcgcccugcugaagaacgacgucccgcucgccggccccaugguggccgggggacugcugcucgccgcguacgugauguccggaagcagcgccgaccugucccuggagaaggccgccaacguccagugggacgagauggccgacaucaccggcagcucccccaucaucgaggugaagcaggacgaagacgggagcuucucuauccgagacguggaggagacgaacaugauaacccuccuggucaagcuggcgcucaucaccgugagcgggcuguacccccuggccaucccgaucaccaugacccucugguacauguggcaggucaagacccagcgguccggcgcccugugggacguccccagccccgccgccacccagaaggcggcacuguccgaggggguguaucggaucaugcagcgcggccucuucggcaagacgcaggugggcgucgggauccacauggagggcguguuccacacgauguggcacgugacccggggcagcgucaucugccacgagaccgggcgcuuagagccauccugggccgacguccgcaaugauaugaucagcuacggcgggggcuggcggcugggagauaagugggacaaggaggaggacgugcagguccucgccaucgagccgggaaagaaccccaagcacgugcagacgaagccaggccuguucaagacccugaccggggagaucggcgccguaacccucgacuucaagccagggacguccggcagcccgaucaucaaucgcaagggaaaggucauagggcuguacggcaacggggucgugaccaaguccggcgacuacgucagcgccaucacccaggccgagcggauaggggagccggacuacgagguggacgaggacauuuuucgcaagaagcggcugacgaucauggaucuccaccccggcgccggcaaaacgaagcgcauccugccauccauagugcgggaggcccugaagaggcggcugcgcacccucauccuggcccccacgcgggucguggccgcggagauggaagaagcgcugcgcgggcuccccauccgguaccagaccccugccgugaagagcgagcacacgggccgcgagaucgucgaccugaugugccaugcaacguucaccacccggcugcucuccagcacgcgcgugcccaacuacaacuugaucgugauggacgaggcccacuucacugaccccucgagcgucgccgcucggggguacaucagcacccgcguggagaugggugaggcggccgccaucuucaugaccgccaccccccccggcgccaccgauccguucccucagaguaacagccccaucgaggacaucgagcgggagaucccugagcgcuccuggaacaccggcuucgacuggaucaccgacuaccagggcaagacugucugguucgucccgagcaucaaggccggaaacgacaucgcgaacugccugcgcaaguccgguaaaaaggugauccagcucagccggaagaccuucgacaccgaguacccaaagaccaagcugacggacugggacuuuguuguuaccaccgacaucuccgagaugggggccaacuuucgcgccggucgggugaucgacccccgccggugccugaagcccgucauccucaccgacgggccggagcgcgugauccuggcaggccccaucccggugacgcccgcgagcgccgcccagcggcgcgggcggaucgggcgcaacccggcccaggaggaugaccaauauguuuucaguggagacccccugaagaacgacgaggaccacgcccacuggacggaggcgaagaugcuccuggacaacaucuacacccccgaggggaucauccccacccuguucgguccagagagagagaaaacgcaggcuauugacggcgaguuccgccuccggggagagcaacgcaagaccuucguggagcugaugcgacgcggggaccugccuguguggcucagcuacaagguagccuccgcagguaucagcuacaaggaccgggaauggugcuucacaggagagcgcaauaaccagauccuggaagagaacauggaggucgagaucuggacucgggagggggagaagaaaaagcugcgcccaaagugguuagacgcccgaguguacgcggaccccauggcccugaaggauuucaaggaguucgccuccgggcgcaaaagcaucacccuggacauucucacggaaaucgccucccuucccaccuacuuaagcucccgcgcgaagcucgcccuggacaacaucgucauguugcacacgaccgagcggggcgggcgcgcauaccagcacgcccuuaacgaauugcccgagagccuggaaacgcucaugcugguggcccugcugggagcgaugaccgccgggauuuuccuguucuucaugcagggcaaggggaucggcaaacucagcaugggccucaucacaaucgccguggccucugggcugcugugggucgccgagauacagccccaguggaucgcggcgagcaucauccuggaguucuuccugauggugcugcucaucccagagcccgagaagcagcggaccccgcaggacaaccagcuaaucuacguuauccucacaauccucacgaucaucggccugaucgccgccaacgaaauggggcugaucgagaagaccaagaccgacuuuggcuucuaccagguaaagacggagacgacaauacucgacguggaccugcgcccagccuccgcauggacccuguacgccguugccacgaccauacucacgccuaugcugcggcacacaauagagaacacgagcgccaaccugucccucgccgcgaucgcaaaucaggccgccguccugauggggcugggaaagggcuggccucuacaucgcauggaccugggggugccccugcucgccaugggcugcuacagccaggugaaccccaccaccuugaccgccucucugguaaugcuccuggugcacuacgcaaucauagggccgggcuugcaggcuaaggccacgcgggaggcgcagaagagaaccgccgccggaaucaugaagaaccccaccguggacggcaucacugucauugaccucgagcccaucagcuacgaccccaaguucgagaaacagcugggccagguuaugcugcucgugcugugcgccgggcagcugcuccugaugcguacgaccugggccuuuugcgagguccugaccuuagcgaccggaccgauccugacgcugugggaggggaaccccggccgcuuuuggaacaccacuaucgccguguccaccgccaacauauuccggggcagcuaccucgccggggccggccuggcguucucccugaucaaaaacgcccaaacgccccgcagggggaccggcacggccggggagacacuaggcgagaaauggaagcggcaacugaauagccucgaccggaaggaguucgaggaauacaagcguuccggcaucuuagagguggaccggaccgaagccaagagcgcccugaaggacgguuccaagaucaagcacgcggucagccgcggcuccagcaagauccgguggaucguagagcgcgggauggugaagcccaaggguaagguaguggaccuggggugcggccgcggcgggugguccuacuacauggccacgcucaagaacgugaccgaggucaagggauacaccaaagggggcccggggcacgaggagcccauccccauggcuaccuacggcuggaaccuggugaagcugcacagcggcguggacgucuucuacaagcccacggaacagguggacacccuccugugcgauaucggggagagcuccagcaacccgaccaucgaggagggccguacccuccgcgugcucaagauggucgaacccuggcuguccagcaagcccgaguucugcauuaaggugcugaaccccuacaugccgacggugaucgaggaacuggaaaagcuccagcggaagcaugggggcaaccugguccgcugcccccugucccggaacagcacccacgagauguacugggugucgggugccucggggaacaucgucuccagcgugaacaccacguccaagaugcuccugaaucgcuucacgacccggcaucgcaagcccaccuacgagaaggauguggaccugggggcgggaaccagaagcgucuccacggagaccgagaagcccgacaugacaaucaucggccgacgucuccagcgcuuacaggaggagcauaaggagacuuggcacuacgaucaggagaacccguaccggacaugggccuaccacgggaguuacgaggcccccuccaccggcagcgccuccagcauggugaacggggugguaaagcuguugaccaagcccugggaugugauucccauggugacgcagcuggccaugacggacaccacccccuucgggcagcaacgcgucuucaaggagaagguggacacacggacgccccaacccaagccgggcacccgcauggugaugacgacgacggcgaacuggcugugggcccuccuggggaagaaaaaaaacccccggcucugcacccgcgaggaguucaucuccaagguccggagcaacgccgccaucggcgccguguuccaggaagagcagggguggaccucagcguccgaggccguaaacgacucccgcuucugggagcuagucgacaaggagcgggcccugcaccaggaggguaagugcgaaagcugcguguacaacaugaugggcaagcgagagaagaagcucggggaguucggccgcgccaaggggagccgggccaucugguacauguggcucggggcgcgcuuccucgaguucgaggcccugggguucuugaacgaggaucacugguucggccgggagaacucguggagcggcguggagggggagggccugcaccgccugggauacauccucgaggagaucgacaagaaggacggcgaccugauguacgccgacgacaccgcaggcugggacacgcggauuaccgaggacgaccugcagaacgaggagcucaucaccgagcagauggcgccccaccacaagauccuggccaaggccaucuucaagcugaccuaccagaacaaggucgugaagguucuccggcccaccccgcggggggccguaauggacaucaucucccgcaaggaccagcgggggagcgggcaggugggaacguacgggcuaaacaccuucaccaacauggaggugcagcugauccgccagauggaggccgagggcgucaucacucaagacgacaugcagaaccccaagggccucaaagaacgcguggagaaguggcugcgcgagugcgggguggaccggcugaagcgcauggcgauauccggagacgacugugucgucaagccccucgacgagcgguucgggacgagccugcuguuccucaacgacaugggaaaggugcgaaaggacaucccccagugggagccguccaagggguggaagaacuggcaggagguccccuucugcagccaccacuuccauaagaucuucaugaaggacggccggucgcuggugguccccugccgcaaccaggaugagcuaaucggccgggcccgcauaagccaaggggccggcuggucccucagagagacugccugccuggggaaggcuuacgcgcagauguggagucuaauguacuuccaccgacgcgaccuccggcuggccuccauggcuauauguucugccguccccacggagugguucccgaccagcaggacaaccugguccauccacgcccaccaccaguggaugaccaccgaggacaugcugaaaguguggaaccggguguggaucgaggacaaccccaacaugaucgacaaaacucccauucacagcugggaggacauccccuaccucggcaagcgcgaagaccuguggugcggaucccugaucggccucagcucccgggcgaccugggccaaaaacauccacaccgccaucacccagguccgcaaccugaucggcaaggaggaauacguggauuacaugccggugaugaagcgguacagcgcccccuccgagagcgaggggguccuguga

SEQ ID NO: 26311 - RNA, 9867 nt, Artificial Sequence
  derived and/or modified CDS sequence (opt11) from DENV-4__KJ579248__SS-prME
agcaccaucaccuugcucugccugauucccaccgugauggcauuccaccugagcacccgggacggcgaaccccucaugaucguggccaagcacgagcgggggcggccucugcuguuuaagaccaccgagggcaucaacaagugcacacucaucgcgauggauuuaggggagaugugcgaggacaccgugaccuacaagugcccccugcuggugaacaccgagccagaagacauagacugcuggugcaaucucacguccacuugggugauguaugggaccugcacccaguccggggagcgacgccgggagaaacgcagcguggcgcugacuccgcacuccggcauggggcucgagacccgggccgaaaccuggauguccuccgagggggccuggaagcacgcgcagagaguggagagcuggauccugcggaacccuggauuugcacugcucgccggguucauggccuacaugaucggucagaccgguauccagcgcacggucuuuuucguguuaaugaugcugguggcccccuccuacggcaugcggugcgucggcguggggaaccgcgacuuugucgagggcgucagcggaggcgcguggguggaccucguccuggaacauggcgggugcgucaccaccauggcccagggcaagcccacucuugacuuugaacucacgaagaccaccgccaaggaaguugcccuacugcggaccuacuguaucgaggcccuuaucucgaacauaacgaccgcgacgcgcugcccgacccagggggagccauaccugaaggaggagcaagaccagcaauauaucugucggcgagacguggucgaccggggcuggggcaacggaugcggccuauucgggaagggcgggguggugacgugcgcgaaauucaguugcuccggcaagaucaccgggaaccucguccagaucgagaaccuggaauauaccgugguggucacugugcacaauggcgacacgcacgccgucggcaacgacaccagcaaccacgggguuaccgccaccauaacgcccagaucccccagcguggaggugaaacugccagacuacggcgagcucacucuggacugcgagccccggucuggaaucgacuucaacgagaugauccugaugaagaugaaaaagaagaccuggcucgugcacaagcagugguuccuggauuuaccccuccccuggaccaccggggccgauacuucagagguccacuggaacuacaaggagcgcauggucaccuucaaggugccgcacgcgaagcggcaagacgugacugugcuggggucccaagagggcgccaugcacucagcccuggccggcgccaccgagguggacagcggcgacggaaaccacauguucgcgggacaccucaagugcaaggugcgcauggagaagcugcgcaucaaggggaugagcuacacgaugugcagcggcaaguuuuccaucgacaaggagauggccgagacccagcaugggaccaccgucgugaaggugaaguaugagggagccggagcccccugcaaggucccaauagagauccgggacgucaacaaggagaagguggucggccgcgugaucucggcaacgccccucgcggagaauaccaauucuguaaccaacauagagcucgagccgccauucggcgacagcuacaucgucaucggcgugggcaacucggcccugacccugcauugguuccggaaggggagcuccaucggcaagauguuugaaagcacguaccgcggggccaagcggauggccauccugggugagaccgcgugggacuuugggucgguagggggccuguuuaccucacuggggaaggccguccaccagguguuuggcuccguguacaccacgauguucgggggcgucagcuggaugauccgcauccucauaggguuccuggugcuguggaucggcaccaacucccggaacaccagcauggccaugacuugcaucgcaguaggagggauuacacuguuucucggauucaccguccaagccgacauggggugugugguguccuggagcggccgagaacugaagugcggguccggcauauucgucguggacaaugugcacaccuggaccgagcaguauaaauuccagcccgagagccccgcgcggcuggccucagccauacucaacgcccacaaggacggcgucugcgggaucagguccacgacccggcuggagaacgugauguggaagcagaucaccaacgagcucaacuauguacugugggaaggagggcacgaccugaccguuguggccggcgacguuaagggcguccugacgaaagggaaacgcgcgcucaccccacccgccucugaucugaaauacuccuggaaaaccuggggcaaggccaaaaucuuuacccccgaggcccgaaacagcacguuccucauugacgggcccgacaccuccgagugcccgaacgagcgccgggccuggaacagcuucgaggucgaggacuacggcuucgggauguucaccaccaacaucuggaugaaguuccgugagggcuccagcgaaguuugcgaucaccggcucauguccgcggccaucaaggaucagaaggccguacacgccgacaugggcuacuggaucgagagcucaaagaaucagacguggcagaucgagcgcgcgagccugaucgaagugaagacgugccuguggcccaagacccacacgcucugguccaacggggugcuggagagccaaaugcugauccccaaguccuacgccggcccguucagccagcacaacuaucggcagggguacgccacccaaacggucggccccuggcaucucggcaagcuagaaaucgacuucggcgagugccccggcacaaccgugaccauccaggaaaacugugaccaucguggccccucccugcgcacgaccacagccagcggcaagcucgugacccaguggugcugucggaguugcacgaugccgccgcugcgcuuccugggggaggacggcugcugguacgggauggaaauuaggccccuauccgagaaggaggagaacauggucaaaucacaggugaccgccggccagggcaccuccgagaccuucagcauggggcugcugugccucacacuguucgucgaggagugucugcgccggcgcgugacacgcaagcauaugauucucgcgguggucaucacccugugcgccaucauccuaggcgggcucaccuggauggaccuacugcgcgcccugaucaugcugggcgacacaauguccggccgggucggcggucagacccaccuggcgaucaucgccguguucaagaugagccccggguacgugcucgggguguuccugcgcaagcugaccucccgggagaccgcgcucauggucauagggauggccaugacaacaacccugagcaucccgcacgaucugauggagcucaucgacggcaucucccugggccugauccuccuuaagaucguaacccaguucgacaacacccagguggggacccuggcccucagccugaccuucauccgcuccacaaugucacuugugauggccuggcgaaccaucauggccguccucuucguggugacccugaucccccugugccgaaccucgugucuccagaaacagagccacugggucgagaucaccgcgcugauccugggcgcccaggcucucccaguguaccucaugacgcugaugaagggagccucacggcgcagcuggccccucaacgagggaaucauggcggugggguuagucucccugcucgguucugcccugcugaagaacgaugugccgcucgccggccccaugguggcagggggccugcuauuagcugcguacgucauguccgggucuuccgccgaccugucccuggagaaggcagcgaacgugcaaugggaugagauggccgacauaaccggaucuucccccaucaucgaggugaagcaggacgaggacgggagcuucuccauccgggacgucgaggagacgaacaugaucacccuacugguuaaacuggcccucauaacggugagcggacucuacccucuugcgaucccgaucaccaugacccucugguacauguggcaggucaaaacccagcgcaguggcgcccugugggacgugcccagccccgccgcaacgcagaaggcggcccuguccgagggagucuaccgaaucaugcagcgcggcuuauucggcaagacgcaggucggggucgggauccacauggaggggguguuccacaccauguggcacgucacccggggcagcgugaucugccacgagacagggcgccuugagcccuccugggcggaugugcgcaacgauaugaucagcuacggcgggggcuggcggcugggcgacaagugggacaaggaggaagacguccagguacucgcgauugagccggggaagaacccuaagcacgugcagaccaaacccggcuuguuuaagacccugaccggcgagaucggagccgucacacucgacuucaagcccggcacguccgguuccccgauaaucaaucgaaagggcaaggugaucgggcuguacgguaaugggguggucaccaaguccggcgacuacgucagcgcaaucacgcaggccgagcggaucggggagcccgacuacgagguugacgaggacauauuccgcaagaaacgguuaaccauuauggaccuccaccccggcgccggcaagacgaagaggauccuuccguccaucguccgggaggcccugaaacgccggcuucgcacccucauccuggcccccacccgggugguugccgcugagauggaggaggcccugcgcggccucccaauccgguaccagacccccgcgguuaagagcgagcacaccggacgggagauagucgaucugaugugccaugcuaccuucacgacucggcugcucuccagcacgcgcguuccgaacuacaacuugaucgucauggacgaggcccacuucaccgacccaagcucagucgccgcccggggguacauaagcacgcgcguagagaugggcgaggccgcugcgaucuucaugacagcgacaccgcccggggccaccgacccguucccccaguccaacagccccaucgaagacauugagcgggagaucccugagcgcuccuggaacaccggauucgauuggauaaccgacuaccagggcaagacggugugguucgugccgagcaucaaggcugggaacgauauugcgaauugccugaggaaguccggcaagaagguaauacaguuaagccggaagaccuuugacaccgaguacccaaagaccaagcugacggacugggacuucguugugaccaccgacaucuccgagaugggugccaacuuucgggccggccgggucaucgacccccgucggugccugaagcccgucauccucacagacgggccggagagggugauccuggccggccccauccccguaacgcccgcgucagccgcccagcggcguggccggauagggcgcaacccugcgcaggaggacgaccaauacguguucuccggcgauccccugaaaaacgacgaagaucacgcgcacuggaccgaggcgaagaugcuccucgacaacauauauacccccgaggggaucauccccacccucuucgguccggagcgggagaaaacgcaggcaaucgauggugaguuccgccugcgcggugagcagcgcaagaccuucguugagcugaugcggagaggcgaucugcccgucuggcucagcuauaaggucgcguccgcggguaucagcuacaaagaccgggagugguguuucaccggggagcgcaacaaccagauccuggaagagaacauggaaguggagaucuggacacgggagggggagaagaagaagcugcgcccuaaguggcucgacgcgcgggucuacgcggaccccauggcccugaaggauuucaaggaguucgccuccggccgcaaguccaucacccuggacauccucacggaaaucgccucccugccgaccuaccugagcucccgcgccaaguuagcgcuugacaacaucgugaugcuacacaccacggagcggggcggacgcgccuaccaacacgccuugaacgaguugcccgaaagccucgagacguuaaugcugguggcccuucucggcgcgaugaccgccgggaucuuccuguucuucaugcaaggcaaggggauagguaagcuaagcaugggccucaucacgaucgccguggcuucgggguugcuguggguugccgagauccagccccaauggaucgcugcaagcaucauacucgaguucuuccuaauggugcugcucauaccggagccagagaagcagagaaccccacaggacaaccagcuuaucuaugucauacugacgauccucaccauuaucggcuuaaucgccgccaacgaaaugggacugaucgagaagaccaagacugauuucggcuucuaccaagugaaaacggagaccaccauccucgacguggaccugcgccccgccucggcguggacccuuuacgccgucgccacgacgauccucacaccgaugcugcggcauacgauugagaacacuagcgcuaaccugucgcucgccgcgauagcuaaccaggcggccgugcugauggggcugggcaagggcuggcccuugcaccgcauggaccugggggugccccugcucgccauggggugcuacagccaaguuaacccuaccacccugacagcgucguuagugaugcuccugguccacuacgccaucaucgggccgggccuacaggcuaaagccacgcgggaggcgcagaagcgcaccgcagcgggcaucaugaagaacccaacggucgacgguauaacugucauagaccucgagcccaucagcuacgaccccaaguucgagaaacagcugggccagguuaugcugcucguccugugcgccgggcagcugcucuuaaugcggacgacaugggccuuuugcgagguguuaacucucgcgaccggcccgauccugacgcugugggaggggaacccuggccgcuucuggaacaccaccaucgccguguccaccgccaacaucuuucgggguagcuauuuagccggggccggccuggcguuuagccucaucaagaacgcccaaacuccccggcgugggaccggcaccgccggggagacgcucggggagaaguggaagcgccagcugaacucgcuggaccggaaggaguucgaagaguauaagcgcuccgguauccucgaggucgaucggacggaggccaagucggccuugaaagauggguccaaaaucaagcaugcggugucccgcggguccagcaagauacgguggaucguggagcgcgggauggucaaacccaagggcaaggucguggaccuggggugcggccgcggcgggugguccuacuacauggccacccuuaagaacgucaccgaggucaagggauacaccaagggcggaccgggacacgaggagcccauucccauggccaccuauggcuggaaccuggucaagcugcacagcggagucgacguguucuacaagcccacggagcaggucgacacacuccugugcgacaucggcgagagcuccucgaacccgaccaucgaggagggccggacccugagaguccucaagaugguggagcccuggcucucaagcaagcccgaguucuguaucaaagucuugaaccccuacaugccgacgguuaucgaggaguuggagaagcuccagcggaaacaugggggcaauuuggugaggugccccuuguccagaaacagcacccacgagauguacuggguguccggcgccagcgggaauaucguguccagcgugaacaccacguccaagaugcuccugaaccgcuucacgacccggcaucgcaagcccaccuacgagaaggacgucgaccugggcgcagggacacggagcguguccacggagauagagaagcccgacaugaccaucauuggccgccggcuccagcgccugcaggaggaacacaaggagaccuggcacuacgaccaggaaaacccuuaccggacgugggccuaucacgguagcuacgaggcccccucgacuggcucugccuccagcauggugaacggagucgucaaguugcucaccaaaccuugggacgugauacccauggucacccaacuggccaugaccgacacgacccccuucgggcagcaacggguguucaaggagaaaguggauaccaggacgccccagcccaaaccgggcacgcgcauggucaugaccacaacagcgaacuggcugugggcccuauuaggaaagaagaaaaaccccaggcugugcacgagagaggaguucaucuccaagguuaggucaaacgccgccaucggugcuguguuccaggaggagcaaggguggaccagcgcguccgaggcagucaacgacagcagauuuugggagcucguggacaaggagcgggcccuccaucaggagggcaaaugcgaguccugcguguacaacaugaugggcaagagagagaagaaacuuggggaguucggucgcgccaaagggagccgggccauaugguacauguggcugggcgcccgguuccucgaguucgaggcccugggguuucucaacgaggaccacugguucggccgggaaaacuccuggagcggcguugagggggagggccugcaccgccugggguacauccucgaggagauugacaagaaggauggcgaccugauguacgcugacgacaccgccgggugggacacucggaucacggaggacgaccugcaaaacgaggaacucaucaccgagcaaauggcgccccaccacaagauccuggcgaaggccauauucaagcugaccuaccagaacaagguggugaagguccuucgccccaccccgcgaggggcgguaauggacaucaucucccgcaaggaccagcgggggucuggccaagucggcaccuacggucugaacacuuucaccaacauggagguccaacugauccgccagauggaggcugagggcgugaucacccaggacgacaugcagaaccccaagggccucaaggagcggguggagaaguggcuucgcgagugcggggucgaccggcuaaagcgcauggcaaucuccggcgacgacugcguggugaaaccacucgacgagcgguucgguaccagucugcuguuccuaaacgacaugggaaagguccgcaaggacaucccacagugggagccgagcaaaggguggaagaacuggcaggaggugcccuuuugcucccaccacuuccacaagaucuucaugaaggacggacgcucccugguugugcccugccgcaaucaggacgagcugauuggcagagcgcgcaucagccagggggccggauggagcuuaagagaaacggcgugccuggguaaggccuacgcucagauguggagccugauguacuuccaccggcgcgaccucagacuugccuccauggccauaugcagcgcagugccuaccgagugguucccgaccagccgcaccacguggagcauacacgcccaccaucaguggaugaccacagaggauaugcuuaagguguggaaccgggucuggaucgaggacaaccccaacaugaucgacaaaaccccuguacacucuugggaggacauucccuaucucggcaagcgcgaagacuuaugguguggaucccuuaucggccucagcucccgggcgacgugggccaagaacauccacaccgccaucacucaggugcgcaaccugaucggcaaggaggaguacgucgacuacaugagcgugaugaagcgguauuccgcgccgucagaguccgagggggugcuguga

SEQ ID NO: 26312 - RNA, 9867 nt, Artificial Sequence
  derived and/or modified CDS sequence (opt11) from DENV-4__KJ579240__SS-prME
ucuaccaucacccugcucugucugauccccacggucauggcuuuccaccuaagcaccagagacggcgagccgcucaugauagucgcaaaacaugagagggggcgaccccuacuguucaagacaacggaggguaucaauaagugcacgcugauugccauggaucucggggaaaugugcgaggacaccguuacuuacaaaugcccacugcucgugaacaccgagcccgaagacaucgacuguuggugcaaccugacuuccaccugggucauguacggcacuugcacccaguccggggagagaagacgugaaaagcgaagcguggcccugacgccccacuccggcaugggccuugagaccagggccgagaccuggaugaguagcgagggggcauggaagcacgcgcagagagucgagucguggauucugcgcaaccccgguuucgcucuccucgcuggguuuauggccuacaugauaggccagaccgggauccagagaacggucuucuucguguuaaugauguugguggccccuagcuauggcaugcggugcgucggcguggggaaccgcgacuucguggagggugucagcgggggcgcguggguggaccucgugcuggaacauggcgggugcgugaccacuauggcccagggcaagccaacacuggacuuugagcucacaaagaccaccgccaaggagguggcccuccugagaaccuauugcaucgaggcucucaucuccaacaucacgacugcaacccgcugccccacccaaggggagcccuaccuuaaggaggaacaggaccagcaguacaucugucggcgagacguugucgaccgaggcugggggaacggcuguggccuguucgggaagggcgggguggucacgugcgcaaaguuuagcuguuccggcaagaucacugguaaccucguccagaucgagaaccuagaguacaccguuguuguaaccguacauaauggcgacacgcaugcggucggcaaugacaccagcaaccauggggugaccgccacaaucacgccccgcagcccgagcguggagguaaaguuaccggacuacggcgagcucacccuggacugugaaccccgguccgggaucgauuuuaacgagaugauccugaugaagaugaagaagaaaaccuggcucguacacaagcaaugguuccucgaccugccccuucccuggaccacuggcgccgacacaagcgaaguacacuggaacuauaaggaacgcaugguaaccuucaaagugccgcacgcgaagcggcaagacgugaccguccuggggagucaagagggagccaugcacagcgcccuggcaggcgccacagaaguggacagcggggaugggaaccacauguucgcgggacaccucaagugcaaggugcgcauggagaagcugcgcaucaaaggaaugucguacacgauguguagcgguaaauucucuaucgauaaggagauggccgagacccaacacgggacgacagucgugaaggugaaguaugaaggagcuggcgcccccugcaaggucccaauagagauacgggauguaaacaaagagaaaguggugggacgaguaauaucggccacgccccuggcggagaauaccaacucgguaacaaauaucgagcucgagccgcccuuuggggacagcuacaucgucaucggcgugggcaacucagccuugacccugcacugguuccgaaaaggguccucuaucggcaagauguuugaaagcacguauagaggcgccaagcggauggccauccucggcgagaccgcgugggauuucggguccgugggcgggcuguucacuagccuggggaaagcgguccaccagguguucggcuccguguacaccacgauguucggcggugucaguuggaugaucaggaucuugaucggguucuuaguucuauggauuggcaccaacucccggaacaccagcauggcggugaccugcaucgccgucggcgggauuacgcuguuucuaggcuuuaccgugcaggccgacaugggguguguugucagcuggagcggccgcgagcugaagugcgggagugggauauuuguggucgacaauguccacaccuggacggaacaauacaaguuccaaccggagagccccgcucggcuggccucagccauccucaacgcccacaaggacggcgugugcgggauccgcuccacgacucggcuagagaacgugauguggaaacagaucacuaacgaguuaaacuacguccucugggagggcgggcaugaccuaaccgugguugccggcgacgucaaaggcguacugacgaaggguaagcgagcguugaccccgcccgcuagcgaucuuaaguacucauggaagaccugggguaaggccaagaucuucacuccagaggccaggaacucuaccuuucugaucgacgggcccgauacuuccgagugcccgaacgagaggcgggcauggaauagcuucgagguggaggacuacgguuucgggauguucaccacgaacaucuggaugaaguuccgagaggguuccagcgaagucugcgaccaccggcucauguccgcagccaucaaggaccaaaaggccgugcacgcagacaugggguacuggauugagagcuccaagaaccagacguggcaaaucgaacgugcgucccugaucgaggugaagacgugcuuauggccuaagacacauaccuugugguccaaugguguccuggagucccagaugcugauacccaaguccuacgccgggccuuucagccagcacaacuaucggcagggguacgccacccagacggugggcccuuggcacuuaggcaagcuggagaucgacuucggcgagugcccgggaacgaccgugacuauacaggaaaauugcgaucaccgcgggcccucccugcgcacaaccaccgccagcggcaagcucgucacgcaguggugcugucggagcugcacgaugccucccuugagguuucugggggaggacggcugcugguauggcauggagauuaggccacucuccgagaaggaggagaacauggucaagagccagguuaccgccggccagggcacguccgagaccuuuagcaugggccugcucugccucacguuauucguggaggagugccugcgccggagagugacucggaagcacaugauccucgcggucgucauaacgcugugugccauuauauuaggcggccucaccuggauggaccuuuuacgagcccucauaaugcugggggacacgauguccggacggaucgggggccaaacccacuuagccaucaucgccguguucaagaugagccccggauacguccucggcguguucuugcgcaaacugaccucccgggagaccgcgcucauggugauagggauggcgaugacgaccacccugucgaucccccacgaucugauggagcucauagacggcaucucacuuggccugaucuuauugaagaucgucacccaguucgacaacacgcagguagguaccuuagcccuuagucugaccuucaucagguccacaaugucccuuguaauggcguggagaaccauaauggccguccucuuugucgugacccugaucccgcugugucggaccuccugucuccagaaacagagccacugggucgagaucacugcuuugaucuuaggcgcccaggcccucccuguguaccugaugacgcugaugaagggagccucucggcgcagcuggccccuuaaugagggcaucauggcggucggauuggugucccuacucggaucagccuuauugaagaacgacgugccguuggccggaccgaugguggcagggggccuccugcucgccgccuacgucauguccgggagcagcgccgaucugucacuggagaaggccgccaacgugcagugggacgaaauggccgauaucaccggcagcucccccaucauagagguaaagcaagacgaggacgggucauucuccauccgcgacguagaggaaaccaauaugaucacacuccugguuaagcuggcgcucaucacggugucgggccuguacccacuggccauaccgaucaccaugacccucugguacauguggcaggucaagacccagcgcagcggcgcccugugggacguccccucacccgcugccacccagaaggccgcacuguccgaggggguguaccggaucaugcagcgcggccucuucgggaagacacagguuggcguagggauccacauggagggcguuuuccacaccauguggcacguaacccgaggcagcguuaucugucacgagaccgggcgccuggaacccuccugggcggacgugaggaacgacaugauaaguuacggcgggggauggcgguugggugacaaaugggacaaagaggaggacguccaagugcucgccaucgagccggguaagaaccccaaacaugugcaaaccaagcccggccuguucaaaaccuuaaccggggaaaucggugccgucacgcucgacuucaagcccgggacguccgguagcccgaucauuaaccguaaaggaaagguuaucggacuguauggaaauggggugguaaccaagucgggcgacuaugugagcgcuauaacccaagccgagcggaucggagaaccugacuacgagguggacgaagauauauuccguaaaaagcgucugaccaucauggaucuccaucccggcgcaggcaagacgaagcgcauccugccgucaaucguccgggaagcccuuaagcgucgacuccgcacucucauccuggcgcccacccggguaguggcggccgagauggaggaggcccugcgcgggcuuccaauuagguaccaaacgcccgccgucaagagcgagcauacgggccgcgagaucguggaccugaugugccacgccaccuucaccacccggcuccuauccagcacucgagugccuaacuacaacuugaucgucauggacgaggcacacuucaccgacccuucguccguggcggcccgaggguauaucagcaccagagucgagaugggggaggccgccgcuaucuucaugaccgccacgcccccgggagcuacagacccguucccgcaguccaacagccccauagaggacaucgaaagggagauccccgagcgcucguggaacaccggcuucgauuggaucaccgauuaucagggcaagacggugugguucgugccgucuaucaaggccgggaaugauaucgcuaacugcuuacgcaaguccggcaagaaggugauccagcucagccggaagaccuucgacaccgaguaucccaagacgaagcugacggacugggacuucguggugaccacggacauuuccgagaugggggccaacuuccgcgccggccgggucauagacccaaggcggugccuaaagcccgugauccucacagaugggccugagagaguuauacuagcuggcccgauccccgucacgcccgcgagcgccgcccagcgacgaggcaggauagggcgcaacccggcacaggaggaugaccaguacguguucuccggcgacccccugaagaacgaugaggaucacgcccauuggaccgaagcgaagaugcuccuggauaacauauacacacccgaggguaucauacccacccuguucggcccggaacgggagaagacccaggccaucgacggcgaguuccgcuuacguggggagcaacgcaagaccuucgucgaguugaugcggaggggcgacuuaccaguaugguugagcuacaagguggccuccgcgggcaucaguuauaaagacagagaguggugcuucaccggcgagaggaacaaucaaauccuggaagaaaacauggagguggagaucuggaccagggagggugagaagaagaagcuucgcccgaaguggcucgacgcccgggucuacgcugaccccauggcccugaaggauuucaaggaguucgccuccgguagaaagagcaucaccuuggauauccucaccgagaucgccucgcuaccgaccuaccugagcagcagagcgaagcucgcgcuggacaacaucgugaugcuacacaccacggaacggggcgggcgcgccuaccagcacgcccucaaugagcugcccgagagcuuggaaacccucaugcucguggcccuucugggcgccaugaccgccgggaucuuccucuucuuuaugcaggggaaggggaucggcaagcugagcaugggccugauuacgauugccgucgccagcgggcugcuguggguagccgagauccaaccccaguggaucgcggcaagcaucauccuggaguucuuccugauggugcugcucaucccggaacccgagaaacagcgcaccccccaggauaaucagcugaucuaugucauccugaccauccuaacaaucauuggccugaucgccgcgaacgagauggggcugaucgaaaagacaaaaaccgacuuugguuuuuaucaggugaagacggagaccaccauccuugacguggaccugcgcccggccuccgcuuggacccuguacgcgguggccacgaccauacucacaccgaugcugcggcacacgaucgagaacaccagcgccaaccugucccucgccgccaucgccaaccaagcugccguacucaugggauugggcaagggcuggccccuccaccgcauggaccugggggugccccugcucgccauggguugcuacucgcaggucaacccuacgacccugacugcgucccuggugaugcuccugguccacuacgcgauuaucgggccuggccugcaggccaaggccacaagagaggcgcagaagcguaccgccgccgguaucaugaagaaccccaccgucgacgguauaacggugaucgaucuugaacccaucagcuaugaccccaaguucgagaagcaacucggccagguaaugcuucucguucuaugcgcgggacagcugcuccuaaugcggacuaccugggcuuucugcgaggugcugacccucgcgaccggcccuauucugacgcugugggaagggaaccccggccgcuucuggaacaccacgaucgccguguccacggccaacaucuuucgggggagcuaccucgccggggccggacuugcguucucccuuaucaaaaacgcccagacgccacgccgggggaccggcacagccggggaaacccucggcgagaaguggaagagacagcugaacagucuggaccggaaggaguucgaagaauacaagagauccgggauccucgaggucgaccggaccgaggcgaagagcgcccuuaaagacgggucgaagauaaagcacgcugucucuaggggaucaucgaagauccgguggaucguggagcggggcauggucaagcccaaggggaaagugguggaccugggaugcggcaggggcggaugguccuauuacauggccacgcuaaagaauguaaccgagguuaagggcuacaccaagggggguccggggcacgaagagccgaucccgauggccaccuauggcuggaaucuggugaaacugcacaguggcgucgacguguucuauaagcccacagagcagguggacacccuccugugcgacaucggggagagcucgagcaauccgaccaucgaggaaggccggacccuuaggguccucaaaaugguagagccguggcugucuagcaaacccgaguucugcauaaagguccugaacccauacaugccgaccgucauugaagaguuggagaagcuccagcggaagcaugggggcaaccuggugaggugcccguuaucucggaacagcacgcacgaaauguacugggucagcggugcaagcggaaacaucguguccagcguaaacaccaccuccaaaaugcuccuaaaccgcuucaccacccgccacagaaaacccaccuaugagaaagacgucgaccugggggcagguaccagaagcguauccacggagaucgaaaagcccgacaugaccaucaucggccgccgguugcagcgccugcaggaggaacacaaggagacauggcacuacgaccaggaaaauccguaccggacgugggccuaccauggaagcuacgaggcuccaucaacuggcagcgccuccagcaugguuaacggcgucgugaagcugcugaccaagccaugggacgugauuccgaugguuacccaacuggcgaugacggacacgaccccguucgggcagcagcgcguguucaaggagaagguugacacccggaccccccagccuaagccgggcacgcguauggucaugacaaccaccgcgaacuggcuaugggcacuccuggguaagaagaaaaacccccgucugugcacgcgcgaggaguucaucaguaaggugcggagcaacgccgccauaggcgcuguguuccaggaggagcaggguuggaccucagcguccgaagccgucaaugauagccgcuuuugggagcuuguagauaaagagcgggcacugcaccaggagggcaagugcgaguccugugucuacaacaugauggguaagcgcgagaagaagcugggggaguuuggccgugccaaggggucacgagccaucugguacaugugguuaggcgcucgcuuccuugaguucgaggcccucggguuccucaacgaagaucauugguucgggcgagagaacuccuggaguggggucgagggcgagggcuuacaccgcuuaggguauaucuuagaggaaaucgacaagaaggacggugaccuaauguaugccgacgacacugcaggcugggacacaagaaucaccgaggacgacuugcagaacgaggagcucaucaccgagcagauggcaccccaccacaagauccuggccaaggccaucuucaaacugacauaccaaaacaaagugguaaagguccucaggccgacuccgcggggggccgucauggacauaaucucacgaaaggaccaacggggcagcgggcaagugggcaccuauggucugaacacuuucaccaauauggaggugcaacugauaagacagauggaggccgagggagugaucacccaggacgacaugcagaacccuaagggucucaaggagcggguagagaaguggcugagagagugcggggucgaccggcugaaacgaauggcgaucuccggggacgacuguguggucaagccucuggacgagagauucgggaccagccuccuguuccucaacgacauggguaagguccgaaaggacaucccccagugggagccguccaaggguuggaaaaacuggcaggaaguaccuuucugcagccaccacuuucauaagaucuuuaugaaggaugggcggucccuggugguccccugccgcaaccaagaugagcucaucggccgggcccgaauaucacaaggggccggguggagucuccgcgagacggccugccuggggaaagccuacgcgcagauguggagccugauguacuuccaccggcgugaccuucgacuggccuccauggccaucugcagcgccgugcccacggaaugguuccccacaucucgcaccacgugguccauccaugcccaccaccaguggaugaccacugaggacaugcuaaagguuuggaacaggguguggauugaggacaaccccaacaugaucgauaagacuccagugcacagcugggaggauaucccauaucuuggcaagcgcgaggaccuguggugcggcuccuuaauuggccucagcucccgggcgacaugggccaagaauauucauacugccaucacccagguacgcaacuugaucggcaaggaggaguaugucgacuacaugagugugaugaagcgguacucagccccgagugaguccgaggggguccuguga

SEQ ID NO: 26313 - RNA, 9867 nt, Artificial Sequence
  derived and/or modified CDS sequence (opt11) from DENV-4__KJ596658__SS-prME
agcaccaucacgcugcuaugccugauaccuaccgugauggcuuuccauuugagcacccgcgacggcgaaccgcucaugaucguagccaagcacgaacgggggcgcccccuacucuuuaaaaccaccgaaggcaucaacaaaugcacucugaucgcgauggaccugggggaaaugugcgaggacaccgugaccuauaagugcccacuccuagugaacaccgagcccgaggauaucgacugcuggugcaaucucacgucaaccugggucauguacggaaccugcacccagaguggggagcggcgccgggaaaagcgcagcguugcccugacuccgcacucgggcaugggccucgagacgcgggcagagaccuggaugaguucugagggggccuggaagcacgcccagcgagucgaaaguuggaucuugcgcaacccgggcuucgcgcuguuggcugguuucauggccuacaugaucggccagaccgggauccagaggacggucuucuucgugcuaaugaugcuagucgcccccuccuacggcaugcggugugucggcguugggaaccgcgauuucguugagggcguuuccgggggcgcuuggguagaccucgugcuggagcacggcgggugugugaccaccauggcccagggcaagcccacccuugacuucgaguuaacgaagaccaccgccaaggaagucgcccuccugcggacguauuguaucgaagccuugauuuccaauauuacuaccgcgacccgcugcccaacccagggggagcccuaccuaaaggaagaacaagaucaacaauacauauguagacgcgacguggucgaccggggaugggggaauggcugcggccuguucgggaagggcggggugguuacaugugcuaaauucucuugcuccggcaaaaucaccgggaaucuuguacaaaucgaaaauuuagaguacacaguuguggugaccguacacaauggcgacacucacgccgucgggaacgacacaagcaaccacggcguuacugccacgaucacgccccgcagccccagcguggaggucaagcucccagacuacggugagcucaccuuggacugcgagcccagguccgggaucgacuucaacgaaaugauccugaugaagaugaaaaagaagaccuggcuggugcacaaacaaugguuccuggaccugccccuccccuggaccaccggcgcugacacuagcgaggugcacuggaacuauaaggaacggaugguuaccuuuaagguaccgcaugcgaagcgccaggacgugaccguccuuggcagccaggagggcgccaugcauuccgccuuagcgggcgccacggaaguggacucgggggauggcaaccacauguucgcggggcacuuaaaaugcaagguccgcauggaaaagcuccgaaucaagggcaugaguuacaccauguguagcggcaaguucagcauagacaaggaaauggccgagacacagcacgguacgaccgucguaaaggucaaguacgaaggcgcgggggccccgugcaagguccccaucgagauccgggaugugaacaaagagaaaguggucggccgcgucauuagcgcuacgccccuggcggagaacacaaauuccgugacuaacauugagcuagagccgcccuucggggauaguuauaucguuaucggugugggcaacagcgcacuaacccuccacugguucaggaaaggcagcuccauugguaagauguucgagagcacguaccgcggggcgaaacgcauggcuauccugggcgaaacagccugggacuuuggguccguagggggccuguucaccagccugggcaaggccguacaccagguguucggcagcguauacaccacgauguucgggggagucucguggaugauccggauucucaucggcuuccuagugcuguggauuggcaccaauagccggaacacuucaauggcuaugaccugcauagcugucggcgggaucacgcuguuccucggcuucaccgugcaggccgauauggggugcguagugucauggagcggucgggaacugaagugcgguucuggcaucuuuguuguggacaacgugcauacauggaccgaacaguacaaguuccagcccgagagcccagcccggcuggcuagcgccauacucaaugcccauaaggacggggucugugggauuagaagcacgacucgguuggagaacguaauguggaaacagauuaccaacgaacugaacuacguuuuaugggaaggcggacaugaccucaccgucguggccggagauguuaaaggggucuuaaccaaagggaaacgcgcucucaccccgccggccagugaccugaaguauucauggaagaccugggggaaggcgaaaaucuucaccccggaagcccguaacuccacguuucugaucgacgggccagacaccagcgaguguccaaaugagcgccgggccuggaacagcuucgagguggaggacuauggcuucgggauguucacaacgaacauauggaugaaguuccgcgaggguuccagcgaggucugcgaucaccgcuuaauguccgcagcgauaaaagaccaaaaggccgugcaugccgacaugggcuacuggauagagucgaguaaaaaccagaccuggcagauagagcgcgcgucucuaaucgagguaaagacaugccuuuggcccaaaacgcacacacucugguccaacggggugcuggagagccaaaugcugaucccgaaguccuacgccggccccuuuucacagcacaacuaccgacagggguacgccacccaaacgguagggcccuggcaccucggcaaacuugagaucgauuuuggcgaguguccgggcaccaccgucaccauccaggaaaauugcgaccaucgcgggcccucccucaggaccaccaccgccucaggcaagcucguuacccagugguguugccggaguugcacaaugccgccccugcgguuccucggggaggauggcugcugguacgguauggagauccggccccucuccgagaaggaggagaacaugguuaagagccaggugacagccggccaaggaaccuccgagaccuucagcauggggcugcugugccuuacgcuauucgucgaggagugccugcgccggcgcgugaccagaaaacauaugauccucgcuguggucaucacccuaugcgcaaucauccugggugggcucacauggauggacuuacugcgugcccucauuauccugggggauacgauguccggccggauaggaggccagacacauuuagccauuauggccguguucaaaauguccccgggguaugucuuagggguauuccuacgcaaguugacaucacgggagacagcauuaauggugaucggaauggcaaugacgaccacguugucgaucccgcacgaccugauggagcucauugacgguauaagccugggccugauccuacugaagaucguaacccaguucgacaauacgcagguugguacccucgcccucagcuuaaccuuuauacgcucuaccaugagucuggugauggcuuggcggacgaucauggccgugcuauucguggugacacugaucccgcuuugccguaccuccuguuugcaaaaacagagccacuggguggaaaucacggcgcugauccugggggcacaggcccuccccguuuauuugaugacgcugaugaagggagcaucacggagaagcuggccccucaacgagggaaucauggccguggggcuggugagcuuauuagguucggcguuguugaagaacgacgucccgcucgccgggcccaugguggcagggggacugcuauuggcggcguacgugaugucugggagcagcgccgacuuaagccuggagaaggccgcuaacguacagugggacgagauggccgauauuacgggaagcuccccgaucauugaggugaagcaggacgaagacgggagcuuuucaauacgggauguagaggaaaccaacaugauuacgcucuuagucaagcuggcgcucauaacgguaagcggucuguauccacuggccaucccaaucaccaugacccucugguacauguggcaagugaagacgcagcguagcggcgcucugugggacgucccuucaccagcggccacccagaaggcggcccuauccgagggaguauaccggaucaugcagcgcggccucuucgggaagacacagguuggcgucggaauccauauggaagguguguuccauacaauguggcacguuacccggggcucugucauaugccacgagaccggucgacuugagccguccugggcagacgugcgcaacgauaugauuucauauggagggggcuggcggcugggcgacaagugggacaaagaagaagacgugcagguccucgccaucgagccugguaagaaccccaaacacgugcaaacgaagcccgggcuguucaagacgcucaccggggagauaggggccguuacacuagacuuuaagcccgggaccuccgguagcccgauaauuaaccggaaagguaaggucauaggauuguauggaaacgggguggugacuaaguccggagauuacgugagcgcuaucacacaggccgagcguaucggcgagcccgacuaugagguggacgaggacaucuucagaaagaaacgguuaaccauaauggaucuccacccgggugccggcaagacgaaacgcauacugccguccaucgugcgggaagcauugaagcgacggcugcguacgcucauccuggcgccgacccgggugguggccgcagagauggaggaggcacuacgcggacuucccauccguuaccagacccccgccgucaagagcgagcauaccggccgggaaaucguggaccucaugugccaugcgacuuucacaacccgccugcucucaaguacucgggugcccaacuacaaccugaucgugauggacgaggcccauuuuaccgaccccagcaguguggcagccagagguuacaucagcaccaggguggaaaugggcgaagcggcggccauuuucaugaccgcgacgcccccgggggcaacagaccccuucccccagagcaacucgcccaucgaagacauugagcgggagauccccgagcgcagcuggaacaccggcuucgacuggaucacggacuaccagggcaagacaguaugguuuguaccgagcaucaaagccggcaacgacaucgccaauugccugcgcaaauccggcaagaaggugauucagcucucgcggaagaccuucgacaccgaguaucccaagacuaagcugacggacugggacuucguggugaccacggacaucuccgagaugggggccaacuuccgcgccggccggguuaucgacccucgccggugccucaagccugucauuuugacggacgguccugagcgcguaauucuggccggcccaauaccggugacacccgcuagugccgcccaacggcgagggcgaaucgggagaaauccggcacaggaggacgaccaguauguauucuccggcgacccccugaaaaacgacgaggaucacgcccacuggacggaggccaaaaugcugcuggacaacaucuacacccccgaggguaucauccccacccuguucggcccggagcgggagaaaacucaagccauugauggcgaguuccgacucagaggggaacagcggaagaccuucguugagcugaugcgacgcggcgaccugcccguuuggcucagcuauaaggucgcguccgccggaauaucauauaaggacagggagugguguuucacaggcgagcgcaacaaccagauccuggaagaaaauauggagguggagauuuggacccgggaaggggagaagaagaagcuacggcccaaauggcucgacgcccguguauaugcggaccccauggccuugaaggacuucaaggaguucgccuccggccgaaaguccaucacccuugacauccucacggaaauagccucccugccaacguaccucagcucccgcgccaagcucgccuuagacaauauuguuaugcuacacaccaccgagagaggagggcgcgccuaccagcacgcuuuaaacgagcugccugagucccuggagacacuaaugcugguggcacugcucggugcgaugacugcuggcaucuuccuguuuuucaugcagggcaaagguauaggcaagcugucgaugggacucauaaccaucgccguugccucuggucuguuauggguggcggagauccagccccaguggauagccgcguccaucauuuuggaguucuuucugaugguacugcuaauuccggagcccgaaaagcagcggacaccccaggacaaccagcucauauacgugauccugaccauucucacgauaaucggccuaaucgcugccaaugagaugggccuaauagagaagacuaagacagacuuuggcuucuaccaggugaagacugaaacuaccaucuuagacguggaccuccggcccgccuccgcauggacacuguaugccgucgccacgaccauucucacgcccaugcugcggcacaccaucgagaauacgagcgccaaccuuucccucgccgcaaucgcaaaccaggccgcggugcugauggguuuaggaaaagguuggcccuugcauaggauggaccuaggagucccccugcuggccaugggcugcuauagccaggugaacccuaccacucucaccgccagccuugucaugcuccuggugcacuacgcgauaauaggccccggucugcaggccaaggccacgagagaggcucagaagcgcacugcugccgguaucaugaagaacccuaccguggacggcaucacugucaucgacuuagaacccaucucuuaugaccccaaguuugagaagcaguuaggacaggugaugcugcucgugcugugugccgggcaauuacuccugaugcguacgaccugggccuuuugcgagguccugacacuggcgacugguccuauccugacgcugugggaggguaauccuggucgcuuuuggaacaccacgauagccguguccacagcaaauaucuuccgggguagcuaccuggcaggggccgggcuagcuuucagucugaucaaaaacgcccagacaccccggcgggggacagggacggccggggagaccuuaggugagaaguggaagcgccagcucaacucucuggaccgcaaggaguuugaggaauacaagcgcucggggauccucgagguugaccggaccgaggccaagucggccuugaaggauggguccaaaauuaaacaugcgguaucucgcggcagcucgaagaucagguggaucguggaacgggggauggugaagccgaaggggaaggucguagacuuaggaugcggccgaggcgggugguccuacuacauggccacgcuuaaaaacguuaccgaagucaagggcuacaccaaaggugggcccgggcaugaggagccgauaccuauggcaaccuacggguggaaccugguaaaauugcauuccgggguggacgucuucuacaagcccacagaacagguggacacacuacucugugacauuggggagucuagcuccaacccgacaaucgaggagggccggacccuucgcguacuaaagauggucgaaccauggcucucgagcaagcccgaguucugcaucaaagugcugaacccguacaugccgacagugaucgaggagcuggaaaaauuacagaggaagcacgggggcaaucuagucaggugccccuugucccggaacagcacacaugagauguacugggucagcggagcuuccgggaacaucgucuccagcguaaacaccacaaguaagaugcucuugaaccgguuuacgacccggcaccgcaaaccuacuuacgaaaaagacguggaccuuggcgcgggcacccggagcguauccacggagaccgaaaagcccgacaugaccauaauuggcaggcggcuccagcgccugcaggaagaacauaaggagaccuggcauuacgaccaggagaauccuuacagaacgugggcuuaccaugggucguacgaagcaccgucgacuggcagcgcuucauccauggugaacggcguggugaaguuacucaccaagcccugggacgugaucccgauggugacccagcuggccaugacugauaccacccccuuuggacagcaacgcgucuuuaaggagaaaguggacacacggacgccacagcccaagccgggcacccggauggugaugacgacuacggcgaauuggcugugggcucuccucgggaagaagaagaacccccggcuguguaccagggaagaguucaucuccaaaguccguucaaacgccgcaaucggcgccguguuccaagaggagcaggguuggaccucugcgagugaggcggugaacgacagucgcuuuugggaauuagucgacaaggagcgggcccuccaucaggagggcaagugcgaaucuugcguguacaacaugauggguaagcgugagaagaagcugggcgaguuuggccgcgccaaggggagucgggccaucugguacauguggcuaggcgcacguuuucuagaguuugaggcccucggauucuuaaacgaggaucacugguucggucgggagaacucauggagcgguguggagggggagggccuacaccgccugggguacauccucgaggaaauagacaagaaagauggcgaccugauguacgcggacgacaccgccggaugggacacccggauaaccgaggaugaccugcagaacgaggaacugaucacggagcagauggcuccccaucacaagauuuuggccaaggcaaucuucaagcucacuuaucagaacaaggucgugaaaguccuccggcccacaccccgaggugcugucauggacauaauauccaggaaggaucagcgaggcagcggucaagugggcacuuaugggcugaacacauucacgaacauggaggugcagcugauccgucagauggaggccgaaggggucauuacccaggacgacaugcaaaaucccaagggccucaaagagcggguggagaaauggcugcgggaaugcgggguggaccgucugaagcgcauggccaucuccggugacgacugcgugguaaagccccucgacgaaagauucgggacgagccugcuguuccucaacgacaugggcaagguuagaaaagacaucccccaaugggaaccauccaaaggguggaagaacuggcaggagguacccuuuugcagccaucacuuccacaaaaucuucaugaaagacggccgaucccucgucguccccugucgcaaccaggacgaacugaucggccgugccaggauuagccagggggcgggcuggucccucagagagaccgcuugccuggguaaagcauaugcucagauguggagccucauguacuuccaccgucgcgaccuucggcucgcauccauggccaucugcagcgcuguccccaccgaaugguucccgacuagccggacgaccuggaguauucaugcucaccaccaguggaugacgaccgaggacaugcucaagguguggaaccguguguggauagaggauaacccgaauaugauagauaagacaccgguccacucgugggaggauauccccuaccucggcaagcgcgaggaucuguggugcgguuccuugaucggcuugagcucucgggcgaccugggccaagaauauccacacugccauuacccagguacgcaaccugaucggcaaggaggaguauguggacuacaugccggucaugaagcguuauucagccccgucagagagcgagggggugcuuuag

SEQ ID NO: 26314 - RNA, 9867 nt, Artificial Sequence
  derived and/or modified CDS sequence (opt11) from DENV-4__KJ596659__SS-prME
agcaccauuacccugcucugccugauccccaccguuauggcguuccaccuguccacccgcgacggcgaaccguugaugaucguggcgaaacacgaacgggggcggccccugcuguucaagacgacagaagguaucaacaagugcacgcucaucgcgauggaccugggcgaaaugugcgaggacaccguuaccuauaagugccccuugcucgugaacaccgagcccgaggacaucgacugcuggugcaaccugacgagcacaugggucauguacgggaccugcacccaguccggggagcggcgacgggaaaagcgcagcguggcacugacgccgcacucaggcaugggcuuagagacccgggccgaaaccuggaugagcucugagggugcuuggaagcacgcccagcgcguugagagcuggauucugcggaaccccggcuucgcgcugcucgccggguucauggcuuacaugaucggccagaccgggauucagcggacagucuucuuugugcugaugaugcuggucgcucccuccuacggcaugcggugcgucggcguuggcaaccgcgacuucguggagggcgucagcgggggcgcguggguugaccucgugcuggagcacggagggugcgucaccaccauggcucagggcaagccgacccuggacuucgagcucacgaaaaccaccgccaaggagguggccuugcugcggaccuacugcaucgaggcccucauuuccaauaucaccaccgcuacccgcugcccgacccaaggggagcccuaccugaaggaggagcaggaccagcaauacaucugccggcgugacgugguggacaggggcugggggaauggaugcggccucuucgggaagggcggggucgugacgugcgcaaaguucagcugcuccggcaagaucaccgggaaucugguacagaucgagaaccuggaguacaccgugguggucaccgugcacaacggcgacacgcacgcugugggcaacgacaccagcaaccauggggugaccgccacaaucacgcccagaucucccuccguggagguuaagcugccggacuacggugagcucacccuggacugugagccucgguccgggaucgacuuuaacgagaugauccugaugaagaugaagaagaagaccuggcucgugcacaagcagugguuucuggaccugccccuccccuggaccaccggcgcagauacgagcgaggugcacuggaaccacaaggagcgaauggucaccuucaaagugccgcacgcgaagcggcaggacgugacaguccuggggucccaggagggcgccaugcacagugccuuagcgggcgccacggagguggacagcggggacggcaaccacauguucgcggggcaucucaagugcaaggugcgcauggagaagcugcgcaucaagggaauguccuauacgaugugcagcggcaaguucagcaucgacaaggaaauggccgagacccaacacgggacgaccgucguuaaagugaaguacgagggagccggggcccccugcaaaguccccaucgagauccgggacguaaacaaggagaagguugucggccgcgugauaagcgccacgccgcuggcggagaacaccaauuccgugaccaacaucgagcucgagccgcccuuuggggacagcuacaucgucaucggcgucggcaauuccgcccucacgcugcacugguuccggaagggaagcuccaucggcaagauguucgagagcacguaccgcggggcuaagcggauggccauccucggcgaaaccgcgugggacuucggaagugugggcggccuguucaccagccuggggaaggccguccaccagguguucgguuccguguacaccacgauguucggcggcgucagcuggaugauccgcauucucaucggguucuuagugcuguggauaggcaccaauucccggaacaccagcauggcaaugaccugcaucgcugugggugggaucacgcuguuccucggcuucaccguccaggcggacauggggugcgugguuuccuggagcggcagagaacugaaauguggguccggcaucuucgucguggacaacgugcacaccuggaccgagcaauacaaguuccagccugaaagccccgcgcggcuggccagcgccaucuugaacgcccacaaggacggcgucugcgggauccgcaguaccacccggcuugagaacgugauguggaagcagauuaccaacgagcucaauuaugugcuuugggagggcgggcacgaccugaccgucguggcaggcgaugugaaagggguccucacgaaggggaagcgcgcucucacgccgcccgccucugaccugaaguacucuuggaagacguggggcaaagccaagauauucacccccgaggcccggaacagcacguucuugaucgacgggcccgacaccuccgagugcccgaacgagcgccgggccuggaacagcuucgagguggaagacuacggauucgggauguuuaccaccaacaucuggaugaaguuccgcgagggcuccagcgaggugugugaccaccgguugauguccgcggccaucaaggaccagaaggcgguccaugccgauaugggcuacuggauugagagcaguaagaaccagacguggcagaucgagcgcgcgagccugauagaggugaagaccugcuuauggcccaagacccacacccuaugguccaacggggugcuggagucucagauguuaauccccaaguccuacgccgguccguucagccagcacaacuacagacagggguacgcaacccagacggucggccccuggcaccuggggaaguuggagaucgacuuuggcgagugccccggaaccacugugaccauacaggagaacugcgaccaccgcgggcccagccugcgcacgaccaccgccagcggcaagcucgugacccaguggugcugccggagcugcacgaugccgccccugcgcuuccugggagaggaugggugcugguaugggauggagauacggccucucuccgagaaggaggagaacaugguaaagucucaggugacugccggccaggguacauccgagacuuucagcauggggcugcugugccucacgcuguucguagaagaaugccugcgccggagagucacccggaagcacaugauccucgcggucgucaucacccugugugccaucauccugggcggguugacguggauggaucugcugcgcgcgcucaucauacugggggacacgauguccggccggaucgggggucagacccaucuggcuaucauggccgucuucaagaugaguccuggguacgugcucgggguuuuccugcggaagcugaccucccgggaaacugcgcucaugguaaucggaauggccaugacuaccacccugagcaucccgcacgaucugauggagcucaucgacggcaucucccugggcuuaauucuacuuaagaucgugacccaguucgacaacacgcagguugggacacuggcccucagccugacuuucauacgcaguaccaugagccuggugauggccuggcggaccaucauggcuguacucuucgucgucacccugaucccucugugccgcacauccugccuccagaagcagagccacuggguggaaaucaccgcgcugauauuaggcgcccaggcccuccccgucuaccugaugacgcugaugaaaggggccucccggcgcucauggccccucaacgaggguaucauggcgguggggcuggucucccugcucggcagcgcccugcucaaaaacgaugucccgcuagccggccccaugguggcagggggacugcugcucgccgcguacguaauguccgggagcagcgccgaccugagucuggagaaagcggcgaauguccagugggaugaaauggccgauauaaccgguagcucccccaucaucgaggugaagcaggacgaggacgggagcuucuccauccgagauguggaggagacgaacaugaucacccuccuggucaagcuggcgcuaaucacgguuagcggccuguacccccuggccaucccgaucaccaugacccucugguauauguggcaagugaagacccagagguccggcgcccuuugggaugucccgagccccgcagccacccagaaggcggcccugagcgaggggguguaucggaucaugcagcgcggacucuucgggaagacacaggugggcguugggauccacauggaaggcgucuuccacaccauguggcacgugacccggggcaguguuaucugucacgagacagggcgccuggaacccucaugggccgacgugaggaacgacaugaucagcuacggcgggggcuggcggcuaggcgacaaaugggauaaggaggaggacgugcagguccuggcuauagagccgggcaagaacccaaaacauguacagacgaagcccggccuguucaagacccugaccggggagauuggcgcuguaacccuagacuucaagcccgguacguccggcaguccgaucauaaaucgcaaaggaaagguuauaggacuguacggcaacgggguggugaccaaguccggcgacuacguaagcgcgauaacccaggccgagcggaucggggagcccgacuacgagguggacgaggacaucuuccggaagaagcggcugaccaucauggacuugcaucccggcgccggcaagacgaagcgcauccucccguccaucgugcgggaggcccugaagcgccggcugcgcacccucauccuggcgcccacccgggucguggccgccgagauggaggaggcucugcgcgggcuccccauccgguaccagacccccgccguaaagagcgagcacacgggccgcgagaucgucgaccugaugugccaugcuaccuucacgaccaggcuguuauccagcacgcgggugccgaacuauaaccugauugugauggacgaagcccacuucaccgaucccagcuccguagcggcccggggguacaucagcaccagagucgagaugggcgaggccgcggccaucuucaugaccgcuacgccacccggugccacugaccccuucccccaguccaauagccccaucgaggacaucgagcgggaaauaccagagcgcuccuggaacaccggcuucgacuggaucaccgacuaccaagggaagaccgucugguucgugccgucgaucaaagccggcaacgacaucgcgaacugcuugcgcaaguccggcaaaaaggugauccagcucagccggaaaaccuucgacaccgaguacccaaagaccaaacugacggacugggacuucgucgucacaacggacaucucugagaugggggcuaacuuccgcgcaggccgggugaucgauccacgccggugccuuaagccggugauucucacggacgggccggagcgcguaauucuagccggccccauccccgugacgcccgcgagcgcggcccagaggcgcggccggauagggcggaacccggcacaggaggaugaccaguacguuuucuccggcgacccucugaagaaugacgaggaucacgcccacuggaccgaggcgaagaugcuccuagacaacaucuacacccccgaggggaucauccccacacucuucgggccagagagagagaagacgcaggccaucgauggcgaguuccguuugagaggggagcaacggaagaccuucguggagcugaugcgucgcggagaucuuccgguguggcucagcuacaaggucgccucggccgggaucagcuacaaggaccgggaguggugcuucacaggcgagcgcaacaaccagauccuugaggagaauauggagguggagaucuggacccgggagggagagaagaaaaagcuccgccccaaguggcucgacgcccggguguacgcggaccccauggcccugaaggacuucaaggaguucgcgucaggccgcaagucuaucacccuggacauccucacugaaaucgccucccugccuaccuaccugagcucccgcgccaagcucgcgcuggacaacaucgucaugcugcacaccaccgaacggggaggacgcgccuaccaacacgcccucaacgaguugcccgagucgcuggagacgcucaugcugguggcccugcucggugcgaugaccgccgggaucuuccuguucuucaugcaggguaagggaaucggcaagcucagcaugggccucaucacgaucgccguggccagugggcuccugugggucgccgagauccagccccaguggauugcggccagcaucauccucgaguucuuccugauggugcugcucaucccggaacccgagaagcagcggaccccgcaggacaaccaguuaaucuacgugauucuaacgauacucaccaucaucggccugaucgccgccaacgagauggggcugauagagaagaccaagacugacuucggguucuaccaggugaagacggagaccaccauccucgauguggaccugcgccccgccuccgcguggacccuguaugcgguugcuaccaccauucuuaccccgaugcugcggcacacgaucgagaacacguccgcuaaccuuucccucgcagcgaucgccaaucaggccgccguucugauggggcugggcaaaggcuggccccuccaccgcauggaccuaggcgugccccugcucgccauggggugcuauagccaggugaaccccacaacccuuaccgcuucccuggucaugcuccuggugcauuacgcuaucauagguccgggccuccaggccaaagcgacuagagaggcgcagaagcgcaccgccgccggcauuaugaagaacccaaccguggacgggaucaccguuaucgaccuugagccuauuagcuacgaccccaaguuugagaagcagcugggccaggugaugcugcucgugcuuugcgcagggcagcugcucuugaugcggacgaccugggccuucugugaagucuuaacgcuggcgaccggcccgauucugacgcugugggaggggaaccccggccgcuucuggaacaccaccauugccgucuccaccgcgaacaucuuccgggggagcuaccucgccggggcuggccuggccuucagccugaucaagaacgcacagacgccucgccggggaaccggcaccgccggggagacucucggcgagaaguggaagcgccagcugaacagccuggaccggaaggaguucgaggaguacaaacgcucuggcauccuagaaguagaccggaccgaggcaaagagcgccuuaaaagacggguccaagauaaagcaugcgguuagccgcggcuccucuaaaauccgguggauaguugaacgcgggauggugaaacccaagggcaaggucguggaccugggaugcgggcgcggcgggugguccuacuauauggccacucucaagaacgugacggaggucaaaggcuacaccaaaggcggaccggggcacgaggagcccauccccauggccaccuacggcuggaaccugguaaagcugcacagcggcguggauguauucuacaaaccuaccgagcagguagacacccuccugugcgacauaggggagucuuccagcaacccgaccaucgaagaaggucggacccugcgcgugcugaagaugguagagccguggcugucuucaaagcccgaguuuugcaucaaggugcugaaccccuacaugccgacgguaaucgaagaacuggagaagcuccagcgcaagcauggaggcaaccuggucagaugcccccucucacggaacagcacccacgaaauguacuggguguccggcgccucggggaauaucgucagcagcgugaacaccaccuccaaaaugcuccugaaccgcuucacgacccggcaccgcaagcccaccuacgagaaagauguggaccuaggcgcagggacccggagcguuucgacggagaccgagaaacccgacaugacuaucaucggccgccggcuccagagauugcaggaggagcacaaggagaccuggcauuacgaccaggagaauccguaccggacgugggcauaccacgguucguacgaggcccccuccaccggaagcgccuccuccauggugaacggcguggucaagcugcucacuaagcccugggaugugaucccgauggugacccaacuggcaaugacggacacgaccccauucgggcagcagcgcguguucaaggagaaggucgacacccggacgccucagcccaaaccgggcacccgcauggugaugacaacuacggcaaacugguugugggcucucuuggggaagaagaagaacccccggcugugcacccgcgaagaguucaucucaaagguccggagcaacgcugcgaucggcgccguauuccaagaggagcaaggauggaccagcgcuuccgaggcaguaaacgacagccgcuucugggagcucguugacaaggagcgggcccugcaccaagaaggcaagugugagucaugcguguacaauaugaugggcaaaagggagaagaaguuaggggaguuuggccgcgccaagggaucacgggccauuugguacauguggcucggcgcccgcuuccuggaauuugaggcccugggguuccuuaacgaagaccacugguucggucgggagaacuccuggagcgguguugagggggagggccuacaccgccuggguuacauccuggaggagaucgacaagaaagacggcgaccugauguacgccgacgacacagcgggcugggacacgagaaucacugaggacgaucuccaaaaugaagaacucaucaccgagcaaauggcgccccaccacaaaauccuugccaaagccauauucaagcugaccuaccagaacaaagucgugaaggugcuccggcccacgccuagaggggccgucauggacaucaucucccgcaaagaccagcggggaagcggacaggugggcacguacggguuaaacaccuucaccaacauggaggugcagcucauccgccagauggaggcagaaggcgucaucacacaagacgacaugcagaaucccaagggccuuaaggagcggguggagaaguggcugcgagagugcgggguggaccggcugaagcgcauggcgauuuccggcgaugauugcguagugaagccacucgacgagcgguucgggaccagccuacucuuccucaacgacaugggcaaggugcgcaaggacaucccccagugggagccuuccaagggguggaaaaacuggcaggagguccccuuuuguucgcaccauuuucauaaaaucuucaugaaggacggccggucccugguggugcccugccgcaaccaggacgagcugauuggccgggcccgcaucagccagggugccggcuggucgcugcgcgagaccgccugccugggaaaggccuacgcgcagauguggagccugauguacuuccaucgccgcgaccuucgauuggccuccauggccaucugcagcgccgucccgaccgaaugguucccgaccuccagaacgaccuggucuauccacgcccaccaccaguggaugaccacggaggacaugcugaagguguggaaucggguauggauagaagacaaccccaacaugaucgacaagacucccguccacucaugggaggacauucccuaccucggcaagcgcgaggacuuauggugugggucccugaucggccucucaucccgugcgacaugggcgaagaacauccacacggcgaucacccagguccgcaaccuuaucggcaaggaggaguacguggacuacaugccggucaugaagcguuacagcgcccccuccgagagcgaggggguccuguaa

SEQ ID NO: 26315 - RNA, 9867 nt, Artificial Sequence
  derived and/or modified CDS sequence (opt11) from DENV-4__KJ596661__SS-prME
ucuaccaucacccugcucugccuuauccccacggugauggccuuccacuuauccaccagggacggugaaccucucaugaucguugcgaaacaugaacggggccgcccccuucuauucaagaccacugagggcauuaacaagugcacgcucaucgcgauggaccugggggagaugugugaagacaccgugaccuacaagugcccucugcucguuaacaccgagccggaggacauugauugcuggugcaaccugacgagcacaugggucauguacggcaccuguacacaauccggggagagacgccgggaaaagcgaucaguagcccugacgccgcacuccggcaugggccucgagacccgggccgagaccuggauguccuccgagggggcauggaagcacgcgcagcggguugagucguggauccugcggaaucccggcuucgcacugcuugccggguucauggccuacaugauaggccagacagguauccagcgcacggucuucuucguacugaugaugcugguggccccauccuacggcaugcgguguguuggcgugggaaaccgagauuucgucgaaggcgucuccgggggcgcguggguggaccuagugcuggaacacggcggcugugucaccaccauggcccaaggcaagccuacccuggacuucgaacucacgaagaccacagcaaaggaaguugcgcuguuacggaccuacugcaucgaagcacucaucuccaacaucacgaccgcgacccgcugcccgacacagggggagcccuaccugaaagaagaacaagaucagcaauacaucugucgccgcgacguggucgacagaggcugggggaacggcuguggacuguuugggaagggcggaguagugacgugcgcgaaguucagcuguuccgggaagaucaccgggaaucuuguacagaucgagaaucuggaguacacuguuguagucaccguccacaacggcgacacccaugccgucggcaacgacacuagcaaccauggggugaccgccaccaucacgccccgcucccccagcguagaggucaagcugccggacuacggcgagcucacccuagauugcgagccccgguccggcaucgacuuuaacgagaugauuuuaaugaagaugaaaaagaagaccuggcuuguucacaagcagugguuccuggaucugccccuccccuggaccacuggagccgauacuuccgaggugcacuggaacuacaaggagcgcauggucaccuucaaggugccgcacgcgaagcgccaggacguuaccguccuagggagucaggaaggcgccaugcauagcgcccuggccggagcaaccgagguagacagcggggacggcaaccacauguuugcggggcaccucaagugcaaggugcgcauggagaagcugcgaaucaagggcaugucauacacgaugugcagcgguaaguucuccaucgacaaggagauggccgagacccagcacgggaccaccgucguaaaggugaaguacgagggagccggggcccccuguaagguccccaucgagauccgggacgugaacaaagagaaggugguaggcagggugaucagcgccaccccccuggcggagaacacgaacucugugaccaacaucgagcucgagccgcccuucggggacagcuacaucgucaucggggucggcaacuccgccuuaacccugcacugguuccggaaggggagcagcaucggcaagauguucgagucaacguaccgcggugccaaacggauggcgauccucggcgagacugcgugggacuuugggaguguaggcggccuguucacuucgcuugggaaggccguacaccagguguucggcuccguguacaccacgauguucgggggcgucucauggaugauccgcauacuuaucggguuccuggugcuguggaucggcacgaauucccggaacaccaguauggccaugacaugcauagccgucggcgggauuacgcuguuccuuggguucaccguccaggccgacauggggugcguuguaucauggagcggucgcgaacuaaaaugcggguccggcaucuucgucguggauaacguccacaccuggaccgagcaguacaaauuccagcccgagagccccgcgagacuggccucugccauccuaaaugcgcacaaagauggcgucugcgggauccgcucuacgacccggcuggagaacguuauguggaagcagauaaccaacgagcugaacuauguacugugggagggcgggcaugacuuaaccgucgucgcuggcgacgucaagggcguucugacgaagggcaaacgcgcguugaccccgcccgccagcgaccugaaguacaguuggaagacauggggcaaggccaagauuuucacccccgaggcccggaacagcacguuccugaucgacggccccgacaccuccgagugcccgaacgagcgccgggccuggaacucuuuugaggucgaggacuauggcuucgggauguucaccaccaacauauggaugaaguucagagagggcuccagcgaggucugcgaccaccggcuaauguccgcggccaucaaggaccagaaggccguccacgccgauaugggcuacuggaucgagucauccaaaaaccagacguggcagaucgagcgcgcgagcuuaauagaggugaagaccugccuguggcccaagacccauacucucugguccaauggggugcuggagucacagaugcugauccccaaguccuacgcuggcccguucucucagcacaacuaccggcaaggguacgccacccaaacagucggccccuggcaccucgggaagcuggagauagacuucggcgagugccccggcaccaccgugacaauccaggagaacugcgaccaccgagggcccucccugcgcacuaccaccgccagcggcaagcucguaacccaguggugcugucgcagcugcacuaugccgccucugcgguuccugggggaggacggcugcugguacggcauggagauccgcccccucucugagaaggaggagaacauggucaagagccaagugaccgcagggcaaggcacuuccgaaaccuucucuauggguuugcugugccucacgcuguucgucgaggagugcuugcgccggcgcgugacccggaagcauaugauccucgcgguggucaucacgcuuugcgccaucauccugggcgggcucaccuggauggaucugcugcgcgcccuaaucaugcugggcgacacgauguccggccggaucggaggccaaacccaccuggccaucauggcuguguucaagaugucaccaggguacgugcuaggcgucuuccugaggaaacucaccagucgggaaaccgcacucauggugauagggauggccaugacgaccacccugagcaucccacacgacuugauggaacuuauugaugguauuucccugggccugauccugcugaagaucgugacccaguucgacaauacgcaggucggcacccuagcccuaucauuaacuuucauccgcucuacgaugagccuggugauggccuggcggacgaucauggccgugcucuuugucguuacccugauaccgcugugccgaaccuccugccuccagaaacagucgcacuggguggaaauaaccgcgcucaucuugggggcacaggcccucccgguauaccugaugacacugaugaagggcgccagucggcgcagcuggccccugaacgagggaaucauggcgguuggguuaguuagccugcucggauccgcccuguuaaagaacgacgucccgcucgcuggcccaaugguggccggggggcuccugcuugcugcuuacgugauguccgggucgagcgccgaccugucccuggaaaaggccgccaacguccagugggaugagauggccgauaucaccggcagcucccccaucaucgaggugaagcaggacgaggacgggucauucuccauacgggacguggaggaaaccaacaugaucacccucuuagugaagcuggcacuaaucacggugagcggucuguacccccuagcuaucccaauaaccaugacccucugguacauguggcaggugaagacccagcguuccggugcccugugggacguccccagccccgcggcaacacagaaggccgccuuauccgaggggguguaccggaucaugcagcgcggccuauucgggaagacucaggugggcgucgggauccauaucgagggcguguuccauaccauguggcaugugacccgggguagcgugauaugccacgagaccgggcgacuggagcccuccugggccgacgugcgcaacgacaugauuagcuacggcggggguuggcggcuaggagacaaaugggacaaagaggaggaugugcagguccucgcaaucgaaccgggcaagaaccccaagcacguacaaacgaaacccggguuauucaagacccugaccggggagaucggcgccgugacccuugacuuuaaacccggcaccuccggcagcccaaucaucaaucguaaaggcaagguaaucgggcuguacggcaacgggguggugaccaagaguggagacuacgucagcgcgaucacacaagcugagcgcaucggggaaccagauuacgagguggaugaggacaucuuucgcaaaaagcggcuuacuaucauggaccuacaccccggcgccggcaagacgaagcgcauccugccuuccaucgugcgggaggcccugaagcgccggcugaggacccugauccuggcuccaacgagagugguggcagccgaaauggaggaggcccuuagagggcugccgauaagauaucagaccccagccgugaaaagcgaacacacgggccgcgaaaucguugaccugaugugccacgcgaccuucaccacccgguugcucuccagcacgcgcguaccgaacuacaaccugaucgucauggacgaagcgcacuucaccgacccaucguccgucgcugcucggggguacaucagcacccgcguggagaugggugaagccgcggccaucuucaugacagccacgccccccggcgccaccgaccccuucccccaguccaacagccccaucgaggacaucgagcgggagaucccggagcgcuccuggaacaccggguuugauuggaucaccgacuaccagggcaagaccgucugguucgugccgagcauaaaggcugggaacgauaucgcgaacugccuccguaagucgggcaaaaaggugauccagcucagccggaagaccuucgacaccgaauaccccaagacaaagcugaccgacugggacuuugucgugacaacggacaucucugagaugggggcgaacuuccgcgcaggccgggugauagacccccgccggugcuugaagcccgugauccuaacugacgggcccgagcgcgucauucuugccgggcccaucccggugacuccagcgucagccgcccagcggcgcggccgaauagggcgcaacccggcgcaagaggacgaccaguacguauucucuggcgacccccugaagaacgacgaggaccacgcccacuggacagaggcgaaaaugcucuuggacaauaucuacaccccagaggguaucauccccacccucuucggcccggagcgggagaagacgcaggccauagacggcgaguuccggcuccggggugagcagcgcaaaaccuucguggaacuuaugcggcgcggcgacuugcccguguggcucucguacaagguugccuccgcagggauuagcuacaaggaccgggaguggugcuucaccggcgagaggaauaaccagaucuuggaggagaauauggagguagagaucuggaccagagagggggagaagaagaagcugcggcccaaguggcucgacgcccgggucuacgcggaccccauggcccucaaggauuuuaaggaguucgccuccggccgcaagagcaucacccuugacauccucacggaaaucgcguccuuacccaccuaccuaucgucccgcgcaaaacucgcgcuggacaacauugucaugcugcacacaaccgagcggggcgggcgagccuaccaacaugcacugaaugaguugcccgagagccuggagacgcucaugcugguggcccugcucggcgcgaugaccgccgggaucuuccuauucuucaugcagggcaagggcaucggcaagcugagcaugggccucaucaccauagccguggccuccgggcugcuguggguugccgaaauccagccccaguggaucgcggcuagcaucauccucgaguucuuccuuauggugcuccucauaccggagccugagaagcagcggaccccucaggacaaccaguuaaucuaugugauccugacgauccucaccaucaucggccugauugccgccaacgaaaugggccugaucgagaagaccaagaccgacuucggcuucuaccaggucaagacggagacgaccauccucgacguggaccugcgcccagccagcgcguggacccuguacgcaguggccacgacuauccucacccccaugcugcggcauaccaucgagaacacguccgccaaucugucccucgccgcgauagccaaccaggccgcggugcugaugggacuuggcaagggcuggccucuccaccguauggaccugggcgugccccuccucgccauggguugcuacagccaagugaaucccacgacccugacagcuucccugguaaugcucuuggugcacuacgcaaucauugggccgggccuucaagccaaggccacgcgggaagcgcagaagcgcaccgcugccgggauaaugaaaaaccccaccguagaugggaucaccgucaucgaucucgagcccaucagcuaugacccgaaguucgagaagcagcugggccaggugaugcuguuggugcugugcgccgggcagcugcuccuuaugcggacgacaugggccuucugugagguccugacucucgcuaccggcccgacccuuacacugugggaggggaaccccggccgcuucuggaauaccaccauagccgugucgacggcaaauaucuuccgcgguagcuaccuagccggggccggccuggcguucucccucaucaaaaacgcccagaccccccgccgggggaccggcaccgccggggagacccucggagagaaguggaagcgacaguugaacagccuggaccggaaggaauucgaggaguauaagcgcagcggcauucucgaaguugaccggacggaggccaagagcgcccuuaaagacggguccaagaucaagcacgcggugucacgcggcuccucaaagauucgguggaucguggagcgcgggauggugaagcccaaaggcaaggucgucgaccugggcugcggcagaggcgggugguccuacuacauggcaacccucaaaaauguuaccgaggugaagggcuauaccaaagggggcccggggcacgaagagccuauccccauggcuacguacggcuggaaccuggugaagcuccacagcggcguggacgucuucuacaagccaaccgaacagguagacacccuccugugcgacaucggggagagcuccagcaacccgaccaucgaggaaggccggacgcuacgggugcucaagauggucgagccuuggcucuccagcaagccagaauucugcauaaaggugcugaaccccuauaugccgacggugauugaggaguuagagaagcuccagcggaagcacgggggcaacuuggucagaugcccccugucccgcaacucuacccacgagauguauuggguguccggcgcaagcggaaacaucgugucgagcgugaacaccaccuccaagauguugcucaaccgcuucacuacccgacaccgcaagccuaccuacgagaaagauguggaccugggcgcgggcacccggucugucuccaccgagaccgaaaagcccgauaugaccaucaucggccgucggcuccagcgccugcaggaggagcauaaggagacguggcacuacgaccaggagaauccguaccggaccugggccuaccacgggagcuacgaggccccuuccaccggcagcgcgucaagcauggugaacggggugguaaagcugcucacaaagcccugggacguaaucccgauggugacacagcucgccaugaccgacaccaccccauucggacagcagcgggucuucaaagaaaagguggacacgcggaccccccagccaaagccgggcacccgcauggugaugaccacgacggccaauuggcugugggcccuccuggggaagaagaagaacccucggcugugcacccgagaggaguucauauccaaggucagaagcaacgcugccaucggcgccguguuccaggaggagcagggguggaccagcgcaucagaggccgugaaugacucccgcuucugggagcucgucgacaaggagcgggccuuacaucaagagggcaagugcgagucuuguguguacaacaugaugggcaagagggagaagaaacugggggaauucggccgcgccaaaggcucccgcgccauuugguacauguggcucggcgcgcgcuucuuagaguucgaggcgcugggguuccuuaacgaggaccacugguuuggccgggagaauuccuggagcggcgucgagggggaaggccuucaccgccugggcuacaucuuggaggaaaucgacaagaaagacggggaccugauguaugccgacgacacggccggaugggacacccggaucaccgaggacgaccugcagaacgaggagcugauuaccgagcaaauggcaccccaccacaagaucuuggccaaggccauauucaagcugaccuaccagaacaaagucgugaaggugcuccgcccgacaccgcggggggccgugauggacaucaucucccgcaaagaucagcggggcagcggccagguuggaacauauggacugaacaccuucacaaacauggaagugcagcugauacgccagauggaggccgagggcgucaucacgcaagacgacaugcaaaaccccaaggggcucaaagagaggguggagaagugguuacgcgagugcggagucgaccggcugaagagaauggcgaucucaggcgacgacugugucgugaagccccucgacgaacguuuugggaccagccugcuguuccucaacgacaugggcaaggcccggaaggacaucccccagugggagccuuccaagggguggaagaacuggcaggaggugcccuucugcagccaccacuuccacaagaucuucaugaaggauggcagaucguuagucgugcccugccgcaaccaggacgaguugauaggccgggcccgcaucagccagggggcaggguggucccuccgcgagaccgcuugucugggaaaggcguacgcucagauguggucacugauguacuuucaccggcgcgacuugagacuggccagcauggcgaucugcagugccguccccaccgagugguucccaacgagccgcacuaccugguccauucaugcgcaccaccaguggaugacuacugaggauauguuaaaggucuggaaccggguuuggaucgaggacaaccccaauaugauagacaagacgccuguacauaguugggaggacaucccauaucucggaaagcgagaggaccuguggugcggaucgcugaucggccugagcucccgggcuacgugggcuaagaauauccacaccgcaaucacgcagguacgcaaccugaucggcaaagaggaguauguagauuacaugccgguuaugaagcgguacagcgcccccucugaaagugagggaguccuguga

SEQ ID NO: 26316 - RNA, 9867 nt, Artificial Sequence
  derived and/or modified CDS sequence (opt11) from DENV-4__KJ596663__SS-prME
agcaccaucacccuucucugccugauccccaccgugauggccuuccaccuguccacccgcgauggcgagccguuaaugaucgucgccaagcaugagcgggggagaccccuguuguucaaaaccacugagggcauaaauaagugcacgcucauagcgauggaucugggggagaugugcgaagacacugugacuuacaagugcccccuguuaguaaauaccgagcccgaagacaucgacuguuggugcaaccuaacgucaaccugggugauguacggcaccugcacccagucuggggagaggcgccgggagaagcgcagcguagcccugacuccccacuccggcaugggccucgagacccgcgcugagaccuggaugucguccgagggggccuggaagcacgcccaacgcguggagucguggauccugcggaaucccggcuuugcucuccucgcuggguucauggcguacaugaucggccagaccgggauccagaggacggucuucuucguacuaaugaugcugguugccccauccuauggcaugcguuguguuggcguggggaaucgcgauuucguggagggcgucagcggaggcgcguggguggaccuggugcuugagcaugggggcuguguuacuaccauggcccagggcaaacccacccuggacuucgagcucacaaagaccaccgccaaggagguugcguugcugcggaccuacuguaucgaggcccuaaucagcaacaucacgaccgcgacccguugcccaacccagggggagccauaccugaaggaggagcaggaccagcaguacauuuguagacgcgacguggucgaccgggguugggggaacggcugcggccuguucgggaagggagggguggugacgugugccaaguuuagcugcuccggaaagaucaccggaaaccucgugcagaucgagaaucuggaguacacugugguggucaccguccacaacggagacacgcacgccgugggcaacgauaccagcaaccacggggugacugccaccauuacgccgcgcucccccagcguggaggucaagcugccggacuacggggagcugacccuggacugcgagccccgguccggcaucgacuucaaugagaugauacugaugaaaaugaagaagaaaaccuggcucguccacaagcagugguuccuggacuugccccugcccuggaccacaggugccgacacgucagaagugcauuggaauuauaaagaacgcauggucaccuucaagguaccacacgcgaagcgucaggacgugaccguccugggcucccaagagggggcaaugcacagcgcccuggccggcgcaacugagguugacucuggggacggcaaccacauguucgcggggcaccucaagugcaaggugcggauggagaagcuaaggaucaaggggauguccuacacgauguguagcggcaaguucuccaucgacaaggagauggcagagacucagcacgggaccacuguagugaaggugaaauacgagggcgccggggcccccugcaagguuccuaucgagauccgggacgugaacaaggagaagguggucgggcgcgucauaagcgccacgccccuggcggagaacaccaauagugugaccaacaucgaacucgagccgcccuuuggggauagcuauaucgucauuggcgugggaaacuccgcccuaacccugcauugguuucgcaaggggagcuccaucggcaagauguucgagucgacguaucgcggggcuaagagaauggccauacucggugagaccgcgugggacuucggguccgugggcggccuauucacaagccuggguaaggccguccaccaagucuucggcuccguguauaccacgauguucgggggcgugucguggaugaucaggauacucaucggauuccuggugcuguggaucggcacaaacucccggaauacuucaauggccaugaccugcaucgcugugggaggcauuacgcuguucuugggcuucaccguccaggccgacauggggugcgugguuucguggagcggucgcgagcugaaaugcggauccggcaucuucguuguggacaacgugcacaccuggaccgagcaguacaaguuucagcccgagucuccggcgcgauuagcaagcgccauccucaacgcccacaaggacggcgucugcggaauccgcuccacgacccggcuggaaaacgugauguggaagcagaucaccaacgagcuaaacuacgucuuaugggagggcggccacgaccugaccguuguggccggcgacgugaagggcguacugacgaaggggaagcgcgcccucacaccgccugccagugacuuaaaguacaguuggaagaccuggggaaaggccaagaucuucaccccagaggcucggaauagcacguuccucaucgacggcccugacaccuccgagugcccgaacgagcgcagagccuggaauagcuucgaaguggaggacuacggcuucgggauguucaccaccaacauauggaugaaguuccgcgagggcucgagcgaggugugcgaccaucgguugauguccgcugcaaucaaggaccaaaaggccguccacgccgacaugggcuacuggauagagagcuccaagaaucagacguggcagaucgaacgcgcguccuugaucgaagugaagaccugccuguggcccaagacacacacacucugguccaacggugugcucgaaagccaaaugcucauucccaaguccuacgcaggcccguuuagccagcauaacuaccggcagggguaugccacucaaacugucggccccuggcaccucgggaagcucgagaucgauuucggcgagugccccggcaccaccgugaccauccaggaaaauugugaccaccgcgggcccucccugagaacgaccaccgcuagcggcaagcucgucacgcaguggugcugccggagcugcacgaugcccccccugcgcuuucugggagaggauggcuguugguacgggauggagauccggccccucucggaaaaggaggaaaacauggugaagagccaggugacagcuggccagggcaccuccgagaccuucucaauggggcuauugugccucacgcuguuugucgaagagugccugcgccggcgcgugacccggaagcacaugauccucgcgguugucaucacccugugugccauuauacuuggcggccucacguggauggacuuauuacgcgcgcucauaauucuuggcgacacgaugaguggccggauugggggacagacccaccuggcgaucauggccguguuuaagaugagccccgguuacguguugggugucuuccugcgcaagcugaccagucgggagaccgcgcucauggugauagggauggccaugacgacuacccuaagcauaccccacgaccugauggaacucaucgacggaaucucccugggacuaaucuugcugaaaaucgugacccaguucgauaacacgcaagucggcacccuagcccuaagccucacauuuauacgcaguaccaugagccucguuauggccuggaggacgaucauggcaguguuauuugucgugacccugaucccgcuuugccgcaccuccugccuccagaaacagucucacuggguggagauaaccgcacucauccugggcgcgcaggcccuccccguauaccugaugacguugaugaagggggcaucccggcgcagcuggccacucaacgagggcaucauggcgguggggcuggugucgcuguugggcagcgcccugcugaagaacgacgucccucucgccggcccaaugguagccggugggcugcuguuagccgcuuaugugauguccgggagcagcgcugaccugucccuggaaaaggccgccaacguccagugggaugagauggccgacaucaccgggagcagucccaucaucgaagugaagcaggacgaggacggaagcuucuccauccgggacguggaagagacgaauaugauuaccuuacuggucaagcuggcgcucaucacggugagcggccuguacccccuggccauccccaucaccaugacccucugguauauguggcagguuaagacccagcgcagcggcgccuugugggacgucccaucucccgccgccacccagaaggcggcccugucggaggggguguaccggaucaugcagaggggccucuucgggaagacgcaggugggcgucggaauccauauggagggaguuuuccacaccauguggcacgugacccgggguuccgucaucugucacgagaccgggcgccuggagccauccugggccgacgugagaaaugacaugaucucuuacggcgggggcuggcggcuaggagauaagugggacaaggaggaggacgugcaaguccucgcaaucgagccggggaagaaccccaagcacgugcagacgaagcccggcuuauucaagacccugaccggggagaucggcgcagugacccuagacuucaagcccgggacauccggcagcccgaucauuaaccgaaagggcaaggugauugggcuguacggcaacggggugguaaccaaguccggcgacuacgucagcgcuaucacccaggccgagcggauuggggagcccgacuacgagguagacgaggauauuuuccggaagaagcggcugaccauaauggacuuacaucccggugcgggcaagacgaaaaggauccugccguccauagugcgggaagcccugaagcgccggcuaaggacccucauacucgcgcccacccgggugguggccgcugagauggaggaggcccugcguggccuccccauccgcuaccagacccccgccgugaagagcgagcauacgggcagggaaaucgucgaccugaugugccacgcgacauuuaccacccgguugcuuuccagcacacgcgugccgaacuacaaucugauagugauggacgaagcacacuucacagaccccagcuccgucgccgcccgaggguacaucagcacgcgcguggagaugggcgaagccgcagccaucuucaugaccgcaacaccccccggagccacugacccauucccccaguccaacagcccuauagaggauaucgagcgggagauccccgagcgcuccuggaacacaggcuucgacuggauuaccgacuaucaggguaagacggucugguucgugccgagcauuaaggccggcaacgauaucgcgaauugccuacgcaaauccggcaagaaggugauacaacucagucggaagaccuucgacacggaguaccccaagacgaagcugacggauugggacuucgucgugaccaccgacaucuccgagaugggggccaacuuccgcgccggccgggugaucgauccccgccgcugccugaagcccgucauccucacugacgggcccgagcgcgugauccuggccggcccgauucccgugacgcccgcgagcgccgcucagcggaggggccggaucggccgcaacccugcccaagaggacgaccaguacguguucuccggcgacccacugaagaaugacgaggaccaugcccacuggacagaggcgaaaaugcuccuggacaacaucuacacacccgaggggaucauccccacccuguucggcccggagcgggagaagacgcaggcuaucgauggcgaauuccgccucaggggggagcagcgcaagaccuucguggagcugaugcgucgcggugaccugccgguguggcucagcuacaagguagccucugccgggaucuccuauaaggaucgggaguggugcuucaccggcgaacgaaacaaccaaauccuagaggagaacauggaaguagagaucuggacccgggagggggaaaagaagaaauugcgacccaaguggcucgacgcccggguguaugcggacccuauggcccuaaaagacuuuaaagaguucgcguccggccguaagagcauaacacuagacauccucacggagaucgccucccuucccacauaccugagcagucgcgccaagcuagcgcuggacaacauagucaugcugcauaccaccgagcggggagggcgcgccuaccagcacgcccucaacgagcugcccgagagccuggagacgcucauguugguggcacugcucggagccaugaccgccgguaucuuccuguucuucaugcagggaaaggggauagguaaacugagcaugggccuuauaacaaucgcgguggccagcgggcuguuaugggucgcggagauccagccccaguggaucgcagccagcauaaucuuggaauucuuccucauggugcugcucaucccggagcccgagaagcagcggaccccccaggacaaucaacugaucuacgugauucugacaauacucaccauuaucgggcugauugccgcgaacgaaaugggacugaucgagaagaccaagaccgacuucgguuucuaccaggugaagacggagaccaccauccuagauguggacuuacgcccagccuccgcauggacgcuguacgcgguggccacgaccauccucacgccgaugcugcgccacaccauagagaacaccagcgccaacuuaucccucgccgcgaucgcgaaccaggccgccguccucauggggcugggcaagggcuggccacuccaccggauggacuuggggguuccuuugcucgccaugggcugcuacucccagguaaaccccaccacccugaccgcgucccuggucaugcugcuggugcauuaugccaucaucgguccgggccuucaggccaaagccacgcgggaggcgcagaagcgcacugccgccggcaucaugaagaaccccaccguggacgggaucacggucaucgaucucgagcccaucagcuacgaccccaaauucgagaagcagcugggucaagugaugcugcucguucugugcgccgggcaauuacucuugaugcgaacaaccugggcuuuuugcgagguccuaacccucgcgaccggccccauucuaacgcuuugggaagggaaccccggccgauucuggaacaccaccaucgcgguguccaccgccaacaucuuccgcggauccuaccuagccggcgccggccuugcguucucgcucauuaagaacgcccaaacgccccggcgcgggaccggcaccgccggggagaccuugggcgagaaguggaagcgccagcugaacucacuggaccggaaggaguucgaagaguauaagcgcuccggcauacucgagguggaccggaccgaagcuaagucggcucugaaggacgggucuaagauaaagcacgcugucagccgcggauccagcaagauccgguggaucguggagagagggauggugaagccaaaaggcaagguuguggaccugggguguggccgcgggggguggucauacuacauggccacucugaagaaugugacggaagucaagggcuacaccaaagguggcccggggcaugaggaacccauccccauggccaccuauggcuggaaucucgugaaacugcauagcgguguggacgucuucuacaaacccaccgagcaaguggauacauuacugugcgacaucggggagagcucuagcaacccgaccaucgaagaaggucggaccuugcgcguguugaagaugguagaacccuggcugucgagcaagcccgaguuuugcaucaaggugcugaauccuuacaugccgacggugaucgaggagcuggagaaacuccagcgcaaacacgggggcaaccugguucguugcccccuaucccggaacagcacccaugagauguauuggguuuccggcgcgucugggaacaucguauccucagugaacaccacuuccaagaugcuccugaaccgauucacgacccggcaccgcaaaccuaccuaugagaaggacguggacuuaggcgcggggacccggagugucuccacagagaccgagaaaccugacaugaccaucaucggacgccggcuacagcgccugcaggaggaacacaaggagaccuggcacuaugaccaggagaacccauaccggacgugggccuaccacgggagcuaugaggccccguccaccggcagugccuccagcaugguaaacgggguggucaaacugcucaccaagcccugggaugugaucccgauggugacgcagcuggccaugacagacaccacccccuucgggcaacagcgcgucuucaaggagaagguggacacgcggaccccccagcccaagccgggcacccgaauggucaugaccaccacggcaaacuggcugugggcccuccuggggaagaagaagaacccgcggcugugcacaagggaggaguuuaucucaaaaguccggagcaacgcggccaucggggcgguguuccaggaggagcagggcuggaccagcgcguccgaggccguaaacgacucacgcuucugggagcuugucgacaaagagcgagcccuccaccaggaaggcaagugcgaguccugcguguacaauaugaugggcaagagagagaagaagcugggagaguucggucgcgccaaggggagccgggcgaucugguacauguggcucggcgcuagauuccuagaguucgaggcacuugguuuucugaaugaggaccacugguucggccgggagaacagcuggagcggcguggagggggagggccugcaucgccugggguacauucucgaggagaucgauaagaaggauggagaucucauguacgccgacgacacagccggcugggauacucggaucaccgaggacgaucugcagaacgaggaguugauuaccgaacagauggcuccucaccauaaaaccuuagccaaggccaucuucaagcugaccuaccagaacaaggucgugaaagugcuccgccccacgcccagaggggccguaauggauauuaucucccgcaaagaccagcggggcagcggacagguaggcaccuacgggcugaauaccuucaccaacauggaggugcagcuaaucaggcagauggaggccgagggcguaaucacgcaggacgauaugcagaacccgaagggccucaaagagcggguugagaaguggcugcgcgagugcgguguggacagacugaagcgcauggcgaucuccggcgaugacugugucgugaagccucuggacgagcgguucgggaccagccuguuauucuuaaaugauaugggcaaggugcgcaaggacaucccccagugggagccguccaagggguggaaaaacuggcaggagguacccuucugcagccaccacuuccauaaaauuuucaugaaggauggccggucccuggugguucccugccggaaccaggacgagcugauaggucgggcccgcauuucucagggggcgggcuggucgcuccgggagaccgccugccuggggaaagccuacgcacagauguggagucugauguacuuccaccgucgcgaccucagguuggccuccauggccaucugcagcgccguccccaccgagugguucccgacgagcagaaccaccugguccauccacgcccaccaccaguggaugacuacggaagacaugcugaagguuuggaaccggguauggaucgaggacaaccccaacaugaucgacaagacccccguccacagcugggaggacauacccuaccucggcaagagagaggaccuguggugcgggucccugaucgggcucagcucccgggcaaccugggcuaagaacauccacaccgccauaacgcaggugcggaaccugaucgggaaagaggaauaugucgacuacaugccggucaugaagagauauagugcucccuccgagagcgaaggggugcuguag

SEQ ID NO: 26317 - RNA, 9867 nt, Artificial Sequence
  derived and/or modified CDS sequence (opt11) from DENV-4__KJ596664__SS-prME
agcaccaucacccugcucugucugauccccacggugauggcuuuccaccuguccacccgcgacggcgagccgcucaugaucgucgccaagcacgagcgugggcgcccccugcuguucaagaccacggaggggaucaauaagugcacgcucaucgcgauggaccugggugagaugugcgaggauaccgugaccuacaagugccccuugcuugugaacaccgagcccgaggacaucgacugcuggugcaaucuuacgagcaccugggucauguacggaaccugcacccaguccggggagcggcgccgggagaagcgcagcguggcucugacgccgcacucaggcauggggcucgagacccgggccgaaaccuggaugagcucggagggggcguggaagcacgcccagcgcguggagagcuggauccugcguaaccccggcuucgcgcuacucgccggguucauggccuacaugaucggccagaccgggauucagcgcacggucuucuuugugcugaugaugcuuguggcucccuccuacggcaugcgguguguuggcguggggaaccgcgacuuuguggagggcgucucuggcggcgcauggguggaccucguucuggagcacggagggugcgugaccacuauggcccagggcaaacccacccuggacuucgagcucacgaagaccaccgcaaaggagguggcccugcugaggacguacugcaucgaggcccucaucuccaauaucacgaccgcgacccgcugcccgacccaaggggaacccuacuugaaggaagaacaggaucaacaguacaucugccggcgcgacguggucgaucggggauggggaaacggcugcggccuguucgguaagggagggguggucacgugcgcuaaguucaguugcuccggcaagaucaccgggaaccucgugcagaucgaaaaccuggaguacaccgucguggucacggugcauaacggcgacacccacgcagucggcaacgacaccucaaaccacggggugaccgccaccaucacgccacgcuccccgagcguggaagucaagcugccugacuacggagagcucacccuggacugugagccccggucagggauugauuucaaugagaugauccuuaugaagaugaaaaagaaaaccugguuagugcacaagcagugguuccuggaccugccacucccuuggaccaccggugccgacacgagcgaggugcacuggaacuacaaagaacguauggucaccuuuaagguuccgcaugcgaagcggcaggaugugaccguccuggggucccaggagggcgccaugcacagcgcacuagcaggcgcaaccgagguggacagcggugacggcaaccacauguucgcugggcacuuaaagugcaaggugcgcauggaaaagcugcgaaucaaaggcauguccuauacgauguguagcgggaaauucuccaucgacaaggagauggccgagacccagcacggaaccaccgucgugaaggugaaguacgagggcgccggggcccccugcaaggugcccaucgagauccgggacgugaacaaagagaagguugucggccgcgugauaagcgcaacgccccuggccgagaacacaaacuccgugaccaacaucgagcucgagccgccuuuuggggacagcuacaucgucaucggcgugggaaacagcgcccugacccugcacugguuccggaaggggagcucuaucggcaagauguucgagagcacguaccgcggggccaagcgcauggccauccuuggcgagacagcgugggacuuuggguccgucggcggccuguuuaccagccuggggaaggccguccaccagguguucggcuccguguacaccaccauguucgggggcgucagcuggaugauccguauccucaucggauuccugguuuuauggaucgguaccaacagucggaacaccagcauggccaugaccugcauagcugucgggggcaucacgcuguuccucggguucaccguccaggccgacauggggugcgucguguccuggagcggccgcgagcugaagugcggguccggcauuuucgucguggacaacgugcacaccuggaccgagcaguacaaguuccagcccgagagccccgcgcggcuggccagcgccauacuaaaugcacacaaggacggcguaugcggaauccgcaguacuacccggcuggagaacgugauguggaagcagaucacaaacgagcugaacuacgugcucugggagggcgggcacgaucucaccgucgucgccggugacgugaagggcguccugacaaaggggaagcgcgcgcugaccccgccggccagugaccugaaguacuccuggaagaccuggggaaaggccaagaucuucacccccgaggcccggaacagcacguuccugaucgacgggcccgacaccuccgagugccccaacgaacgacgagccuggaacagcuucgagguggaggauuacggcuucggcauguucacuaccaacaucuggaugaaguuuagggagggcucuagcgaggugugugaccaccggcucaugucagcggcuaucaaagaccagaaagccguccacgcagacaugggcuacuggaucgagagcucaaagaaccagacguggcaaauagagcgcgcgagccugauagaggucaagaccugccuguggcccaagacacacacccucuggagcaacggagugcuggaaagccagaugcugauacccaaguccuacgccggcccguuuagccagcauaacuaucggcagggauacgcgacccagaccgucggucccuggcaccuugggaagcuggagaucgacuucggcgagugccccggcaccaccguuaccauccaggagaacugugaccaccgcggucccucucugcgcacgaccacagccaguggcaaacucgugacccaguggugcugccggagcugcacgaugccgccccugcgcuucuuaggggaggacggcugcugguacgggauggaaauccggccgcucuccgagaaggaggagaacaugguaaagagccaggugacggccggccagggcaccuccgaaaccuucuccaugggguuauuaugccucacguuguucgucgaagagugccugcgccgacgcguuacacggaagcacaugauccuagcgguugugaucacccuaugugccaucauucugggugggcucacuuggauggaccugcuacgcgcucucaucaugcugggugauacgauguccgggcggaucggcggccagacccaccuggccauuaucgccguguuuaagaugagccccggauacguacucggggucuuccugcgcaagcugaccucacgggagaccgcgcuaauggugaucgggauggcaaugacgaccacccugagcaucccgcaugaccugauggagcucaucgauggcaucucccugggccugauccucuugaaaaucguaacccaguucgacaacacgcaggucggaacccuggcccucagucugaccuucauccgcuccacaaugagucugguaauggccuggcggacaaucauggccguacucuucgucguuacccugauuccccugugccgcaccuccugccuccagaagcaaucucacuggguggagaucaccgcgcugauacugggcgcccaggcucuccccguuuaccugaugacgcugaugaagggggccucccggcgcagcuggccccucaacgaggguauuauggcgguggggcugguuucccugcucggcagugcccuacugaaaaacgacgucccgcucgccgggcccaugguggccgggggccugcugcucgccgcauaugugaugagugggagcagcgccgaccugucccuggaaaaggccgccaacguccagugggacgagauggccgacauaaccgguagcucucccauuaucgaggugaagcaggacgaggacgggucguucuccauccgggacguggaggagaccaacaugauuaccuuguuagucaagcuggcgcucauaacagugagcggccuguacccccuggcuauuccaaucaccaugacccucugguacauguggcaagugaagacccagcgcuccggcgcucuuugggacgucccaucgcccgccgccacccagaaggcggcccuguccgaggggguguacaggaucaugcaacggggccucuucgggaagacacaggugggcgucgggauccacauggagggcguguuccacacaauguggcacgugacccggggcagcguaaucugucacgagaccgggcgucuggagccauccugggccgacgugcgaaacgacaugaucagcuacggcggaggcuggcggcugggcgacaagugggauaaggaggaggacgugcagguuuuggccaucgagcccgggaagaacccuaagcacgugcagacuaagcccggcuuguucaaaacucugaccggagagaucggggccgugacccucgacuucaagcccgggaccucgggcagcccgaucaucaaccgcaagggcaaggucaucgggcuguacggcaacgggguugugaccaaguccggagacuacguuagcgcgaucacacaagccgagcggauaggggagcccgacuacgagguggacgaggacauauuccgaaagaagcggcugacgauaauggaccuccaccccggcgccgggaagacgaagcgcauacuaccguccaucgugcgggaggcacugaagcgccggcuacgcacguugauccuggcuccuacacgggucguugcagccgagauggaagaggcccuccgcgggcuccccauccgguaccagacgcccgccgugaagucagagcacacgggccgcgagaucguggaccugaugugucacgcgaccuuuaccacccgguuauuauccagcacacgcguaccgaacuacaaccugaucguuauggacgaggcucacuuuaccgaucccagcagugucgcagcccggggguacaucagcacccguguggagaugggcgaggcggcggccaucuucaugaccgcgacgcccccaggggcaacagacccguucccacaguccaacagcccaaucgaagacauugagcgcgaaauccccgagcgauccuggaacaccggcuucgauuggauaacagauuaccagggcaagacggugugguucgugccgagcaucaaggccgggaacgacaucgcgaacugucugaggaaguccggcaagaaggugauccagcucagccggaagaccuucgacaccgaguaucccaagaccaagcugacugacugggacuucgucguaacaaccgacaucuccgagaugggggccaacuuucgcgccggacgugucaucgacccacgccggugucugaagccggucauucugaccgacgggccggagcgcgugauccuggccggcccgauccccgucacacccgcaagcgcugcccagcggcgcggccggauagggcgcaauccggcccaggaggacgaccaguaugucuucuccggcgacccccugaaaaacgacgaggaccaugcucacuggaccgaggcaaagaugcuucuggacaacauuuacaccccggaggggaucauccccacccuauucggcccggaacgugaaaagacucaggccaucgacggcgaguuccgccucagaggggaacaacgcaagacauucguggaacugaugaggcgaggcgacuuaccaguuuggcucucauacaaggucgccuccgccgggauaagcuauaaggaccgggaguggugcuucaccggcgagcgaaauaaccagaucuuagaagagaacauggagguggagauauggacccgggagggcgagaaaaagaagcugcgccccaaguggcucgacgcccggguguacgcugaccccauggcccuaaaggacuucaaggaguuugccuccggccgcaagagcaucacacuggacauccucacggaaaucgccagucuaccgaccuaccugaguucccgcgcaaagcucgcgcuggacaacaucguuaugcugcacaccaccgagcggggcgggcgugcauaccagcacgcccucaacgagcuccccgagagccuggagacgcucaugcugguggcccugcucggcgcuaugaccgccgguaucuuccuguucuucaugcagggaaaggggaucgguaagcucagcaugggccucauaaccauugccguggccuccggacuuuugugggucgccgagauccagccccaguggaucgcggccagcaucaucuuggaguucuuccugauggugcugcucaucccugagcccgagaagcagcggacaccccaggacaaccaacugaucuaugugauccugacgauccucaccaucaucggccugaucgccgccaacgagauggggcugaucgagaagaccaaaacugauuuuggcuucuaccagguuaagacggagaccaccauccucgauguggaccuacgccccgccucugcuuggacgcuguacgcgguggccaccaccauccucaccccgaugcugcggcacaccaucgagaacacgagugccaaccugucccucgccgcgaucgccaaccaagccgccguccuaauggggcugggcaagggcuggccccuccaccgcauggaccugggggugccccuccucgccaugggauguuacagccaggugaaccccacuacccugaccgcgucccuggugaugcuccuggugcacuacgcuauuaucggaccgggcuuacaagccaaggcuacgcgggaggcgcagaagcgcaccgccgccggcaucaugaagaaccccaccguggauggaaucaccgucauugaccucgaacccaucagcuacgauccuaaguucgaaaagcaguuaggacaggugaugcuguuagugcugugcgcggggcagcugcuccugaugcgaacgaccugggcauucugugaaguacugacccuggcgacaggcccuauccugaccuuaugggaggggaaccccggcagauucuggaauaccaccauagcaguguccaccgccaacaucuuccggggcagcuacuuggcuggugccggccuggcguucucccugaucaagaacgcccagacuccgcgccgaggcaccgguaccgcgggggagacccucggagaaaaguggaagcgccagcucaacagccuggaccggaaggaguucgaggaguauaagcgauccggcauccucgaaguggaccggaccgaggcaaagagcgccuugaaggacggguccaagaucaagcacgcggucagcagaggcucgagcaagauacgguggauaguggagcgcgggauggugaagccuaagggcaagguaguggaucuggggugcggccgcggcgggugguccuacuacauggccacgcucaagaaugugaccgaggucaagggcuacaccaaaggggguccgggucacgaggaaccgauccccauggccaccuacggcuggaacuuagugaagcugcacagcggcguggauguguucuacaagcccacggaacagguggacacccuccucugcgacaucggggagagcucuaguaacccgacaaucgaggaggguagaacucuacgcgugcucaagauggucgagcccuggcugucaagcaagcccgaguucugcauaaaggugcugaacccguacaugccgacggugaucgaggagcuggagaaacuccagcggaaacacggagggaaccugguccgcugcccccugucgcgaaacaguacacacgagauguacugggucuccggcgccagcgguaacaucgucuccagugugaacaccaccuccaagaugcuccugaaccgcuucacgacccggcaccgaaaaccgacauacgaaaaggacguggacuugggggcggggacccggagcgucuccacggagaucgagaagcccgacaugacgaucaucggccgccggcuucagcggcugcaggaggagcacaaggagaccuggcacuaugaccaagaaaacccguaucguaccugggccuaucaugggagcuacgaggcccccuccacgggcagcgccuccagcauggugaacgggguggucaaguuacucaccaagcccugggacgugauacccauggugacacagcuggccaugaccgacacgaccccguucggucagcagcgcgucuucaaggagaagguagacacgcggaccccgcagccaaagccgggcacgcgcauggugaugacuaccaccgccaauuggcugugggccuuacugggaaagaagaagaacccccggcugugcacgcgggaggaguuuaucuccaagguccguagcaacgccgcgaucggcgccguuuuccaagaggaacagggauggaccagcgcguccgaggccgugaacgacagccgcuucugggagcucguagacaaggagcgggcccugcaccaagagggcaagugcgagucuugcguuuacaacaugaugggcaaacgugagaagaagcugggugaguucggccgcgcaaaggguagcagagccaucugguauaugugguugggcgcgcgcuuccuggaguucgaagccuuaggguuccugaacgaggaccacugguucggccgugagaacuccuggucgggaguggaaggugagggccugcaucggcugggguacauucuagaggagaucgauaaaaaggauggggaccuuauguacgccgacgacacagcaggcugggacacccggaucacggaggacgaucugcagaaugaggaguuaaucaccgaacagauggcgccacaccacaaaauucuggcaaaggccaucuucaagcugaccuaccagaacaaggucgugaaggugcuccgccccaccccgagaggggccgucauggacauuaucucccgcaaggaccagcguggcucagggcaagugggcacauacgggcugaacacguucaccaacauggaggugcagcugauccgccagauggaggcggagggcgucaucacccaggacgacaugcagaaccccaagggccucaaggagcgggucgagaagugguuacgggaaugcggcguggaccggcugaagcgcauggcaaucuccggugacgacugcgucgugaagccccucgacgagcgguucgggaccagccuccuguuccucaacgacaugggcaaggugcgcaaggacaucccgcagugggagccguccaagggguggaagaacuggcaggagguaccguucuguagccaccacuuccauaagaucuucaugaaagacggucguucucuggugguucccugccgcaaccaggacgagcugaucggccgggccaggaucagccagggcgccggcuggaaccuccgcgagacggcaugucuugggaaggccuacgcacagauguggucgcugauguacuuccaucggcgcgaucuccggcuggccagcauggccauuugcucggcuguccccaccgagugguucccaaccagccgcaccacguggucuauccacgcccaccaccaguggaugaccaccgaggacaugcugaagguguggaaccggguguggaucgaggacaacccgaacaugauagacaagacccccguccacuccugggaggacauccccuauuuaggcaagcgcgaggaccuguggugcgguagccugauuggacucucuagccgggcaacgugggcuaagaacauacacaccgcgaucacacagguccgcaaccugaucggcaaggaggaguacguggacuacaugagugugaugaagcgguacagcgccccguccgagagcgaggguguccuguga

SEQ ID NO: 26318 - RNA, 9867 nt, Artificial Sequence
  derived and/or modified CDS sequence (opt11) from DENV-4__KJ596665__SS-prME
ucaaccauaacgcuccuuugccucauccccacggucauggcuuuccauuuaucaacgcgugauggggaaccccuaaugauaguggcuaaacacgaacggggccgaccccucuuauucaaaacgacagaaggcauaaauaaaugcacucuaauugcgauggacuuaggagaaaugugugaagauacgguaacauacaaguguccgcuguugguaaauacugaacccgaagauauugauugcugguguaauuuaaccucaacaugggucauguacggaaccuguacgcagagcggcgaaagaagaagagaaaaacgaucuguagcauuaacgccccacucugguaugggauuagaaacgagggcggaaacguggaugucgagugagggcgcauggaagcaugcacaaaggguugaauccuggauucuccgaaacccgggguuugcauuacuagcgggauucauggcguacaugauaggacagacaggcauccaacgaaccguauucuucguacugaugaugcucguagcgccuagcuacgggaugcgcugcguagggguaggaaauagggauuuugucgaaggagucagcgggggagccuggguggaucuagugcuugaacacgguggcuguguaacaacaauggcgcaaggcaaacccacccucgacuucgagcuuacaaagacaacagccaaggaaguagcccugcuccgaaccuacugcauagaagcccucauaaguaacaucacaaccgcgacccgaugccccacccagggagaaccauauuugaaagaagaacaggaccaacaguacaucugccgccgagaugucguggacagaggauggggcaacggcugcggcuuauucggaaaagguggaguugucacaugcgcgaaauucucaugcucaggaaagaucacuggaaaccucguacaaauagagaaccucgaauacacaguagugguaacggugcacaauggcgacacgcacgcaguggggaacgacacaucuaaccacggggugaccgcaaccauaacaccccggagccccucggucgaaguuaaauuaccagacuacggugaacucacgcuagauugcgaaccccggucagguauugacuuuaaugagaugauccugaugaagaugaaaaagaaaaccuggcucguucacaaacagugguucuuagacuuaccacuacccuggacaacaggagccgacaccuccgagguacacuggaacuacaaagagcgcauggucacguuuaaaguuccgcaugcaaagagacaggacgugacagugcucggaagccaagaaggcgcaaugcacagcgcacuagccggugcaacggaaguggacucgggcgacggaaaccauauguucgcagggcaccucaaauguaaaguacggauggagaaacuaagaauaaaagggauguccuacacaauguguucgggaaaauucucaauugacaaggaaauggcggaaacccaacacggaaccaccguagucaagguaaaauaugaaggagcaggagcccccugcaagguucccauagagauaagagacgugaauaaggaaaaggucguuggucgcguaauauccgcgacaccuuuagcggaaaacacaaauagcgucaccaacaucgaguuagagcccccguucggggauagcuacauuguaauaggcguggggaacucagcguuaacccuacacugguuucgcaaaggaucuucuaucgggaaaauguucgagucgacuuaccgcggcgcgaagagaauggcuauccugggagaaacugcaugggacuucggaagcgucggaggcuuguucaccucacuagggaaggcaguucaccaaguguucggaagcguuuacacgacaauguucggcggcguuuccuggaugaucaggauucugauuggcuuucucguccuguggaucggcacaaacaguaggaauacaagcauggcgaugacgugcaucgcgguaggaggcaucacccuauucuugggguucaccguacaagccgacaugggaugcguaguaagcuggagcggaagggaacucaaaugcgggagugguauauucguaguagauaacguacauacguggaccgagcaauacaaauuucagccagaguccccagccaggcucgcuagcgccaucuugaaugcccacaaagacggagugugcggaaucagaucgacgacccgacucgaaaacgucauguggaaacagauaacgaacgaacuuaacuacgugcugugggaaggaggacacgaucuuacaguggucgcgggagaugugaaaggagugcucaccaaggggaagcgagccuuaacgccgccggcauccggauugaaguacaguuggaagacuuggggcaaggcaaagauauucacacccgaagcgcgaaacuccaccuuccugaucgacgggcccgauacaagugaaugcccaaacgagcgucgagccuggaacucguucgaggucgaggacuacggauucggaauguucacaaccaacauuuggaugaaguuccgagaaggaucuuccgaagucugcgaccaucggcuaauguccgccgcuaucaaggaccagaaggccguacacgcggauaugggcuacuggaucgaaagcagcaaaaaucagacguggcaaaucgagcgagccagcuuaauagaaguaaaaacaugccuuuggccaaagacacacacgcuauggagcaacgggguccuugagagccaaaugcuaaucccgaaaagcuacgcggggccauucagucaacacaauuauagacaaggcuacgcuacgcagacuguuggcccguggcacuuggguaagcucgaaauugacuuuggcgagugcccgggaacuaccgugacaauccaagagaacugcgaucacagaggcccaucgcuccgcacgacuacggcaucugggaagcuaguaacgcaauggugcugcaggucaugcacgaugccaccccuaagauucuugggcgaggacgggugcugguauggaauggagauccguccauuaagcgaaaaagaggaaaacaugguuaagucacaagugaccgcaggacaaggcaccuccgagacauucaguaugggccuacucugcuugacuuuauucgucgaggagugcuugcgacguagaguaacccgcaagcauaugaucuuagcaguagugauaacccuaugcgccaucauacuaggagggcugaccuggauggaccuccugagggcgcuaaucauccugggggacacgaugagcgggcguauuggcggccaaacccaccuagcaaucauggcaguauuuaaaauguccccuggcuauguacuaggcguauuccuuaggaaacugacgagcagggaaacagcuuuaauggucauugggauggcgaugacuacaacgcuaagcauaccgcacgaccucauggaacugauugacggcauaagucucggucugauucuacugaaaaucguaacccaauuugacaauacacaaguaggcacccucgcgcuaucucucacguucauccgaucgacgaugucgcuaguuauggcauggcgcaccauaauggcaguacuuuucguggucacucucaucccucuaugccgcacaucgugcuugcaaaaacaaucacauuggguagagauaaccgcccuaauacugggagcccaagcccuaccgguguaccuuaugacucugaugaaaggcgccagucgcaggagcuggccccuaaaugaggggaucauggcgguaggccuggugucacuacuaggcagcgcgcugcugaaaaacgacgucccgcuggcagguccgauggucgcagggggccuucugcuagcagcauauguaaugucaggcucaucugccgaccucucauuagaaaaagccgccaauguucagugggacgaaauggcagacauaaccggguccaguccgauaauagaaguaaagcaagacgaagauggaucauucucaauucgagacguagaggaaacaaacaugaucacucugcugguaaaacucgcguugaucacagucaguggccuguacccccucgcaauacccauaaccaugacacucugguacauguggcaagucaaaacacagcgaaguggggcacuaugggacgugccaaguccagccgcaacccagaaggcggccuuguccgagggcguguauagaaucaugcagaggggucuauucgguaagacucaagucggcguaggaauacacauggagggcguauuucacacgauguggcaugucacucgagggucugucauaugccacgaaacaggccgauuagaaccaucaugggcagauguacgcaacgacaugauaagcuacggcggaggguggcguuugggugacaaaugggacaaggaagaagauguacagguccucgcaaucgagccaggcaaaaacccaaaacacguccaaacaaaacccggucucuucaagacgcugacgggagagaucggagccgucaccuuagacuuuaaaccagggacguccggaucacccaucaucaaccgaaagggcaaggucauagggcuguacgggaacggagucguaacaaaaaguggggauuacgucagcgccaucacucaagccgaaagaauuggggaaccugacuaugaaguggacgaggacauauucaggaagaaaagacucacgauaauggaccuacauccgggggcaggcaaaaccaaacggauccuaccaaguaucguuagagaggcccuaaaacggcgccuacggacacucauacucgcaccaacccgugucguagccgcagagauggaagaagcacuaagggggcuaccuauacgguaccagaccccggcagugaaaagcgagcacaccgggagagaaauaguugacuugaugugccacgcuaccuucacaaccagacuucugaguagcacacgaguaccuaacuauaaccuaaucguaauggacgaggcgcacuuuacugaccccagcucaguggcggcaagaggauacauaagcacacggguugaaaugggggaggcggcggcaauauuuaugacggcgacgccacccggugccacugacccauucccacaaagcaacaguccuaucgaagacauagaacgcgagauccccgagcgaucuuggaacacaggguucgauuggauaacagacuaccaaggcaaaaccgucugguucguccccucgauaaaagccgggaacgauaucgccaacugccuacgcaaaagcgggaagaaagugauccaacuaucucgcaagacauuugacacagaguacccaaaaacaaaguuaaccgacugggacuuuguaguaaccaccgauaucagugaaaugggugcaaacuuccgcgccggccgggugauagacccuagaagaugccucaaaccagucaucuuaaccgacgggccagagagagugauccuagcagggcccaucccggucaccccagcgagugccgcgcaacggagggggcggaucggucgcaauccagcccaggaagacgaucaauacguuuucaguggggacccccucaaaaacgacgaggaccacgcacauuggaccgaagcgaaaaugcuacuggauaacauauacacaccggaaggcaucauuccgacacuauucggccccgagcgcgagaaaacacaggccauagauggcgaauuuagacuaagaggcgagcagcgaaaaacauucguugagcucaugcgacgcggggaccuaccgguauggcugucuuacaaagucgcgagcgccggcaucuccuacaaggacagggaauggugcuuuaccggagaacgaaacaaccagauacuggaggaaaauauggaaguagagauuuggacacgcgagggcgagaaaaagaagcuacgucccaaguggcuagacgcaaggguuuacgccgaccccauggcacugaaggacuuuaaagaguuugccucgggaagaaaaucgauaacacucgauaucuuaacagaaauugcgagccucccgacauauuugaguagcagagcaaagcuagcacucgacaauaucguaaugcuacauaccacggagcgcgggggacgagcuuaccaacacgcccucaaugaacugccggaaucgcuagagacauugaugcuggucgcccuauuaggcgccaugacugcuggcaucuuucuauucuucaugcaggggaaaggcauuggaaaacugaguaugggccucauaacaauagcgguagcgucgggacuauuguggguagcggaaauacaaccccaguggauagccgcuucgaucauccuggaguucuuccuaaugguauuacuaauacccgagccugaaaaacagcgcacaccccaggauaaucaacuaaucuacgucauccucaccauauugaccaucaucgggcuaauagccgcgaacgagaugggacuaauugagaaaaccaagacggacuucggcuucuaccagguaaaaacugaaaccaccauccuagacgucgaccuacgcccagcgucagcguggacguuguacgccguagcaacaacuauacuaacgccuaugcuuagacauacaaucgaaaauacgagcgcaaacuugucccuggcagccaucgccaaccaggcagcgguccuuauggguuuaggcaagggauggccacuacacagaauggaccuaggaguaccacuacuagccauggggugcuauucgcaagugaacccgacaacauuaacagcaucccugguuaugcuccuuguucauuaugccauaaucggaccaggacuucaagccaaagcaacacgagaagcccagaaacgaacagcagccgguauaaugaaaaacccgaccguggauggaauuaccguaauagaccuagaaccgauaucauacgauccaaaguuugagaagcaacucggacaagugaugcuacucguacucugcgcagggcaacuccugcugaugaggacaacgugggcauucugcgaaguacuaacgcuggccaccggccccauccuaacacuaugggaggggaacccgggacgcuuuuggaacaccaccaucgcgguuagcaccgcgaacauauuccgagggucguaccucgcuggugcagggcucgcauucagccuuauaaagaacgcccaaacaccccgccgagggacagggaccgcuggagagacauuaggagaaaaguggaaaagacaacuuaacucucucgacagaaaggaguucgaagaauacaagaggagcggaauuuuagaggucgaccgaacagaagcaaaauccgcacuuaaggacggaucgaaaauuaaacaugccguuucgcgaggcagcucaaagauaagguggauaguggaacgagggaugguaaaaccuaagggcaaggucguagaucuuggaugugggagagggggcuggucguacuacauggcgacacucaaaaacgucacggaaguuaaaggauacaccaagggagggcccggccaugaggagcccauuccgauggccacauacggguggaaucuaguaaagcuccacucaggcguggacguguucuauaagccaaccgagcaaguugacacccugcuaugugacauaggagagagcaguucaaauccgacaaucgaggagggacguacacuacgaguacuuaaaaugguggaaccauggcucagcaguaaaccugaguucuguaucaaaguccuuaacccguacaugcccacagucaucgaagaacuggagaagcuccagcgcaagcacggcgguaaccugguacgaugcccucuaagccgaaacaguacgcacgaaauguacuggguauccggggcgucgggaaacaucgucagcagugugaacacaaccagcaagaugcuauuaaacagguucaccacccgccaccgaaaacccacauaugagaaagaugucgaccuaggggcaggcacgcgaagcgucuccacagaaacggagaaaccugacaugacgauaaucggucgaagacuacagaggcuacaagaagaacacaaagagacguggcacuacgaccaggaaaacccuuaccggaccugggccuaccauggcucguacgaggcgccaucaacgggaagcgcaucaagcauggucaacggcguagucaaguuacuaacuaaaccgugggacgugauaccuaugguuacccagcuagcgaugaccgacacaacccccuucgggcagcaacgugucuucaaagagaaaguagacacacggacaccacagccaaaaccugggacccggauggucaugacaacuaccgcuaauuggcucugggcgcugcuuggcaaaaagaaaaacccacgcuugugcacucgagaggaguucauaagcaaagucagauccaacgccgccaucggagcagucuuccaagaagaacagggauggacgagcgccucagaggcuguaaacgauucacgcuucugggaacucgucgacaaagagcgagcacuccaccaggaggggaaaugcgaguccugcguauacaacaugaugggaaaacgcgagaagaaacuaggcgaauuugguagagcaaaaggaucaagagcaauaugguacauguggcucggcgccagauuccucgaguuugaggccuuaggguucuugaacgaagaccacugguucggccgugagaacagcuggaguggaguggaaggugaaggcuuacacaggcuaggauacaucuuggaggagaucgacaagaaagacggggaucugauguacgcagacgacacagcgggcugggauacacgaaucaccgaagaugaccuccagaacgaagaacugauuacagagcagauggccccucaccacaaaaucuuagcaaaggcgaucuucaaacugacauaucagaauaaaguuguuaagguacuccgccccacgccccgcggggccguaauggacauaaucucacguaaggaucagcggggaaguggccaaguggggaccuacggccuuaacacuuucaccaacauggaggugcaacuaauucgccaaauggaagcagaggggguuauuacccaagacgacaugcaaaaucccaaggggcucaaggaacgcguggaaaaauggcuucgcgaauguggaguggaccggcucaaacguauggccaucaguggcgacgacugcgugguaaaaccacuugaugaaagauucggaacaucacuccuguuccucaacgauaugggaaaggugcgcaaagacaucccgcaaugggagccuaguaaaggcuggaaaaacuggcaggaaguaccguucugcagccaccacuuucacaagauauucaugaaggacggcaggagccuagucguucccugccggaaccaagacgaacugauuggaagggcucgcaucagucagggggcgggauggucucucagagaaacggcaugccucggcaaggcguaugcgcagauguggucccugauguacuuccaucgaagagaccuccgguuagccagcauggcaaucugcagugcagugccaaccgagugguuccccacaucgaggacaacauggagcauccacgcgcaucaucaauggaugaccacggaaaacauguuaaaaguguggaaccgggucuggaucgaagauaaccccaauaugaucgacaagacgcccguucacagcugggaagauauaccauaccugggaaaaagggaggaucucuggugcggaucacucaucggccuaagcucacgagcaaccugggcuaagaauauccacaccgccauuacccaggugcgcaaccucaucggcaaagaggaauacguagacuauaugcccguuaugaagcgauauagcgcgcccagugagagcgaaggaguacuuuga

SEQ ID NO: 26319 - RNA, 9867 nt, Artificial Sequence
  derived and/or modified CDS sequence (opt11) from DENV-4__KJ596668__SS-prME
uccaccauuacgcuccucugccucaucccaacuguaauggcauuccaccucucaacuagagacggugaaccgcugaugauaguugccaagcaugaacgaggacggccguuacuuuucaagacgaccgaaggaauuaacaagugcacguugauagccauggaccucggugaaaugugcgaagacaccgugaccuacaaaugcccacuucugguuaacaccgaaccagaagacaucgacuguuggugcaaucuuaccucaaccugggugauguacggaacguguacgcaaagcggcgaaagacgccgggagaagagaagcgucgcacugaccccacacucaggcaugggccuggaaacucgggcagaaacauggaugagcagcgaaggugccuggaagcacgcucaaagaguagagagcuggauuuugcgaaauccgggguucgcgcuccuagccggauucauggcauacaugauagggcaaaccggcauacaaagaacaguguucuucgugcucaugaugcuaguagccccaucauacggaaugagaugcguagggguuggaaaccgcgauuucguggaagggguuagcggcggcgcguggguagaccuaguacuggaacacgggggcugcgucacuacgauggcgcagggcaaaccgaccuuagacuucgaacucaccaagaccacagcgaaagaagucgcccugcuacggaccuacugcauagaagcgcucaucucaaacauaacaacagcgacccguuguccuacccagggcgagccguaucuaaaagaagaacaagaccagcaauacauaugccgacgugacguaguggaccgcggcugggguaacggauguggccucuucggaaaagguggcguggucacaugcgccaaauuuuccugcagcggaaaaauaaccgguaaccuagugcaaaucgagaaccuagaguacacuguuguagucaccgugcacaacggcgauacacaugcgguagggaacgauacaucuaaccauggcguaacagcaaccaucacaccccgcucccccuccguugaggugaaacugccugacuacggcgagcuaacccuagacugcgagccgcgcagcgguauagacuucaaugagaugauacuaaugaaaaugaagaaaaagacauggcucguucacaaacaaugguuucuagaucucccacuacccuggacaacgggagccgacacgucugaagugcacuggaacuacaaagaaagaauggucacauucaaagucccccaugcaaagcgccaagacgucaccguccuuggaagucaagagggcgcaaugcacucggcccuagcgggcgccacugaagucgacagcggcgacggcaaccauauguucgcgggacacuuaaaauguaaaguccgaauggaaaaacuuagaauaaagggaauguccuacacgaugugcucagggaaauuuagcaucgauaaagaaauggcggaaacacagcacgggacaacugugguaaaagucaaauacgaaggcgcaggcgcaccgugcaaagucccgaucgaaauacgagacguaaacaaagaaaaagucgugggccgugucaucuccgcgacaccccuagcggaaaacacaaacagugucaccaacauagaacucgagccgccguuuggcgauagcuacaucguaaucggaguaggcaacagcgcacugacacuacauugguuuagaaagggaaguucaauagggaagauguuugaguccacuuacagaggagcaaagcgcauggcaauacucggcgagaccgcgugggauuuuggaagugugggcggacuauuuacaucccuagggaaggccguacaucaaguauucgggucuguauauacgacgauguucggaggggucucauggaugauacgcauccuaauaggcuucuugguauuauggaucggcaccaacucccgaaauacaagcauggccaugaccuguaucgccguaggcggcauuacacuauucuuaggcuucacgguccaagcagauaugggcugugucguauccuggaguggaagggagcugaagugugggagcggaaucuucguaguugauaacguacacacauggacugaacaauacaaguuucaaccagagagccccgccagacucgcguccgccauccugaaugcccacaaggauggagucugcggaaucaggucgacaacacgguuagaaaauguaauguggaaacaaaucacaaaugaacucaauuacguacugugggagggagggcacgaccucacaguggucgcgggagacgugaaaggcguacuaacaaaagggaaacgcgcgcuaacgccaccggcauccgaccuaaaauacucauggaagacuuggggaaaagcgaaaauauucaccccggaagcccgaaauuccaccuucuuaaucgacggaccugacaccagcgagugcccgaaugaaaggagagcauggaacagcuuugagguggaggacuacggcuucggaauguuuacaaccaacauuuggaugaaguuccgagaaggaucgagcgagguaugcgaccaccgccugaugagugccgcaaucaaggaccaaaaagcuguacacgcagacaugggcuacuggauugaaucguccaaaaaccaaaccuggcaaaucgagcgggcaucacucauugaggugaagacgugucuguggccuaagacccacacccucuggagcaaugggguucuagaaagccaaaugcuuauucccaagaguuaugccggaccguucucgcagcacaacuaucgacagggguaugccacgcagacagucggaccauggcaccuuggaaaacucgaaauagacuuuggagaaugccccgggacgacaguaaccauccaagaaaauugcgaccacagagggcccucccuacgaacaacgaccgcgagugggaaacucgucacgcagugguguugccggagcuguacgaugccaccccuacgcuucuugggcgaagaugguugcugguauggaauggaaauaagaccccucuccgagaaagaagaaaauauggugaagucccagguaaccgcaggccagggaaccagcgagacauucagcaugggauugcuaugccuuacccucuucguggaggagugccuacgccgaagggucacacguaaacauaugaucuuggcaguugucauaacucugugcgcaaucauccucggcggacuuaccuggauggaccuccugcgagcacuaauaauacugggcgacacaaugucaggccggauaggaggacaaacacaccuugcuauaauggcgguauuuaagaugucuccuggguacguacuaggagucuuccuucggaagcugacgagccgggagacggcccugauggucaucggaauggcuaugacgaccacacuaagcaucccacacgaccuaauggaauuaauagacggcauuagucuaggccuaauccuguuaaaaaucguuacccaauucgacaacacgcaagucgguacucuugcuuugaguuuaaccuuuauacgcucgaccaugagccucguuauggcuuggaggacaaucauggcgguucucuucguagugacccugaucccguuaugucgaacaucaugcuuacaaaaacagagucacugggucgagauuacugcacugauccucggggcccaagcacuaccaguguaccuaaugacacuaaugaaaggcgcgucgcgacgcuccuggccgcuaaaugaaggaauaauggcugucggacugguaucccuccuggguuccgcacucuugaagaacgaugugccccucgcgggccccaugguggcaggcgggcuacuccucgcagcauacgucaugagcggaagcagugcugaccugucccuagaaaaggccgcgaaugugcaaugggaugaaauggcugacaucacagguuccucaccgauaaucgaggugaaacaggaugaggacgguaguuucaguauaagggacguggaagaaaccaacaugauaaccuuacucguaaaacuugcucucaucaccgucagcggccuguaucccuuggcgauaccggugaccaugacacucugguacauguggcaaguaaagacgcaaagaagcggcgccuuaugggaugucccuuccccagccgcuacccagaaagcggcccucucugagggugucuaucgcaucaugcaaagaggacuauuuggaaagacacaggucggggucggcauucacauggagggaguguuucacacaauguggcacgugacccgcgguagcgucauaugccaugaaaccggccgccuagagcccucgugggcggacguacguaacgacaugaucucguauggggguggauggagauuaggcgacaagugggacaaggaagaagacgugcaagugcuggcaauagagcccggaaagaacccaaaacacgugcaaacuaaaccaggacucuuuaaaacgcugaccggcgagaucggcgcuguaacacuagacuuuaaaccaggaacuucaggaagcccaaucauaaaccgcaaggguaagguaaucggacuguacgguaauggggucgucacgaaguccggagacuacgugagcgccauaacccaggccgaaaggauaggcgaaccugacuacgaagucgacgaagacauauuccggaagaaacgauuaacgauuauggaccuccacccgggcgcggggaaaacaaagcgaauccucccgucaauaguucgagaagcacugaagagacgccuucgcacguuaauauuagcacccaccagaguaguagcagcugagauggaagaagcacugcgcggccucccgauuagguaccaaaccccggcggucaagucugagcauacggggagagaaauagucgaucuaaugugucacgccacauucacgacccggcuacugagcagcacgcggguccccaacuauaaccuaauugucauggaugaggcccacuucacggacccguccagugucgcagcuagaggcuacauaagcacaagagucgaaaugggcgaggcugcagccaucuucaugaccgcgaccccaccaggggcaacagaccccuuuccccaaucgaacaguccgaucgaagacauagagagagaaauuccagagcgaucauggaacacgggauuugacuggauuacugacuaccaaggaaagaccgucugguuugucccaucuauuaaagccggcaacgacaucgcaaacugccuacgaaaguccgggaagaaggugauccaacuuagcagaaaaacguucgacaccgaguauccaaagaccaaacuuacggacugggacuucguaguuacaacagauauaucugaaaugggcgcaaacuucagagcgggcagagucaucgacccaagacgaugccucaaaccgguaauauuaacugauggcccagagagagugauccucgcgggcccgauccccgucacgcccgccucggccgcucagagacguggcaggauaggacgcaacccagcccaggaagacgaucaguaugucuucagcggggacccacucaagaacgacgaggaucaugcgcacuggaccgaggcuaagaugcuccucgacaacauuuacaccccggaaggaaucauucccacguuguucgggccagaacgagagaagacucaggcaauagacggcgaguucagauuacguggggaacaaagaaaaaccuucguagaacuaaugcgccgaggagauuuacccguauggcucagcuauaaaguggccucagccggaauaagcuacaaggacagagaguggugcuucacgggggaacgaaacaaccagauucuggaggagaauauggaaguagagauauggacuagagagggcgaaaagaagaaacucagaccaaaauggcucgacgcgagaguauacgcagacccaauggcccuaaaagacuucaaagaguuugcauccggccggaaaucaauaacccuagacauacucacggagauagcaucccuaccuaccuaccuaucguccagagcuaaacuggcgcuagauaacauugucaugcuccacaccacugaaagagggggcagagcauaucaacacgcccucaacgaguugcccgaaaguuuagagacccucauguugguggcacuucugggcgcuaugacagcgggaauauucuuguuuuucaugcaagggaaaggaaucggcaaguugucgaugggacuuauuaccauagcaguggcuucggggcucuuauggguagcggaaauccaaccccaguggauagcggcaucuauuauacuggaguucuuucuaaugguacuacugaucccagaaccugaaaagcagaggacgccacaagauaaccagcucaucuacgucauccugacgauauuaacuaucaucggacugauugccgccaacgagaugggacuaauagagaagacaaaaaccgacuucggcuucuaccaaguaaaaacagagacgacaauacuagauguggaccucagaccagcaucagccuggacccuguacgccguagcaaccacaauacucacucccaugcuccgucauaccauagagaacacuucagcgaaccuaucccuggcagccaucgcgaaccaagcugccguccugaugggccucggcaagggcuggccacuccaccgaauggacuugggaguacccuugcucgcgaugggguguuauucucaagucaauccgaccacgcugacugcaucucuagucauguuacugguacacuacgccaucauuggaccaggguugcaagcgaaagcgacgagggaagcccagaaaagaaccgcagcuggcauaaugaaaaacccaacagucgacgguauaacaguuauagaccuagaaccaaucagcuacgauccaaaauuugagaagcagcuagggcaaguuaugcuacucguacucugcgcgggccagcuccuuuugaugcgaacgacgugggcauucugcgaagugcugacccuagccaccggaccuauucuuacacuuugggaggggaauccagggcgcuucuggaacacaacuauagccgucuccacggccaacaucuucaggggaagcuaccucgccggcgcaggccuagcauucucccuuaucaaaaacgcacaaacaccaagacggggcaccggaacugccggcgagacacucggagagaaguggaagaggcagcucaacucccuagacaggaaggaguucgaagaauacaagaggagugggauacuggaaguagaccggaccgaagcgaaaucggcccuuaaggacgggucaaaaauuaagcacgcagucucacgggguagcagcaaaauccgauggaucguggaacgcgguauggucaagccgaagggaaaagucguggaucuaggcugcggacgcggaggauggagcuauuacauggccacccucaaaaacguaacggagguaaaaggauacaccaagggagguccaggccacgaagaaccaauaccgauggcgacauacggauggaaucugguaaagcuccacuccggaguggacguauucuacaaaccaaccgaacaggucgacacucuucucugcgacauuggcgaaucguccaguaacccaacgaucgaagaagggaggacacugcgcguauugaaaauggucgaaccguggcuuucgaguaaaccagaguucugcauaaagguccugaacccauauaugccgacaguaauugaagaacucgagaaacuacaacggaaacacggagguaaccugguuaggugcccacuaucccgaaacagcacccacgaaauguauuggguaucgggagcauccggaaacaucgucagcagcgucaacacaaccaguaagaugcuccuuaaccgcuucaccacacgucaccgcaaacccaccuacgagaaagacguagaucuaggcgcuggcacccgcucagucagcacagagacggagaaacccgauaugaccaucauagggcgaaggcugcagaggcuacaagaagaacacaaagaaacguggcacuacgaccaagagaauccauaccgcaccugggccuaccauggaagcuacgaagcacccucuacgggguccgcaucauccaugguuaacgguguugugaagcuccuuacgaagccuugggacgucaucccuauggucacgcaacucgcgaugacagauaccacaccuuucggccaacagcgagucuuuaaggaaaaaguggacacacgaacuccccaaccgaagcccggcacccgaaugguaaugacaaccacagccaacuggcucugggcgcuacucggcaagaaaaagaaccccaggcucugcacacgcgaagaguucaucucaaagguacgaucgaacgcagcuauaggggcggucuuccaggaagaacaaggcuggacuuccgcaucggaagcaguaaacgacagccguuucugggaauugguggauaaagagagagcuuuacaccaagaagggaaaugcgagagcugcgucuacaacaugaugggaaagcgcgagaagaaacuuggugaauuuggaagggcaaaaggaucacgggcgauaugguacauguggcugggggcgcgcuuucuggaguucgaggcuuugggauuucugaacgaggaucacugguuuggccgugagaacuccuggucaggcguagaaggcgaaggauuacacagauugggauacauccuggaggagaucgacaagaaagauggcgaccuaauguacgcagacgacacagcagggugggacacacgcauaaccgaggaugaccuacaaaacgaagaauuaaucacagagcaaauggcaccccaccauaaaauccucgccaaagcuauauucaaacuaacguaucaaaacaaggucguaaaaguucuuagacccacuccgcggggagcggugauggauauuaucucuaggaaggaccaaaggggcagcggacaagucggcaccuaugggcugaacacauucacgaacauggaggugcaacuaauacggcagauggaggcagaaggcgucauaacacaagaugauaugcaaaacccgaagggacuaaaggagagaguugagaaguggcuacgggaauauggcguugaccgccugaaaaggauggccaucucaggggaugauugcgugguuaaaccgcucgacgagcgcuucggcaccuccuugcuuuuccuaaacgauaugggcaaaguacggaaggacauaccucagugggagccaagcaaagguuggaagaacuggcaagaagucccauuuugcucgcaccacuuccacaagaucuucaugaaagacgggcggucgcucgucgucccuugucguaaccaggacgaacuaauagggcgcgcuagaauaucccagggggcgggcuggucucuaagagaaaccgcaugucuuggcaaggcauaugcccaaauguggagccuaauguacuuccaccguagagaccuaagacuagcgagcauggccauaugcucagcagugccgaccgagugguuuccaacaucaagaaccacguggagcauccaugcccaccaucaauggaugaccaccgaagacaugcuaaagguguggaaucggguguggaucgaagacaacccgaacaugaucgacaagacgccaguccacagcugggaggacauccccuaccuaggcaagcgagaagaucuauggugcggcagccuaaucgggcugaguucaagggcaacaugggcaaagaacauccacacagccauuacccaaguccgcaaucuaauugggaaagaagaauacguagacuacaugccagucaugaaacgguacucagcaccgucugagucagaaggcgucuuguaa

SEQ ID NO: 26320 - RNA, 9867 nt, Artificial Sequence
  derived and/or modified CDS sequence (opt11) from DENV-4__KJ596670__SS-prME
aguaccauuacccuccuaugccugaucccgacuguaauggccuuccaucuuuccacucgcgauggcgaaccgcucaugauaguggcaaagcacgaacgggggcgcccccugcuguucaaaaccaccgaagguaucaauaagugcacgcucaucgcgauggaccugggggaaaugugcgaggacacagugacauacaaguguccacugcucgugaauaccgagcccgaagacaucgacugcuggugcaaccugacguccaccugggucauguacggcacaugcacccaguccggggaacggcgccgcgaaaagcgcagcguggcacugacgccucauuccgggaugggccuugagacccgggccgaaacuuggaugagcuccgagggggccuggaagcacgcccagcgaguugagagcuggauccugcggaaccccggcuucgcucuguuggcaggguuuauggcauacaugaucggccagacugggauccagcggacagucuucuucguucugaugaugcugguagcccccuccuauggcaugcggugcgucggcguggggaaccgcgacuucguugagggaguuagcgggggagcguggguggaucucguguuggagcauggcgggugugucaccaccauggcucaggggaagcccacccuugacuucgagcucaccaagacgacugccaaggagguggcccugcugaggacuuacugcaucgaggccuugauuucaaacaucacgacagcgacccgcugcccgacccaaggggagccuuaccugaaggaggagcaggaucagcaauacaucugcagacgagacgucgucgaccgggggugggggaacggauguggccuguuugguaagggagggguggucacuugcgccaaguuuagcugcuccgggaagauuacugggaaccucgugcagaucgagaaccuggaguacaccgugguggugaccgugcauaauggcgacacgcacgcggucggcaacgacacaagcaaucacggcgugaccgccaccaucacgccccggagccccucaguggaggugaagcugccggacuacggcgagcucaccuuggacugugagccccggucagggaucgauuucaacgagaugauacuaaugaagaugaagaaaaagaccuggcucgugcacaagcagugguuccuggaccuucccuugccguggaccaccggcgccgacacgagcgagguccacuggaacuacaaggagcgcauggucaccuucaaagugccgcacgcgaagcggcaagaugugaccgugcuggguucucaggaaggcgccaugcacagugccuuagccggugccacagaggucgacuccggggacggcaaccacauguucgcggggcaccucaagugcaagguccgcauggagaagcugcguaucaagggcaugucguacacgaugugcagcgggaaauucuccaucgauaaggagauggccgagacccaacaugggaccaccguagugaaagugaaguacgagggcgccggggcccccugcaagguccccaucgagauccgugacguaaacaaagagaaaguugucggucgggugauuagugccacgccucuggcugaaaacacuaacaguguaacaaacaucgagcucgagccacccuucggggacagcuacauugucauagggguaggcaacagcgcccugacccuacacugguuucggaaggggaguuccaucggcaagauguucgagagcaccuaucgcggggccaagcggauggccauacucggcgagaccgcgugggauuucgggucaguagguggccucuucacgucgcuggggaaagccguccaucaggucuucgggucaguguacacaacgauguucggaggggucagcuggaugauucgcauacugaucggguuccugguccuuuggauaggcaccaauagccguaacaccucaauggccaugaccugcaucgcagugggagggaucacgcuguucuuaggguucaccguccaggcggacaugggcugcguaguguccuggagcggucgcgagcugaaauguggauccggcaucuucgucguggauaacguacacaccuggaccgagcaguacaaauuucagcccgagagccccgcacgucuggcuagcgcaauccucaacgcccacaaagauggggucugcgggauccgcucgacaacacggcuagaaaacgugauguggaaacagauaacaaaugaacuaaacuacguguuaugggagggcgggcacgaccugaccguagucgccggcgacgugaagggcgucuuaaccaaggggaagcgggcgcucaccccgccugccagcgaccuuaaguacuccuggaagaccuggggcaaagcgaagauauucacccccgaggcccguaauagcaccuuccucauugauggccccgacacaucagaauguccgaacgaacgccgcgccuggaauagcuucgagguggaggacuacggguucgggauguucacuaccaacauauggaugaaguuccgggaggguuccagcgaggugugcgaucaccgccuuaugucugcggccaucaaggaccagaaggccguacaugcggacaugggcuauuggaucgaguccucuaagaaccaaacguggcagauugagagagcgagccuuaucgagguaaagacuugccuguggcccaagacccacacccuaugguccaacgggguucuagaaucgcagaugcugauccccaaauccuacgccggcccguuuagccagcauaacuaucgacagggguaugccacccagacggucggccccuggcaccucggaaaguuagagaucgauuuuggagagugcccagguaccaccgugaccauacaggagaauugugaccaccgcgggccguccuugcguacuaccaccgcgucgggcaagcucguaacccaauggugcugccgcagcuguacgaugccgccccugcguuuccugggggaggacgguugcugguaugguauggagauacggccccucuccgaaaaggaggaaaacauggucaaaagccagguuacggccggccagggcaccucugagaccuucaguaugggcuuacugugccucacauuauucgucgaggagugccugagacggcgcgugacccggaagcauaugauccuagcaguaguaaucacucugugcgccauuguucuaggcggucuaaccuggauggacuuguuacgcgcacugaucaugcugggcgacacgauguccggaaggauuggcggccagacccaccuggccaucaucgcuguguuuaaaaugucuccagguuacguccucgguguguuccuucgcaaacuaacaucccgggagaccgcucucauggugaucggaauggcgaugacgacuacgcugucgaucccccacgaccugauggagcuuaucgacgggaucucccuggggcugauacuucugaagaucgucacccaguucgauaacacccagguggggacccuggcacucagccucaccuucauccgcucgaccaugucacuggugauggccuggaggacgaucauggcgguccuauucguugugacgcugaucccgcuuugccgcaccucaugccuccaaaaacaaagccacuggguagagaucacggcgcuuaucuugggggcucaggcacugcccguguaccucaugacguuaaugaaaggggcaucgcgucgcagcuggccacucaacgagggcaucauggcgguggggcuggucucccuacucggcucggcuuuacugaagaacgacgugccgcuagccgggccgaugguugccgggggucugcugcucgcagcguacgucauguccggguccagcgcugaccugucccuagagaaggccgcgaacgugcaaugggacgagauggccgauaucaccggcucgucgccgauuaucgaggugaaacaagacgaggacgggagcuucuccauucgggacguagaggaaaccaauaugauaacacucuuggugaagcuggcgcucaucacggugagcgggcuguacccccuggcaaucccuaucacuaugacccucugguacauguggcaagugaagacucagcgcucaggcgcccugugggacgugcccagccccgccgcaacccagaaggcggccuuguccgagggaguguaucggaucaugcagagaggccuuuucggcaaaacgcagauaggcguagggauccacauggagggcgucuuucacaccauguggcacgugaccaggggcucaguaaucugccacgagacaggccgcuuggaacccaguugggccgauguucgcaacgacaugaucaguuacggcggggguuggcggcugggugacaagugggacaaggaggaggacguacaaguccuugccaucgagccagggaagaaccccaagcacguccagacaaagcccggauuguucaaaacccugaccggagagaucggcgcaguaaccuuagacuuuaagccagggacgucagggagcccaaucaucaaucgaaagggcaaggucaucggacuguacggcaacggcgucguuaccaaguccggcgacuacgucagcgcgauuacccaggccgagcggaucggggagcccgauuacgagguggacgaggacaucuucaggaagaaacggcugacgaucauggaccuccacccuggcgccgggaagacgaagcgcauccuccccucuaucguacgggaggcguuaaagcgccggcugcgcacccucaucuuagcccccacacgugucguggccgccgagauggaagaggcgcugcgcggccucccgauacgguaccagacccccgcggugaagucagagcauacgggccgugagaucgucgaccugaugugccacgcaaccuucaccacccggcugcucuccagcacgcgcguaccgaacuauaaccuaauaguuauggaugaggcccacuucaccgauccaagcucugucgcugcccggggcuauaucuccacccgcguggagaugggcgaggccgcggcgauuuucaugaccgccacgccgcccggagccacugaccccuuuccccaauccaacagcccgaucgaggacauagagcgggagauccccgagagauccuggaacacaggguucgacuggaucaccgacuaccagggaaaaacggucugguuugugccgagcauuaaggcgggaaacgauaucgcuaacugccugcgcaaaucaggcaagaaggugauucagcuaagucggaaaaccuuugacaccgaguauccaaagacaaagcuaacagacugggacuucguugugaccacagacaucagugagaugggggccaauuuccgcgccggccgcgugaucgacccccgccggugccugaagccggucauccucacagacgggccggagcgagugaucuuagccggccccauccccguaacgccggcaagcgccgcccaacggcgcggcaggaucgggcguaacccugcccaggaggacgaccaguacguguuuuccggcgauccccugaaaaaugacgaggaucacgcccauuggaccgaggccaagauguugcuagacaacaucuacaccccagagggcaucauccccacccuuuucgggccggagcgggaaaagacgcaggccauugauggcgaguuccgauugagaggcgaacagcgcaagaccuucguggagcugaugaggcgcggcgaccuccccgugugguugagcuacaaggucgccuccgcugggaucagcuacaaggaccgggaguggugcuucaccggcgagaggaacaaccagauccuugaagagaauauggagguggagaucuggacccgggaaggggagaaaaagaaacuccgucccaaguggcucgacgcucggguguacgcggaucccauggcccugaaagacuucaaggaguucgccagcggcagaaagagcaucacucuugacauccucaccgagauugccuccuuaccgaccuaccucagcucacgcgcaaagcucgcgcucgacaacauugugaugcuccacaccaccgagcgcggagggcgcgccuaccagcaugcccucaacgagcugccagagucguuggaaacgcuuaugcuaguagcgcugcucggggcuaugaccgccgggauuuuucuguuuuucaugcaggggaaaggaauuggcaagcugucaaugggccucauuaccauagcaguggccuccggucugcugugggucgccgagauacagccgcaguggaucgcggcuagcauuauuuuagaguucuuccuaauggugcuuuuaauaccagagcccgaaaagcagagaacaccccaggauaaccaguugaucuaugugauacuaacgauccucacgauaaucggacugauugcggccaacgaaauggggcugaucgagaagaccaagaccgacuuuggcuucuaccaggucaagacagagaccaccauacucgauguggaucugaggccggccucggcguggacccuguaugccguggcgacuaccauacucacccccaugcugcggcacacaauugaaaacacuagcgcaaacuugucccucgcugcgaucgcgaaccaagccgccguccugaugggguuggggaagggcuggccccuccaccgcauggaucuggggguuccccugcucgccaugggcugcuacagucaggucaaccccaccacgcugaccgcaucccucgugauguugcugguucauuaugcgauaaucgggccgggcuugcaggccaaggcaacuagagaagcucagaaacgcaccgcggccggaauuaugaagaaccccaccgucgacgguaucaccguaauagaccuagagcccauuagcuacgacccuaaguucgagaaacagcuuggucaggucaugcuccucgugcuaugcgccgggcaguuguugcugaugcgcacgacgugggccuucugcgagguccuuacccucgcaaccggccccauccugacgcugugggagggcaacccgggcagguuuuggaacaccaccauagcuguauccaccgcaaauauuuuccgcggcagcuaccuggccggggcuggacucgcguucucccugaucaaaaacgcgcagacgccccgucgggggacgggcaccgcgggcgaaacccucggcgaaaaguggaagcgccaacugaacucccuagaccggaaggaguucgaggaguacaaacggaguggcauucucgagguggaccggaccgaggccaagagcgcauugaaggacggguccaagauaaagcacgcggucucgcgcggauccucaaaaauaagguggaucguggagagaggcauggugaagccuaaaggcaaggucguagaccuagggugcggccgcgguggauggagcuacuauauggcaacgcuaaagaacgugaccgaggucaaggguuacaccaaaggagggccaggucaugaagaacccauccccauggccaccuaugguuggaaccuggugaaguugcacaguggcguggacguauucuauaagcccacggaacagguggacaccuuacuaugcgacaucggggagagcucaucuaacccgaccauugaggagggccggaccuugcgcguccucaagaugguugagcccugguuauccagcaaaccagaguucugcauaaagguauuaaaccccuacaugccuacugugauugaggagcuggaaaagcuccagcggaagcacgguggaaaccuggugcgaugcccucugagcagaaauuccacacacgaaauguacugggugucuggcgccagcgggaacaucgucuccagcguaaacaccacuagcaaaaugcuccugaaccgcuucacaacccggcaucgcaagcccaccuacgagaaggacgucgaccugggcgcggggacucgaagcguaucuacggagaucgaaaagcccgacaugaccaucaucggccgccgacuccagcgccugcaggaggagcacaaagagaccuggcauuacgaucaggaaaaccccuacagaacgugggccuaucaugguagcuaugaggcacccucuacgggaagcgcgucgucaauggugaacgggguggucaagcugcuuacaaagcccugggacgugauccccauggucacucaacuagccaugacagacacgacgcccuucgggcaacagcgugucuucaaggagaaaguggauacucggacgccccagccaaaacccggcacgcgcauggugaugaccaccacagcuaacuggcuaugggcccuccuagggaagaagaagaaccccagguuaugcacgcgugaggaguuuauuucgaagguccggucgaaugccgccaucggcgccgucuuucaggaagaacagggguggaccucggcguccgaggcggucaacgacagccgcuucugggagcucgucgauaaggagagagcuuugcaucaggaggguaaaugcgagucgugcguuuauaacaugauggguaagcgggagaagaagcugggggaguucggccgcgccaaagggagccgggccaucugguacauguggcuuggugcgcgcuuccuggaguucgaagcccugggguuuuugaacgaagaucacugguucggccgugaaaacucguggagcggcguggagggugagggccugcaucgccugggauacauucucgaggagauugauaagaaggacggcgaccugauguaugccgacgacaccgcuggcugggacacccgaaucacggaggacgaccuucagaacgaggagcuaaucacagagcagauggcuccccaccacaaaauccuggcuaaggcuaucuucaaguuaaccuaucagaacaaggucgucaaaguccuccgcccuacaccucggggugccgucauggauauuauaagucgcaaggaucagcggggaagcgggcagguaggaacguacggacugaacacauucacgaacauggagguacaacugauaagacagauggaggccgagggagugaucacacaggacgacaugcagaaccccaaaggccucaaagagcguguggaaaaauggcugcgcgagugugggguagaccguuugaaacgcauggcaaucuccggagacgacugcgucguaaagccccucgacgagcgcuucgggacaagucuguuauuccugaaugacaugggcaaggugcgcaaagacauuccccagugggagcccucuaaaggguggaagaauuggcaggaggugcccuucugcagccaccacuuccacaagaucuuuaugaaagauggacggucccugguuguccccugucgcaaccaggacgagcugaucggccgggccagaaucucccagggggcgggcuggucgcucagagagacggccugccuagggaaggccuacgcgcagauguggucucucauguacuuucaccggcgcgacuugaggcucgcuucgauggccaucuguucagccguccccacugaaugguucccaaccagccgcaccacgugguccauccacgcacaccaccaguggaugacaaccgaggacaugcugaaaguguggaaccggguguggauugaggacaauccuaauaugauugauaagacccccguccacagcugggaagacaucccuuaccucggcaagcgcgaggaccuuuggugcgggucccugauuggguuaucuucucgggcuacaugggccaaaaauauccauacagccaucacccaggugaggaaccuuaucggcaaagaagaguacguggacuacaugucugucaugaagcguuacucugccccgagcgaauccgaaggggugcuguga

SEQ ID NO: 26321 - RNA, 9867 nt, Artificial Sequence
  derived and/or modified CDS sequence (opt11) from DENV-4__KJ596671__SS-prME
agcacuaucacccugcuaugcuugauccccacggugauggcauuccacuugucuacgcgggacggcgaaccucucaugaucgucgcuaagcacgagcgggggcgcccccugcuguuuaagaccaccgagggcaucaacaagugcacgcucauugcgauggaccugggagaaaugugugaagauaccgugaccuauaagugcccccugcuagugaacaccgagccugaagauaucgacugcugguguaacuugacgagcaccugggucauguacgguaccugcacccaguccggggagcgucgccgcgagaagcgcagcguugcccugacgccgcacuccggcaugggccucgagacgcgggccgagaccuggaugagcagcgagggggccuggaagcacgcccagcgcguagaaagcuggauccugcggaacccgggcuucgcgcugcuugcugguuucauggcauauaugauaggccagaccgguauccagcgcacggucuucuucguucucaugaugcugguggcacccuccuacggaaugcgaugcgucggcguggggaaucgcgacuucguggaaggcgucagcgggggcgcguggguugaccucgugcuggagcauggcggguguguuaccacgauggcucagggcaagcccacccuggacuuugagcucaccaagaccaccgccaaggagguggcccugcugaggaccuacugcaucgaggcccucaucaguaacauuacgaccgcgacgaggugcccuacgcagggggaaccuuaccuuaaggaggagcaggaccagcaguacaucugccggcgcgacguggucgaucggggcuggggcaacggaugcggccuauucggcaaaggaggggucgugacgugugcaaaguucagcugcagcgggaagaucaccgguaacuugguccagauagagaaucuggaguacaccgugguggucaccgugcauaacggcgacacgcacgccgucggcaacgacaccagcaaucacgggguuaccgcaaccaucaccccgcgcucgcccagcguggaggucaagcugccugacuacggcgagcucacgcuggacugcgagccacgguccgggauagacuucaacgagaugaucuugaugaaaaugaagaaaaagaccuggcucgugcauaagcagugguucuuggaucugccccucccguggacgaccggcgccgacacgagcgagguccacuggaacuauaaagagcggauggucaccuucaaggugccgcacgccaagcggcaggacgugacgguccuggggucccaggagggcgccaugcacagcgccuuggccggcgcuaccgagguggacagcggggacggcaaucacauguucgcgggacaccucaaaugcaaggugcgcauggagaaacugcgcaucaagggcauguccuacacgaugugcagcgggaaguucaguaucgacaaagagauggcagaaacgcagcacgggaccaccgucgugaaagugaaguacgagggagccggagcccccuguaagguucccaucgagaucagagacgucaauaaagaaaaaguggucgggcgcgugaucucggccacaccccuggcggaaaauaccaacuccgugacuaacaucgagcuggaaccgcccuuuggggauucguacaucguaaucggagugggcaacucugccuuaacccuacacugguuccguaaggggucguccaucggcaagauguucgaaagcaccuaccgcggggccaaacggauggccauccucggcgagaccgcgugggacuucggguccgugggcggccuguucaccucucuggggaaggccguccaccaaguguuuggcaguguauauaccacgauguucgggggugucagcuggaugauccguauccucaucggcuuccugguacuguggaucggcaccaacucccggaacacuagcauggccaugaccugcaucgccguuggcgggaucacuuuguuccuuggcuucaccguacaggcugacauggggugugugguguccuggagcggccgggaguuaaagugcggguccggaauauuuguagucgacaaugugcacacuuggaccgagcaguauaaauuccagcccgagucccccgcgagacuggccagcgcgauacucaaugcucacaaggauggcguaugcgguauccgcaguacgacccggcuggagaacgugauguggaagcaaaucaccaacgagcugaacuacgugcucugggagggcgggcacgaccugaccguggucgcgggcgacgugaagggcguccugacuaaggguaagcgagcgcuuacaccacccgccucugaccugaaguacucuuggaaaaccuggggcaaggccaagaucuucacccccgaggcccggaacagcacguuccugaucgacgggcccgacaccucagagugcccgaacgagcgccgggccuggaacagcuucgagguggaggacuacggcuucggaauguuuaccaccaauaucuggaugaaguuccgcgagggcuccucagaggugugcgaccaccggcucaugagcgcugcaaucaaagaucagaaagccguccacgccgacaugggcuacuggaucgagagcagcaaaaaccagacguggcaaaucgagcgcgcuagccugaucgaggugaagacgugucuguggccuaagacgcacacccuguggaguaacgggguguuggagucccagauguugauuccaaaguccuacgccggcccguuuagccagcacaacuaccgacagggguacgccacccagacgguagguccauggcaccucgguaagcuggagaucgacuucggcgagugccccggaaccaccgugaccauccaggagaauugcgaucaccgcgggccuuccuugcgcacgaccaccgccagcggcaagcucgugacccaguggugcugccggagcugcaccaugccgccgcugcgcuuccucggggaagacggcuguugguacgggauggagauacggcccuuguccgagaaggaggagaacauggucaaaagccaggugaccgccggccagggcaccuccgagacuuuuagcauggggcuccugugccuuacccuguucguugaggagugccugagaagacgcgugacccggaagcacaugauccucgcgguggucaucaccuugugcgccaucauccuuggagggcucacauggauggaucugcugagagcucugaucaugcugggugacaccauguccggccggaucggaggccagacccaccucgccaucaucgccguauucaagaugagccccggauaugugcucggcgucuuucugcguaagcugaccucccgagaaacggcccucauggugaucgggauggcaaugacgaccacccugagcaucccgcaugaccugauggagcucaucgacggaaucagccugggucugauccuucugaagauugugacccaguucgacaacacgcaggucgggacccuugccuuaagccugaccuuuauccgcuccacgaugucccuggugauggccuggcggacgaucauggccgugcucuuugucguuacccucauccccuuaugccggacaaguugccugcagaagcagucacacuggguggagaucaccgcgcugauccugggagcccaggcccuccccguauaccugaugacgcugaugaaaggggccucccggagaaguuggccccuaaacgagggcaucauggcuguggggcuaguaagucuccucggauccgcccuccuaaagaacgacguaccccuagccggccccaugguggccgggggccuccugcucgccgcguacguaauguccggauccagcgcugaucuguccuuggagaaggcugcgaacguacagugggacgagauggccgacauaaccggcagcucccccaucaucgaggugaagcaagaugaggaugggagcuucuccauacgggacguugaggagacuaacaugaucacccuccuggucaaacuggcuuugaucacggugagcggccuguauccccuagccaucccgauuacaaugacucugugguacauguggcaagugaagacccagcgcucgggagcccugugggacgucccaucccccgcagccacccaaaaggcggcacuguccgaagggguguacaggauuaugcagcguggccucuucgggaagacacaggugggcgugggcauccacauggagggcguauuccacaccauguggcacgucacccggggcagcguaaucugccacgaaaccgggagacuggagccuuccugggccgauguccggaacgacaugaucagcuacggcgggggauggcgucugggagacaagugggauaaagaggaagacgugcagguccucgcuauugagccggggaagaaccccaaacacgugcagacuaagcccggucuguucaagacccugaccggggagauuggggcaguuacccucgacuuuaagcccggaacguccggaucuccgaucaucaaucgcaaaggaaaggucaucgggcuguacggcaacggcguugugacuaaguccggcgacuauguaagcgcgaucacccaggccgagcguaucggggaaccugacuacgagguggacgaggacauuuuccgcaagaagcgccuaacaaucauggacuuacacccgggcgccggcaagacgaagcgcauacugcccucaaucgugcgggaagcccuaaagcgccgguugagaacccuaauccuggccccaacccgggucguggcagccgaaauggaggaggcccugcguggguugcccauccgcuaccaaacccccgccgugaaaagcgagcacacgggcagagagaucgucgaccugaugugucacgcaaccuucaccacccggcugcuguccaguacgcgcgugccgaacuacaaucugaucguaauggacgaagcgcacuucacggaccccagcuccgucgccgcccggggguacaucagcacccgcguggaaaugggugaggcagcugccauuuucaugaccgccacgccgccgggugcuaccgacccguucccucaguccaacagcccaaucgaggacaucgagcgagagauucccgagcgauccuggaacacgggauucgacuggaucacagacuaccagggcaagacggucugguuugugccgagcaucaaagccgggaacgacaucgcgaacugccugcgcaaguccgggaagaagguaauccagcugagccggaagaccuucgauaccgaguaccccaaaaccaaacugacggacugggacuucgucgugaccaccgacaucuccgagaugggggcgaacuuucgcgcuggccgggugaucgacccccgcagaugccugaagcccgucaucuuaacagacgggccggagcgcgugauccuagccggcccgaucccugugacucccgcgagcgccgcccagcguagaggccggaucggacgcaacccagcccaagaagacgaccaguacguauuuuccggggacccguugaagaacgacgaggaccacgcacacuggaccgaggcgaagaugcucuuagacaacaucuauaccccggaggggaucauccccacccuguuuggcccagaacgggaaaagacgcaggcuauagacggcgaguuccgccucagaggggaacagcgcaagaccuucguagaacucaugcggcgcggcgaccugcccguguggcucagcuauaaggucgcguccgcugggaucagcuauaaggaccgggaauggugcuucaccggcgaaaggaacaaucagauccuggaggagaacauggagguggaaaucuggacccgugagggggagaaaaagaagcugaggccaaaguggcucgacgcccguguuuacgcggaccccauggcauuaaaggauuuuaaggaguucgccuccggccgcaagucgaucacacuggacauccuuaccgagauugccucccugccgaccuaccugaguagccgcgccaagcuggcacuggacaacaucgucaugcugcacaccaccgaacggggcggucgcgccuaccagcacgcccucaacgagcugcccgagucacuggagacucucauguugguggcacuucucggcgccaugaccgcaggaaucuuccuguucuucaugcaaggcaaggggaucggcaagcugagcaugggucucaucacaaucgccgucgccuccgggcugcuguggguagcugagauccagccccaguggaucgccgccucgauaauccucgaguucuuccugauggugcuucucauaccggagcccgaaaagcagcggacuccccaggacaaccagcugaucuacguuauccugacgaucuuaaccauaaucggccugaucgccgcuaacgagauggggcugaucgagaagaccaagacagauuucggguucuaccaaguuaaaacggaaaccaccauccucgacguggacuugcgcccggcaucugcguggacgcucuacgccguugcgacgacgauccucacuccgaugcugcggcacaccaucgagaacacgagcgcaaaccugucgcucgccgcaaucgccaaucaggccgccguccucaugggccugggaaaaggcuggccccuccaccgcauggaccugggggugccucugcuagccaugggguguuacagccagguaaaccccaccacccugacugcgucccuggugaugcuccuggugcauuaugccaucauugggccgggccugcaggcaaaggccacgcgggaggcgcagaagcgcaccgcugccggcaucaugaagaacccgaccguugacgggaucaccguaaucgaccucgaaccuaucagcuacgaucccaaguucgaaaagcagcugggccaaguaaugcugcucgugcucugcgcggggcagcugcuucugaugcggaccaccugggccuucugcgaaguccugacacuggcuaccggcccgaucuugacgcugugggaagggaaccccggccgcuucuggaacaccacgauagccguguccacggccaauaucuuucgggggucuuaccucgcaggcgccggccuggcguucucccugauaaagaacgcccaaacaccccgacggggcaccgggaccgcuggggagacccucggcgagaaauggaagcgccagcugaacagccuggaucgcaaggaguucgaggaguacaagcgcucuggcauccucgagguggacagaaccgaggccaagagcgcccugaaggauggguccaagaucaagcaugcggucucccgcggcuccagcaagauccgguggauuguggagcgcgggauggugaagcccaagggcaagguuguggaccugggguguggccgaggcgggugguccuacuacauggccacccucaagaacgugaccgaggucaagggauacacgaaagggggcccgggccacgaagaacccauccccauggccacauacggcuggaacuuggucaaacugcauagcggcguggacgucuucuacaagcccacugagcagguagacaccuuacuuugugacaucggggagagcuccagcaacccgaccaucgaggagggccggacgcuacgcgugcucaagauggucgagccaugguuguccucaaagcccgaguucugcauuaaagugcuuaaucccuacaugccgacugugaucgaggagcuggagaagcuccagaggaaacacgggggcaaccugguccguugcccccugucccggaacagcacccacgaaauguacuggguauccggcgccagcgggaacauagucaguagugugaacaccaccucgaagaugcuccugaaccgauucacgacgcggcaccgcaagccaaccuacgagaaagacguugaucuaggcgcgggcacucggagcgucucuacggagaucgagaagcccgacaugaccaucauaggacgccggcugcagaggcugcaagaggagcacaaggagacauggcauuacgaccaggagaauccguaucggaccugggccuaccacggcagcuacgaggccccauccacgggcagcgccuccagcauggugaauggaguugucaagcugcuuacgaagcccugggacgugaucccgauggugacgcagcuggccaugaccgauacgacucccuucgggcaacaacgcguguucaaggagaagguggauacccggacaccccagcccaagccggggacgcgcauggugaugaccaccaccgccaacuggcugugggcccuccuggggaaaaagaagaacccccgccuaugcacgcgcgaggaguucauuuccaagguccggagcaacgccgcgauaggcgccguguuccaggaagaacagggauggacuagcgcuuccgaggcugugaacgacucccgcuucugggagcucgucgauaaggagagggcacugcaucaggagggcaaaugcgaguccugcguguacaacaugaugggcaaacgcgagaagaagcugggggaauuuggccgagcaaaggggagucgugccaucugguacaugugguuaggcgcgcgguuccuggaguucgaggcgcugggguuucucaacgaggaccacugguucgggagagaaaauuccuggagcggcguagagggggagggccugcaucgcuugggguacauccucgaggagaucgacaagaaggacggcgaccuuauguacgccgacgacaccgccggcugggacacccgcauuacugaggacgaccugcaaaacgaggaacucaucaccgagcagauggcgccccaccacaagauccuugccaaggccaucuucaagcugaccuaucagaacaaggucguuaaggugcuccgcccgacaccccggggcgccguuauggacaucauaucacgaaaggaccagcggggcagcggucaggucggcacguacggguugaacacguucaccaacauggaggugcagcugauccgacaaauggaggccgaaggcgucaucacucaggacgacaugcagaaccccaagggccucaaagagcggguggagaaguggcugcgugagugugggguggaucggcugaagcgcauggcgaucuccggcgacgacugugucgugaagccccucgaugagcgguucgguaccagccugcuguuccuuaacgacauggguaaggucagaaaggauaucccccaaugggagccguccaaaggguggaaaaacuggcaggaggucccauuuuguagucaccauuuccacaagaucuucaugaaggacggccggucccugguggugccgugccgcaaccaagaugaacuuaucggcagggcuagaaucagccagggugccggaugguccuugcgcgagacugccugccuggggaaggcauacgcgcagauguggucucugauguacuuccaccgacgcgaccuccggcuggccuccauggccaucuguucugcaguucccacugagugguucccgaccagccgcaccacgugguccauccacgcccaucaccaguggaugacaacugaggacauguuaaaaguuuggaaccggguguggaucgaggacaaccccaacaugauugacaaaacucccguccacagcugggaggauauccccuacuugggcaagcgcgaggaucuguggugugggucccuaaucggcuugagcucucgggcgacgugggccaagaacauccacaccgcgaucacccagguacgcaaccugaucggcaaggaggaguauguugacuacaugagcguuaugaagcgcuacuccgccccgucugaguccgagggugugcuguga

SEQ ID NO: 26322 - RNA, 9867 nt, Artificial Sequence
  derived and/or modified CDS sequence (opt11) from DENV-4__KJ579241__SS-prME
agcacgaucacgcugcucugcuugauccccacggugauggccuuccaucuguccacucgcgacggcgaaccgcucaugauugucgcuaagcacgagcgggggcgucccuuacuguucaagacgaccgaaggcaucaauaagugcacgcucauagccauggauuuaggggagaugugcgaagacaccgugaccuacaagugucccuuacucgugaauaccgagcccgaggacaucgacuguuggugcaaccucacgucaacuugggucauguacggaaccugcacccaguccggagagaggcgccgugagaagcgcucgguggcccucacgccgcauucagguaugggccuggagacccgggccgagaccuggaugucguccgagggggccuggaagcacgcccagcgcguggagucauggauccugaggaauccggguuucgcgcugcucgccggauucauggcuuauaugaucggccagaccgggauccaacguacgguguucuuuguguugaugaugcuuguggcccccuccuauggcaugcggugcgucggcguggggaaccgcgacuucguggagggcgugagcggaggagcguggguggaucucguccuggagcacggcgguugcgucaccaccauggcccagggcaagcccacgcuggacuucgaguuaacuaagaccaccgccaaggagguggcgcugcugcggacuuacugcaucgaggcccuuauauccaauaucacgaccgccacccgcugccccacgcagggcgagccguaccuuaaggaggagcaggaccaacaauacauuugccgccgcgacguugucgaccguggcugggggaacggcugcggcuuauucgggaagggcgggguggucacgugcgcaaaguucagcugcuccggcaagaucaccgggaaccucguucagauagagaaccuggaguacaccguggucgucaccgugcacaacggcgauacgcacgcaguaggcaaugacaccagcaaccacggggugacugcgaccaucacgccccguucccccucuguggaggucaaguuaccugauuacggggagcucacccuggacugcgagccgcgguccgggaucgauuucaacgagaugauuuugaugaagaugaagaagaaaaccuggcucgugcacaagcagugguucuuagaccugcccuugcccuggaccaccggcgcugauacgagcgaggugcacuggaacuauaaggagcgcauggucaccuuuaaaaucccgcaugcgaagaggcaggacgugacuguccuuggaucgcaggagggagccaugcacagcgcccuggccggagccaccgaggucgacagcggagacggcaaucacauguucgcggggcaccucaaguguaaagugcgcauggagaaacugcgcaucaagggcauguccuacacgaugugcagcggcaaauucuccaucgauaaggagauggccgagacccagcacggcaccacaguggucaaggugaaguacgagggcgccggggcgcccuguaaggucccuaucgagauucgugacgucaacaaggagaagguugugggccgcgucauaucggccacaccccuggcggagaacaccaacuccgugacgaacaucgagcucgagccuccguucggggacagcuacauugugaucggcgucggcaacuccgcccugacccugcacugguuccggaagggcagcucgaucgggaaaauguuugagagcacguaccggggagccaaacguauggccauucugggcgagaccgcgugggauuucggguccgugggcggccuguuuaccucccugggcaaggccgugcaccaggucuucggcuccguguacaccacgauguucggcggcguguccuggaugauccgcauucucauuggcuuccuugucuuauggauugguaccaacucccgcaacaccagcauggcuaugacaugcauagcugucggcgggaucacgcuguuucucggcuuuaccgugcaagccgacaugggaugcgucgugaguuggucaggccgcgagcugaagugcggguccggcaucuucguagucgauaacgugcacaccuggaccgagcaauacaaguuccagcccgagagcccugcacggcuggccagcgccaucuuaaacgcgcauaaggacggcguguguggaauacgcuccacgacccggcuggagaacgucauguggaagcaaauuaccaacgagcugaacuacgugcucugggagggcgggcacgaccugaccguagucgccggggacguaaaaggggugcucaccaaagguaagcgcgcguuaacuccgcccgccagcgacuugaaguacaguuggaagaccuggggcaaggcuaagaucuucacccccgaggcccggaacucgaccuuccugauagacgggcccgacaccuccgagugcccaaacgagagacgggccuggaacagcuucgaggucgaggacuacggcuucgggauguuuaccaccaauaucuggaugaaguuccgcgaaggcagcucggaggugugcgaccaccggcuuaugucugcugcuaucaaagaccagaaagccgugcacgccgacauggguuacuggauugaguccuccaagaaccagaccuggcagaucgaacgcgcgucucugauagaggucaagaccugccuguggccaaaaacucacaccuugugguccaacgggguacucgagucucagaugcugauccccaaguccuaugccgguccauucagccagcacaacuaccggcagggguacgccacccagacggugggccccuggcaccuagggaagcuggagaucgacuuuggcgaaugccccggcaccacagucaccauucaggagaacugcgaccaccgcgggcccucccuccgcacgaccaccgccagcggcaagcucguaacccaguggugcugccggucguguacgaugccgccccuucgcuuccuuggggaagacgggugcugguacggcauggaaauccggccccuuuccgagaaggaggaaaacaugguuaaaagccaggugaccgcgggucagggcacuuccgagaccuuuucgaugggacugcuaugccucacccuguucguggaggagugccugcgccggcgcgucacgcggaagcacaugaucuuggcgguggucaucacgcugugcgcaauaaucuuaggcgggcuaacauggauggaccuucugagagcccucaucauccugggcgauacgauguccggccgaauagggggucagacucaccucgccaucauggccguguucaagaugagcccuggguacgugcuaggaguguuccugcguaagcugaccucccgugaaacugcucuaauggucauaggaauggcuaugacgaccaccuuguccaucccgcacgacuugauggaacucaucgacggcaucucccugggccugauccuccugaagauuguaacacaguuugacaacacgcaaguggggacccuggcgcugucucugaccuucauacgcagcaccaugagccuagugauggccuggcggacgaucauggccgugcuuuucgugguaacucugaucccccugugccgcaccuccugccuccagaagcagagccacuggguggagaucacagcgcugauccugggcgcccaggcauuacccguguaucugaugacgcugaugaagggggccucccggcgcagcuggccccucaacgagggcaucauggcgguugggcuggucucccugcucgguagcgcccuacugaaaaacgacgugccgcucgccggccccauggucgccgggggcuugcugcucgccgcguacgugauguccggcagcucggccgaccugucucuugagaaagccgcaaacgugcagugggacgagauggcagacauaaccggcagcucccccauaaucgaggugaagcaggacgaggacggcucguucuccauccgggacguagaggagacuaauaugauaacccuccuggugaaacuugcgcucaucacugucagcggccuguauccucuggcgauaccuauaaccaugacucucugguacauguggcaagugaagacucagcgauccggcgcacugugggacgugccuagcccagccgcuacccagaaggcugcacuguccgagggggucuaccggaucaugcagcgcggccucuucgggaagacacaagugggcguggggauccauauggaaggcguauuucauacuauguggcacgucacccggggcagcgugaucugccacgagaccggacgccuggagcccuccugggccgauguccgcaacgacaugaucagcuacggaggggguuggcgacuuggcgacaagugggauaaggaggaggaugugcagguccuugccaucgagccggggaagaaucccaagcacguccagacgaagcccggccuguuuaagacccugaccggagaaaucggcgccgugacccucgacuuuaagcccggaaccucuggcucucccaucauuaaccgcaagggcaaggugaucgggcuguacggcaacggagucgugaccaaguccggcgacuacgugagcgccaucacccaggcugagcggaucggggagcccgacuacgaggucgacgaagacauauucaggaaaaagcggcugaccaucauggaccuccaucccggcgcagguaaaacgaagcgcauccugccgagcaucgugcgggaggcucugaaacgccggcuucgcacccucauccucgcgccuacccgggugguagccgcugagauggaggaggcauuacgggggcuccccauccgguaccagacccccgcuguaaagagcgagcacacgggcagagagaucguggaccugaugugccaugcgaccuucaccacucggcugcucuccagcacgcgcguuccgaauuauaaccugaucgugauggacgaggcccacuuuacugaccccagcuccguggcagccagaggauauaucagcacucgcgucgaaaugggugaggcugcugccaucuucaugaccgccacaccacccggggcaacugacccauucccccaguccaacagccccauagaggacauagagcgggagauccccgagcgcuccuggaacaccggcuucgauuggauaacugacuaccagggaaagaccgugugguuugucccgagcaucaaggccgguaaugacauugcgaacugccugcgcaaguccggcaagaaggugauccaacucucucggaagaccuucgauaccgaguaucccaagaccaaacugacggacugggacuucguggucaccacugacaucuccgaaaugggggccaacuuccgugccggccgggugaucgacccccggaggugccuuaagcccgugauccugaccgacgggccggaacgcgucauccuggccggccccaucccuguaacgccagcgagcgccgcccagaggcgcggccggaucgggcgcaacccggcccaggaagacgaccaguacguguuuuccggcgacccccugaagaacgacgaggaccacgcucacuggaccgaggcgaagaugcuccuggacaauaucuacaccccagaaggaaucauucccaccuuauucggccccgagcgugagaagacgcaagcuaucgacggugaguuccgccuccggggcgagcagaggaagaccuucgucgaguuaaugcggaggggcgaccugccgguauggcugagcuacaaaguagccuccgccgggaucagcuacaaagaucgggaguggugcuucacaggcgaacgcaacaaccaaauccuugaggagaacauggaggucgagaucuggacccgggaaggggagaagaagaagcugcgccccaaguggcucgacgcucggguguacgcggacccaauggcucuuaaggacuucaaggaguucgccagcggcagaaagagcaucacacuugacauccucacggagaucgccagucugccgaccuaccugagcucccgcgccaagcucgcguuagauaauauugugaugcuacacaccaccgagaggggcgggcgggccuaccaacaugcccucaacgagcugcccgagagccuggaaacgcucaugcuggucgcccugcucggcgcgaugaccgcagguaucuuccuguucuucaugcagggcaaggggaucggcaaguuaagcaugggccucaucacuaucgccguggccuccgggcuacuguggguggcugagauucagccccaguggaucgcggccagcaucauccucgaguucuuucugaugguucugcuaauccccgagccagagaagcagcggacuccacaggacaaccagcugaucuacgugauccuaacgauccucacgauaaucggccugaucgccgcaaacgagauggggcugaucgagaagaccaagaccgacuucggcuuuuaccaagugaagacagaaaccaccaucuuggacgucgaccuucgccccgccuccgcguggacccuguacgccgucgccacgacgauccucacgccgaugcugaggcauaccaucgagaauacgagcgccaaccugucccucgccgcgaucgccaaccaggccgccgugcugaugggccugggcaagggcuggccccuccaccgcauggaccugggugucccccugcucgccaugggguguuauucacaggugaaccccaccacccugaccgcgucccugguuaugcuccugguccacuacgccaucaucgggccgggccugcaggccaaagccacgcgggaggcgcagaaacgcaccgcugcggguaucaugaaaaacccgaccguggacgggaucaccgugaucgaccuugagcccaucagcuacgaucccaaguucgagaagcagcugggccaagucaugcugcuagugcugugcgccgggcagcugcucuugaugcggacgaccugggccuucugcgaggugcugacccucgcgacuggaccgauccugacgcugugggaggguaaccccggucgcuucuggaacaccaccaucgccgucuccaccgcuaacaucuuccggggcagcuaccuugccggggcaggacuugcauucaguuuaauuaagaacgcccaaacgcccaggcguggaacggguaccgcuggggagacccucggcgagaaguggaagcgccagcugaacagccuagaccggaaagaguucgaggaauacaaacguuccgguauccucgagguggaccggacagaggccaaaagcgcccugaaggacggguccaagaucaagcacgcggugagccgcggcuccuccaaaauccguuggauagucgagcgcgggauggugaagcccaagggaaagguagucgaccugggcugcggccgcggcggcugguccuauuauauggcaacgcucaaaaacguaacggaggugaagggcuacacuaaaggggguccggggcacgaggagcccauucccauggccacuuacggcuggaaccuggucaaacugcacagcggaguggauguguuuuacaaacccacggagcaggucgauacgcuccuuugcgacaucggggagucgucaagcaacccgaccauugaggagggccggaccaugcgcguguugaaaaugguagaacccuggcucuccucgaagcccgaguuuugcauuaaagucuuaaaccccuauaugccaacggugaucgaggaacuggagaagcugcagcgaaagcacgguggcaaccucgugcgcugcccuuugucacggaacagcacccacgagauguauuggguuuccggagccagcggaaacaucguguccagcgucaacaccacauccaagaugcuauugaaccgguucacgacccggcaccgcaagcccaccuacgagaaggacgucgaucugggagcagggacccgaagcgugagcacggaaaccgagaagcccgacaugaccauuauaggccgccggcuucaacgccuccaagaggaacauaaggaaaccuggcacuacgaucaggagaacccguaccggacgugggccuaccaugggagcuacgaggcccccuccacaggcagcgccucgagcauggucaauggcguggugaaacuucugacaaaacccugggauguuaucccgauggugacccagcucgccaugacagacaccacccccuucgggcagcagcgcguuuucaaggagaaagucgacacucggacaccccagcccaagccagguacacgcauggugaugacgacgacggcgaacuggcugugggcccuauuagggaagaagaagaacccccggcugugcacccgcgaagaguucaucagcaagguccggagcaacgcugccaucggggccgucuuccaagaggagcagggcuggacauccgcauccgaggccgugaacgacucgcgcuucugggagcugguggacaaggagcgggcccuccaccaggaggggaagugcgaguccugcgucuacaacaugauggggaagcgcgagaagaaacuuggggaguucggccgcgcaaaagggagcagagccauuugguacauguggcugggcgcgcgcuuccucgaguucgaagcccuuggauuccugaacgaggaccacugguucggucgcgagaacuccuggagcggcguggagggugagggccuccaccgccugggguacauccuggaggagauagacaagaaagacggcgaccugauguacgcugacgauacggccggcugggacacgcggaucaccgaggacgaccuccaaaacgaggaacuaaucaccgagcagauggcgccacaucacaagauacucgcgaaggccaucuuuaaacugaccuaccagaacaaaguggucaaggugcugcgcccuaccccgcggggagcggugauggacaucaucucgcgcaaggaccagcgggguagcgggcaggucgguacuuacggguugaacaccuucaccaacauggaaguacagcuaauccgccagauggaggccgaaggcgugaucacucaggacgauaugcagaaucccaagggccugaaagaacgugucgagaaguggcucagggagugcgggguggacagauuaaagcgcauggcgaucucaggcgacgacugcguggucaaaccccuagacgagcgguucgggacgucucuccucuuccugaacgacaugggcaagguucgcaaggacauuccccagugggagccuuccaagggguggaagaacuggcaggaggugccguucugcucucaucacuuccacaaaaucuuuaugaaggacggcagguccuuaguggugccaugccgcaaccaggacgaguugaucggccgggcccgcauuagucagggggccggcuggucccuucgugaaaccgccugucucggcaaggcuuacgcccaaauguggucgcugauguacuuccacagacgcgaucucaggcucgccuccauggccaucugcagcgccgugcccaccgagugguucccuaccagccgcacgaccugguccauacacgcccaccaccaguggaugacuaccgaggacaugcugaaagucuggaaccggguguggaucgaggacaauccaaacaugauagacaagacuccugugcacagcugggaagacauccccuaucugggcaaacgcgaggaucucuggugcgggucccugaucggccugagcucccgagcgacuugggccaagaacauucauaccgcgaucacgcagguccgaaaccugaucggcaaggaagaguacguggauuauaugccgguuaugaagcgguacuccgcucccuccgagagcgagggggugcuuuga

SEQ ID NO: 26323 - RNA, 9867 nt, Artificial Sequence
  derived and/or modified CDS sequence (opt11) from DENV-4__KJ596672__SS-prME
uccacgauaacacugcuuugccucauucccaccguaauggcguuccaucucagcacccgggacggugaaccuuuaaugaucgucgccaaacacgaaagaggccgcccacuccuguucaaaacaacagaagggaucaacaaaugcacgcucauagcuauggacuuaggagaaaugugcgaagacacagucacauacaaaugcccguuauugguuaacacggaaccagaggacaucgacugcuggugcaaccuaaccucaacgugggucauguacggaacauguacgcagagcggagaacgacgucgggagaaaaggucaguggcccugaccccgcacuccggcaugggacuagaaaccagagcggaaacuuggaugucaagcgaaggagcauggaaacaugcacaacgcguagagucuuggauacuacggaaccccggauucgcucuauuggcaggcuucauggcauacaugaucgggcaaaccgggauacaaaggacagucuucuucguucuaaugaugcugguugccccaagcuacggcaugcgcugcgugggagucggaaaccgggacuucguggaaggggucucaggcggggcauggguggauuugguccucgagcacggugggugcguuacaaccauggcccagggaaaacccacccuggacuucgagcucacuaaaacaaccgccaaagaaguagcauugcuaaggaccuauugcaucgaagcucugauaucuaauauuacaacagcuacaagguguccaacacaaggcgaaccauaccuuaaagaagaacaagaccagcaauauaucugccgccgagacguaguggacagaggguggggaaacggcugcggccuguuugggaaaggcgggguagucacuugcgccaaauuuuccugcucgggcaaaauaaccggaaaucucguucaaaucgaaaaccuggaguacacuguugugguuacuguccauaauggagacacucacgcagucggcaacgacacauccaaucauggggucaccgcgacuauaacaccacgcucgccaucagucgagguaaaacuaccugacuauggggaacuaacccucgacugcgaaccaaggaguggaauagacuucaacgaaaugaucuuaaugaaaaugaagaagaaaaccuggcugguccauaaacaaugguuccucgaccugccacucccuuggaccaccggcgcagacacaagcgagguacauuggaacuacaaagagcggauggucaccuucaaagucccgcacgcuaaacggcaagacgucacaguccuaggcucccaagaaggcgcaaugcacucagcacuugccggugccacagaggucgacagcggcgacggcaaccacauguuugcaggacauuuaaaaugcaaagucaggauggagaaauuacguaucaaaggcaugucauacacuaugugcucagggaaauucagcauugacaaagagauggccgagacccagcacgggacgacuguagucaaaguaaaauacgagggcgcaggggcucccugcaaagucccaauugagauccgcgaugucaacaaggaaaaaguagugggccgaguaaucucagcgacuccacucgcagaaaacacgaacucggucacaaacauagaacuagaaccaccauucggcgacucguacauugugaucggggugggcaacuccgcacuaacccuucacugguuccgcaagggaagcucgauaggaaagauguuugaaucaacuuaucggggcgcaaagaggauggccaucuuaggcgagacggccugggacuucgguuccguaggagggcuauucacuucacugggaaaagcugugcaccaggucuucggaucagucuacacuaccauguucggagguguguccuggaugauccggauccuaaucggauuucuggugcuauggaucgggaccaacagcaggaacaccagcauggccaugacguguauagcaguuggcgguauuaccuuauuccuaggguuuacuguacaagccgacauggggugcgucgucuccugguccggacgagagcuaaagugugggucggggaucuucgugguagauaaugugcacacauggacagagcaguauaaguuccaacccgaguccccggcccggcuggcauccgccauacuaaaugcccacaaagacggcgugugcgggaucagaagcaccaccagacuugaaaaugucauguggaagcagauaaccaacgaacugaauuacguccucugggagggaggacacgaccucacugugguagcgggagauguaaaaggagugcucacuaagggcaaaagagcccuuacgccacccgcguccgaucucaaauauucauggaagacaugggggaaagcgaagaucuuuacucccgaagcccgcaacagcacguuccugaucgacggcccggacacaagcgagugcccaaaugaacgccgcgcguggaacucauuugaaguagaagacuacggguucgggauguucaccaccaauaucuggaugaaauucagagaaggcagcuccgaggucugcgaccacagguuaaugagugcagccauaaaggaccaaaaggcgguacaugcagauauggguuacuggauagaaagcaguaagaaccaaacauggcagauagaaagggcgagccucauugagguaaaaaccugccucuggccuaaaacgcauacucuguggagcaacggaguacucgaaucgcaaaugcugauccccaagagcuaugcaggcccuuucagccagcauaacuaccgccagggcuacgccacgcaaacaguagggccauggcaccuagggaaacuggaaauagacuuuggagaaugccccgguacgaccguaacaauucaagagaacugugaccacagaggucccucauuaaggacuacaacugccucgggcaagcucguaacacaaugguguugucguagcuguacgaugccgccacucagguuuuugggggaagauggcugcugguacgggauggagauacgaccacucagcgaaaaggaggaaaacaugguaaaaucgcagguaaccgccggccaagguaccucagaaacauucucgauggggcuccuaugucucacacuauuugucgaggagugucucagaagacgagucacaagaaagcacaugauccucgccgugguaauuacacuaugcgcuaucauacugggagggcuaacauggauggaccuccugcgcgcccucauaauguuaggagacacgaugucgggccgaauaggagggcaaacacaucucgcaauaauagcaguuuuuaaaaugagcccgggauaugugcuaggagucuuccuacguaaacucacaucacgcgaaacagccuugaugguaaucgggauggccaugacgacaacccucuccaucccccacgaccuaauggagcuaaucgacgggauaucccugggauuaauccugcuaaaaauaguaacccaauuugauaacacacaagugggcacgcucgcgcucucacucacauucauccguuccacaaugucgcuugucauggccuggcgcacuauaauggcaguacucuucguggucacccucauuccgcucugucgaacgucaugucuccagaagcaaagccacuggguggaaauaacggcguugauccuaggagcccaggcacuuccggucuaucucaugacacugaugaagggagccucacgaagaagcuggccacuaaacgaaggaauaauggccgucgguuuagucagccuacucggcucagcgcuacucaaaaaugacgucccccuggccggucccauggucgccggcggguuacuccuagcagcguacgucaugagcgggucauccgccgaccugucccucgagaaagcggcgaacguucaaugggacgagauggcugacaucaccggaucaagcccgaucauugaggugaagcaggacgaggaugggucauucucaauacgcgacguagaggaaacgaacaugaucacacugcuggucaaacuagccuuaaucacugugaguggccucuauccacucgccauaccgauaaccaugacacucugguauauguggcaagucaagacgcagcggagcggcgcccuaugggauguacccagucccgcggcaacgcagaaagcugcccuaagcgagggaguauacagaauaaugcaacguggacuuuucggaaagacgcaaguaggaguaggaauacacauggaaggcguguuccacaccauguggcacgucacaagagggucagugauaugucacgaaacuggucgacuggaaccgucuugggccgaugugagaaaugacaugauaaguuauggaggaggguggcgccuuggggacaaaugggacaaggaagaggacguacaaguuuuagcaauagaaccggggaaaaacccgaagcaugugcagaccaagccgggacucuucaaaacgcuaaccggggaaaucggggccgugacccuugauuucaagcccgggaccagugguucgcccauuaucaaucggaaggggaaggucauugggcucuauggaaacggaguaguaacgaagucuggcgacuacgucuccgcaauaacccaagcagagcgcauaggggaaccggacuacgagguagacgaggacaucuuccguaagaaacggcugaccauaauggaucuacaccccggagcaggaaaaacaaaacggauacugcccuccauuguccgagaagccuuaaaacgccgccuccgcacccuaauacucgcgcccacgcgaguggucgcugcagagauggaggaagcacuacggggacugccgauaagguaucagacgccagcaguaaagucagagcacaccggccgcgaaaucguggaccuuaugugucacgcgaccuuuacaacccgcuuacugucaagcacaagagucccaaacuacaaccugaucgucauggaugaagcgcacuucacggaccccuccagcaucgcggcccgaggauacauaucaaccagaguggaaaugggagaagcggcggcaaucuuuaugacagcuacaccaccuggugccacagacccauucccgcagucuaacagucccauagaagacaucgaacgcgagauucccgaacggaguuggaacaccggauuugacuggaucacagacuaccaaggaaaaacggucugguucgugccgagcauaaaagcugggaacgacauagcgaacugccuccggaaaucaggcaagaaagucauccaacuaagcaggaagacauucgacacggaauacccuaaaaccaagcucacggacugggacuucgucguaaccacggauauuagcgagaugggcgcuaacuucagagcaggccguguaaucgacccccgccggugccuaaagcccgugauucucaccgaugggccagaacgcgugauccuagcagggcccauaccugugacgccggcgagcgcggcacaaaggcgggguaggaucggcaggaacccggcccaagaagacgaccaguacguuuucucaggcgacccccuuaagaacgacgaggaccacgcccauuggaccgaagcgaaaaugcuccuagacaauauauacacacccgaggggauaauaccgacccuauuuggaccggagagagaaaagacgcaggcuaucgauggcgaguuccgacuccgcggagaacaaaggaagaccuucguugagcuaaugagacguggagaccuccccguguggcugucauacaaagucgccagcgccggaaucagcuacaaagacagggaaugguguuucaccggugagagaaauaaccaaauccuagaggaaaauauggaaguggagauuuggacacgggaaggggagaagaagaaacuucgaccgaaguggcuagacgcgcgcguguacgcugacccaauggcacugaaggacuucaaagaguucgcgagcggccgcaaaucaauuacacuagacauuuugacggaaauagcgucacugcccacguaccuaagcuccagagcaaaguuggcucuggacaacaucguaaugcuucacacgacagaaaggggcgggcgagcuuaccaacaugcccuaaacgaacuacccgaauccuuagaaacccucauguuaguggcacuguuaggcgccaugaccgcggggaucuuccuguuuuucaugcaggggaaaggaauaggaaaguuauccaugggccuuauaaccaucgcaguggccaguggucuacucugggucgcggaaauacagccucaauggaucgcagccucgauaauauuggaguucuuucuuaugguacuccucaucccggagccggaaaaacaaagaacaccccaagacaaccaacucaucuacgucaucuugacuauccuuacgaucauugggcuaaucgcagccaacgaaauggggcugaucgagaaaacaaagacagacuucggcuucuaucaaguuaaaacagaaacaacgauccucgaugucgaccuacgaccugcauccgcguggacauuauacgccguggccacuacgauacugacccccaugcuaagacacacgauugagaacacauccgcaaacuuaucccuagccgcuaucgcaaaccaagccgcgguccuaauggggcuaggcaaaggguggccguugcacaggauggaccuuggugucccacuacuagcuaugggcugcuacagucaaguaaacccgacaacgcugacugcgagccugguaaugcucuuaguacacuacgccauaaucggacccggguugcaagcgaaagcaacccgcgaagcccaaaagagaacagccgcaggaauaaugaagaaccccacgguggauggaauaaccguaauagaccuagaaccaauaucauacgauccaaaauucgagaagcaguuaggacaggugauguuacuggucuugugcgccggccagcuguuacuaaugaggacgacgugggccuuuugcgaagugcugacacuagcaaccgggcccauauugacgcugugggaaggaaaucccgggcgguucuggaacaccacgauagcaguauccacugcaaacauauuccgagguagcuaccuagccggcgcgggacucgcuuucagucucaucaaaaacgcgcaaacaccaagacgugguaccggaacagccggggagacacuaggcgaaaaauggaagcggcagcuaaauucccuggauagaaaggaauuugaagaguacaaacgaucuggcauauuagaagucgaccgaacugaggcaaagucggcgcugaaagacggcucaaagaucaaacacgccgucagcagagguucgucaaaaauccgauggauagucgaaaggggaaugguaaaaccgaaagggaaaguaguagaucuggguugcggcagaggcggauggucauacuacauggcuacgcucaaaaaugucaccgaaguaaaaggauauacgaaaggaggaccaggccacgaggaacccaucccgauggcuacuuacggcuggaaucugguaaaauuacauagcggcguagacgucuucuauaagccuaccgagcagguugacacccuuuuaugcgauaucggugagucgagcagcaacccgacgauagaagaaggacguacccuccgcgugcugaaaauggucgagccauggcucuccagcaagcccgaauuuuguaucaagguccugaacccguacaugccaacagucauagaagaacucgagaagcuccagcgcaagcacggaggaaaucugguccggugcccccugucccgcaauucuacacacgagauguauuggguaagcggagcuucuggcaacauagucucguccguaaacacaaccagcaagaugcuucuaaaccgcuucacgacacgccauagaaaaccgacauacgaaaaggacguagacuugggagcaggaaccagauccgucagcacagaaauagaaaaacccgacaugacaauaauaggacgacgcuugcaacgacuacaggaggaacacaaagaaacauggcauuacgaccaagaaaaccccuacagaaccugggcuuaccauggcucuuaugaggcgccaucaacgggaucagcauccucuauggugaauggaguggucaaacuacucacaaagccaugggacguuauaccgaugguuacgcaguuagcgaugacagacaccacgccguucggacagcagcguguguucaaagaaaaagucgauacccgaacgccccaacccaaacccggcacaagaauggugaugaccaccacggcgaacuggcugugggcccuucuggggaaaaagaaaaauccccgccuaugcacccgcgaagaguucaucagcaagguucguagcaacgcugcgaucggagcuguguuccaggaagaacagggcuggacaagugcguccgaagcagugaacgauagucguuucugggagcugguagacaaagaaagagcgcuucaucaggagggaaaaugugaaagcugcgucuauaacaugaugggaaaacgggagaagaaacucggggaguucggccgagcgaaaggaucacgugccauaugguacauguggcugggggcucgcuuccuggaguucgaggcacuaggcuucuugaacgaagaucacugguuuggaagagagaacaguuggucuggcgucgaaggggaggggcugcaccgccuggguuacauccuggaagaaaucgacaagaaagauggagaccugauguacgcagacgauacagccggcugggauacacgaauaacagaggacgaccugcaaaacgaggaacuaauuacugagcaaauggcaccgcaccacaaaauacuagcgaaggcuauuuucaaguugacguaccagaacaaagucguaaaagugcuacgaccgaccccgcggggcgcggucauggacaucauaagccggaaagaccagcgcggcagcgggcaaguuggaacauacggguuaaauacauucacaaauauggagguccaacuuaucaggcaaauggaagcagagggaguaauuacacaagacgauaugcaaaacccaaagggcuuaaaggagcgaguagaaaaauggcuucgggaaugcggagucgauaggcuaaagcgcauggcaauaagcggagacgacuguguagugaagcccuuggaugagcgauucggaacaucacuacucuuccugaacgauaugggaaaaguccgaaaggacauaccacagugggaaccgucgaaaggauggaaaaacuggcaagagguacccuucugcucacaucacuuccacaaaauauucaugaaagacgggaggucccucgucguaccguguagaaaccaagacgaauuaauaggaagggcaagaauaagccagggcgcggggugguccuuaagagaaacggcgugucucggcaaggcauacgcucaaauguggucacugauguauuuccaccggagagaucugcgacuagcaucaauggcaauauguuccgcugucccaacggaaugguuccccacaagucgaacaacguggaguauccacgcacaucaccaauggaugacaacagaggacaugcugaaagucuggaacagggucuggauagaagauaacccgaacaugauagacaaaacgccgguccacucaugggaggauauaccauaucuaggcaaacgagaggaccuauggugcggaucuuugaucggcuuauccaguagagcuacaugggcuaaaaacauacauacagccauaacccagguucgcaaucugauugggaaagaggaauacguggacuauaugucgguuaugaagagauacuccgcaccaucagaauccgagggcguccucuaa

SEQ ID NO: 26324 - RNA, 9867 nt, Artificial Sequence
  derived and/or modified CDS sequence (opt11) from DENV-4__KJ579242__SS-prME
agcacuaucacgcugcugugccugaucccaacggucauggccuuccaucuguccacccgcgacggcgagccgcuuaugaucgucgccaaacacgagcggggacgcccccugcuauucaagacaaccgagggcauuaacaagugcacgcucaucgcgauggaccugggggagaugugcgaggacacagugacauacaagugcccccuccuggugaacaccgagcccgaggacauagacugcugguguaaucugacuagcacgugggucauguacggcaccugcacccaguccggggagaggcgacgggaaaagcgaagcguggcccucacgccgcacuccgguaugggccucgagacacgagccgaaacuuggaugagcucggagggggcguggaagcacgcccaacgcguggaaagcuggauccugagaaacccgggauucgcgcuguuggcaggguucauggcuuacaugauaggccagacagggauccagcgcaccgucuucuuugugcugaugaugcugguggccccauccuacggcaugcggugcgucggcguggggaaccgcgacuuuguggagggcguuucggggggcgcguggguggaccucgugcuggagcauggggggugcgucacuaccauggcacagggaaagccgaccuuagacuucgaacucacgaagaccaccgcaaaggagguggcucuucugcggaccuacugcaucgaggcccucauuucaaacaucacuaccgcgacacguugcccgacccagggggagcccuaccugaaggaggagcaggaucaacaguauauaugccggcgagacguggucgaccggggcugggguaacggaugcggccuguucgggaagggcggugucguaacgugcgccaaauucucaugcuccgguaagaucacugggaaccucguccagauugagaaccuggaguacaccgugguugucaccgugcacaauggagacacgcacgccguugguaacgacaccagcaaccacggugugacagccacuaucacuccccgcucccccagcguagaggugaagcugccggacuacggcgagcucacacuggacugcgagccccggucugggaucgacuucaacgaaaugaucuugaugaaaaugaagaaaaagaccugguuagugcacaagcagugguuuuuagacuuaccccugcccuggaccaccggugccgacacgagugaggugcacuggaacuauaaggagcgcauggucacauuuaagguuccccaugcgaagcggcaagacgugaccgugcuggggucccaggaaggcgccaugcauagcgcccuggccggcgccaccgagguggacagcggggacggcaaccacauguucgcgggucaccucaagugcaaggugcgcauggagaaacugagaaucaagggcauguccuauacgaugugcagcggcaaauucuccaucgacaaggagauggcugagacccagcacggcaccacggucgugaaggugaaguacgaaggcgccggugcccccugcaagguucccaucgagaucagagaugucaacaaggagaagguggucggacgcguuaucucagcgacuccccuagcagagaacacgaacagcgucaccaauauugaguuggagccgcccuucggugauaguuacaucgucaucggcguuggaaacuccgccuuaacucugcacugguuccggaaggggagcuccaucggcaaaauguucgagucaaccuacagaggugccaagcggauggccauccugggcgaaacagcgugggauuucggguccgugggcggccuguucaccagccucgggaaggccguccaccagguguucggcuccguguacaccacgauguucgggggcguaagcuggaugauccgcauucucaucggguuccugguacuuuggauuggcaccaauucccggaacacaagcauggcaaugaccugcaucgcuguaggcgggaucacgcuguuucucggcuucaccguccaagccgacauggggugcgugguguccuggucgggccgggaguugaagugcggguccggcaucuucgucguggacaacguccacaccuggacugaacaauacaaguuccagcccgagagccccgcgcggcuggccagcgcgauauuaaacgcccacaaagacggcgucugugggaucaggucaaccacccggcuggagaacgugauguggaagcagaucacaaacgagcugaacuacguacucugggagggcgggcaugaccugaccgucguggcgggcgacgugaagggcguccucaccaagggcaagcgagcgcucaccccgccugccagcgaucuaaaguacuccuggaagaccuggggcaaggcaaagaucuucacccccgaggcccggaacucgacuuuccugaucgacgggccagacaccucggaguguccuaacgagcgccgggccuggaacagcuucgagguggaggacuacggcuucgggauguucaccacaaacauauggaugaaguuccgcgaggggucaagcgaggucugcgaccaccggcucaugagcgcggccaucaaggaccagaaggccguccacgccgacaugggcuauuggauugagagcucuaagaaccagacguggcaaauugagcgcgcgucacugauagaggugaagaccugucuguggccaaaaacccacaccuuguggaguaauggggugcuggagucacaaaugcugauccccaaguccuacgcggggccguucucccagcacaacuacagacagggguaugccacccagacggucggccccuggcaucucgggaagcuggagaucgacuuuggcgagugccccggcaccaccgugacgauccaggaaaacugcgaucaccgcgggcccucccuccgcacgaccaccgccucggggaaacucgugacacaaugguguugccgguccugcacgaugccaccacugagauuccucggggaagaugggugcugguacgggauggaaauccggccccucuccgagaaagaggagaauauggucaagagccagguuaccgccggccagggcaccagugagaccuucagcaugggcuugcugugccucacgcuuuucgucgaagagugccugcgccggcgcgugacgcggaagcacaugauucuggcgguggucauuacccugugcgccauaauucuggggggccucaccuggauggaccugcugcgcgcgcucauaauccucggcgacacgaugaguggccggaucggcggccagacccaccuggccaucauggccguguuuaagauguccccuggguacguacuugggguuuuucucaggaagcugacgucucgagagaccgcgcuaaugguaauugggauggccaugacgaccacucuaagcaucccgcacgaccugauggagcucauugacggcaucucccuuggcuuaauucuacugaaaaucgugacacaauuugacaacacgcaggucgguacccucgcccucagccugacauucauccgcaguaccaugagccuggugauggccuggcggacgauaauggcagugcucuucgucgugacccugaucccccugugccgcaccagcugccuccagaagcagucucauuggguagagaucaccgcacugauccugggcgcccaggcccuccccguguaccuaaugacgcugaugaagggagccuccaggcgcucguggcccuuaaaugaaggcaucauggcggucgggcugguuucccugcucgguagcgcccugcucaagaacgacgucccgcucgcaggccccaugguggcugggggacucuugcucgccgcguacguuauguccggcagcagcgccgaccugagucuggagaaggcggccaacguccagugggaugagauggccgacaucaccggcuccucccccaucauugaagugaagcaggacgaggacgggagcuucucuauucgugacguagaagagaccaacaugaucacccuucuggucaaguuagcgcucaucacggugagcggucuuuacccccuggccaucccaaucaccaugacccugugguacauguggcaggugaagacccagcgcuccggagcacugugggacgucccuucgcccgccgccacacagaaggcagcccucuccgaagggguguaccgaaucaugcagcgcggccucuucgggaagacgcaggugggcgucgggauucacauggagggaguguuccacaccauguggcacgugacucggggcagcgucaucugucacgagaccgggcgccuggagcccuccugggcggacgugcgcaacgacaugaucuccuaugguggaggcuggcggcucggcgacaagugggauaaggaggaggaugugcaaguccucgccauugagccggggaaaaaccccaaacacguucagaccaagcccggccuguucaagacccuuaccggugagaucggcgccgucacccucgacuucaagcccggcacgucuggcagcccgaucauuaaucgcaagggcaaagucaucgggcucuacgggaauggggugguaacuaagaguggcgacuacgucagugccaucacccaggcggagcggaucggggagcccgacuacgaaguggaugaggauaucuuccggaagaagcgguuaaccauaauggaccuccaccccggcgcagggaagacgaagcguaucuuaccguccaucguccgggaagcccugaagcgccgucugcgcacucucaucuuagcccccacccgggugguggccgccgagauggaggaagcccuacgcgggcuccccauacgguaccaaacucccgcggugaagagcgagcacacgggccgcgaaaucgucgaccugaugugccacgcgaccuucaccacccggcugcucuccaguacccgcgugccgaacuacaaccugaucguuauggacgaggcgcacuucacugaccccuccuccguggccgccaggggcuacaucagcaccagaguagaaaugggcgaggcggcagcaaucuucaugacugccacgccccccggggccaccgacccguucccccagucaaacagccccaucgaagacauagagcgugagauccccgagagguccuggaacaccggcuucgacuggaucacggacuaccaggguaaaacggucugguuugugcccagcaucaaggcagggaacgacaucgcgaacugcuugcgaaaguccggcaagaaagucauccagcucagccggaagacguucgacaccgaguacccuaagacuaagcucacggacugggacuucguggugacaacggacauauccgagaugggggccaacuuucgcgccgggcggguaaucgacccacgccgaugccugaagccuguuauccucacugacgggccggagcgagugaucuuagccggccccauacccgucacgcccgcgagcgccgcacaacggcgcggccggaucgggagaaacccagcccaggaggaugaccaguacguauucuccggcgauccgcugaaaaacgacgaggaccacgcgcacuggaccgaggcgaagaugcuccuggauaauaucuauacgcccgaggggauuauucccacccuguucggcccggagcgggagaaaacgcaggccaucgacggcgaguucagauuacggggggaacagcggaagacguucguggagcuaaugaggcggggcgaccugcccguaugguugucauacaagguugccucugccgggaucagcuauaaggaucgggaguggugcuucaccggcgagcggaacaaccaaauccuggaagagaacauggagguggagaucuggacccgggagggugagaagaagaagcugcgccccaaguggcucgaugcccggguauaugcggaccccauggcccuuaaggacuucaaagaguucgccuccggucgcaaaagcaucacccuggacauccucacggaaaucgccucuuuaccgacuuacuugagcucccgcgcuaagcucgcgcuggacaacaucguaaugcugcacacuaccgagcggggcgggcgcgccuaccagcacgccuugaacgagcugccagaaagccuggaaacacucaugcuagucgcccugcugggagcgaugaccgccggaaucuuccuguucuucaugcaggggaagggaauaggcaaacugagcaugggccugaucaccaucgccguggccuccgggcuucuguggguggccgagauccaaccgcaguggaucgccgccagcaucauccucgaguuuuuccugaugguacuccucauuccugagccugagaagcagcggacaccccaggacaaccaguuaaucuacgugauccugacgauacuaacaauuaucggcuugaucgccgccaaugaaaugggacucaucgagaagaccaaaaccgacuucggauucuaccaggucaagacugagaccaccauccucgauguggaucugcgccccgccuccgccuggacacuguacgccguggccacgaccauccucaccccgaugcugcgacauaccaucgagaacacgagcgccaaccugucccucgccgcgaucgcaaaccaggccgccguccugauggggcuggggaaggguuggccccuccaucgcauggaccugggaguuccccugcuagccauggguugcuacagccaggucaaccccacuacccucaccgcgucccuggucaugcuccuggugcacuacgccauuaucggaccuggcuugcaggcgaaggccacgcgggaggcgcaaaagcgcaccgccgcagguauaaugaagaaccccaccguggacgggaucaccgucauugaccucgagcccaucagcuaugaccccaaguucgagaagcaauugggccaggugaugcugcucguccugugcgccggucagcuucuccugaugaggacgaccugggcguucugcgaggugcugacccucgccaccggcccgauacucacguuaugggaagggaaccccggacgcuucuggaacaccacgaucgcuguguccaccgccaauaucuuccgcggcuccuaucucgccggggccggccugguguucagucugaucaagaacgcgcagacgccccgucgggggaccgguaccgccggggagacccucggcgagaaguggaagcgccagcugaacucucuggaccggaaagaguucgaggaguauaagcguuccggcauucucgaaguggaccggaccgaggcgaagucggcccucaaggacggguccaagaucaaacacgccguaagccggggcuccucuaagauucgguggaucgucgagcgagggauggucaaacccaagggcaaagugguggaucuggggugcggccgcggagggugguccuacuacauggcgacgcucaagaacgugaccgaggugaagggcuacaccaagggggguccgggccacgaggagcccauuccaauggcaaccuacggcuggaaccuagucaagcuccacagcggugucgacgucuucuacaagccuacggagcagguggacacccuccugugcgacaucggggagagcuccucgaacccgacgaucgaggagggccggaccaugcgcguccugaagaugguggagccauggcuuaguucgaagcccgaguuuuguaucaaggugcugaaccccuacaugccaacgguaaucgaggagcuagagaaacugcaaaggaagcacgggggcaaccucguacgcuguccccugucccggaacagcacccacgagauguacugggucucuggcgccagcgggaacaucgugucgaguguaaacaccacaucaaagaugcuguugaaccgguucacgacacggcaccgaaagcccacauacgagaaagacgucgaccugggcgcuggcacccggucuguuuccacugaaaccgagaagccugauaugaccaucaucggccggcggcugcagcgccuccaagaggagcacaaggagaccuggcacuacgaccaggagaacccguaccggacgugggcguaccacgggagcuacgaagccccuucuaccggcagcgccuccaguauggugaacggcgucgugaagcuguuaacuaagcccugggacgugaucccgauggucacacaguuagcgaugacugacaccacccccuucgggcagcagcgcguguucaaagagaagguugacacgcguacgccccagccaaaaccgggaacccgcauggucaugaccaccacagcaaacuggcugugggcgcuacucgggaagaagaagaauccccgcuuaugcacacgggaggaguucaucuccaaggugcggagcaacgccgcuaucggggcgguguuucaggaagagcaaggguggacuagcgccuccgaagcgguaaacgacagccgcuucugggagcugguggacaaagagcgggcccuccaccaggagggcaagugcgagucuugcguguacaacaugaugggcaagagagagaaaaaacuaggggaguuuggcagagccaaggggagccgggccaucugguauauguggcugggcgcccgcuuccucgaguucgaggcgcuggguuuuuugaacgaggaccauugguucggccgggaaaacuccuggagcggugucgagggcgaaggccuacacagauugggguacauccuggaggagauugacaagaaggacggcgaccucauguaugcggacgauaccgcagguugggacacucggaucacugaggacgaccuacagaacgaggagcugaucaccgagcagauggccccucaccacaagaucuuagcgaaggccaucuucaaacuaaccuaccagaacaaggugguuaagguccugcgccccaccccgcggggggccgugauggacaucaucucucgcaaggaccaaaggggcagcgggcaggugggcacguacgggcucaacaccuuuaccaacauggaggugcagcugaucagacagauggaggcagagggcgugaucacccaggacgacaugcagaauccaaagggccugaaggagcggguggagaaauggcuccgcgaguguggggucgaucgacugaaacguauggcgauuuccggcgacgauuguguggugaagccccuugacgagcguuucgggacgucauugcuguuucugaacgacaugggaaagguccggaaggacauaccccagugggagccguccaaggguuggaagaacuggcaggaggugccuuucugcagccaucacuuucauaagaucuucaugaaagauggccggagucucguagugccaugccgcaaccaggacgagcuaaucggccgagcacgcaucagucaaggggccgguuggucgcugagggagaccgcuugccuugggaaggccuacgcucagauguggagccugauguacuuccaccggcgugaccuccgucucgcuucuauggccaucugcucggccguacccacugagugguucccgaccagccgcacgaccugguccauccacgcccaccaccaguggaugaccaccgaggacaugcugaaaguguggaaccggguauggaucgaggacaauccgaacaugaucgacaagacgccugugcauucgugggaagacauccccuaccugggcaagcgcgaagacuuauggugcggaucccugauaggccugagcucccgggcaaccugggccaaaaauauccacaccgcaaucacccaggugcgaaaccucauaggcaaggaggaguacgucgacuauaugccggugaugaaacgguacuccgcccccucggagagcgagggcgugcuguaa

SEQ ID NO: 26325 - RNA, 9867 nt, Artificial Sequence
  derived and/or modified CDS sequence (opt11) from DENV-4__GQ398256__SS-prME
agcaccaugacucuucucugccugaucccaaccgugauggccuuccaucuaucgacucgcgauggcgaaccacucaugaucguugccaagcacgagcgggguagacccuuacucuucaagacuaccgaaggaaucaacaagugcacgcucauagcgauggaccucggggaaaugugugaggacaccgugaccuacaagugcccccugcucgucaacaccgagccugaggauauugacugcuggugcaaccugacgucuacuugggugauguacgggaccugcacgcagaacggggagagacggcgugaaaaacgcucuguggcccugacgccacacucgggcaugggccuagaaacccgcgccgagacuuggaugucaagugagggggcuuggaagcacgcgcagcgcguggaaucguggauccugcggaacccggguuucgcgcugcuggccggguuuauggccuauaugauaggccagacagggauccaacgcacaguguucuucgugcucaugaugcuggucgcgccaagcuauggcaugcgcuguguuggagugggcaauagggacuucguggagggcgucuccggcggagcuuggguggaccucguguuagagcacggcgggugugucacgacgauggcccagggcaagccuacccuggauuucgagcucaccaaaaccaccgccaaggagguggcccuccuacggaccuacuguaucgaggcguccaucuccaacauuaccaccgcgacucguugcccaacccagggagagcccuacuuaaaagaagagcaggaccagcaguacauuugucgccgcgacgucgucgaccguggcuggggcaacggcuguggccucuuuggaaaggguggggugguaacgugugcuaaguuccugugcucggguaagauaaccgggaaucucguccagauugagaaucuggaguacaccguggcugucaccguccacaauggggacacgcacgcuguuggcaacgauaccuccagccacggggucaccgccaccaucacgcccagauccccaaguguggagguuaagcugccggauuacggcgaguuaacccuagacugcgagccccgguccggcaucgauuucaacgagaugauacugaugaagaugaaaaagaagacuuggcuagugcacaagcaaugguuucuggaccugccucucccguggacagcuggugcggacaccagcgaaguucacuggaaccacaaggaacgcaugguaacuuucaaggucccgcaugcgaagcggcaggacgugaccguacucgggucccaagagggcgcuaugcauucagcccuggcgggagccaccgaggucgacucaggggauggcaaccacauguucgcagggcaccuaaagugcaaagugcggauggagaagcuccguauuaagggcauguccuacacgaugugcagcggaaaguucuccauagacaaggagauggccgagacgcagcacggcaccacagugguaaaggugaaguacgagggcgcaggggcacccugcaagguucccauugagaucagagaugugaacaaggagaagguugugggccgaauuauaagcuccacgcccuucgcagagaacacuaacagcgucacgaacaucgagcuggagccgcccuucggggacuccuacaucguaaucggcgucggcgagucagcgcugacccugcacugguuccggaagggguccucaaucggcaagauguucgaguccaccuaccguggugccaagcgaauggccauacugggcgagacagcaugggacuuuggcucggugggcggccucuucaccucgcuggggaaggcgguucaucagguauucggcagcguauacacgaccauguucggugguguauccuggauggugcgcauccucauagguuuccucguccuguggauaggcacgaacagccggaacacaaguauggccaugaccugcauagcagugggcggaaucacacuguuccugggguuuacggugcaggcggacauggggugcgucgucucauggaauggcaaggaacugaaaugcggaucgggcauuuucguagucgacaaugugcacacuuggaccgaacaguacaaguuccaaccugagagcccugcccgccuugccagcgccauccuaaacgcccacaaggauggggucugcgggaucagguccacaacgcgccucgagaaugucauguggaagcagauaacaaacgagcugaacuaugucuuaugggaaggaggacaugacuuaaccguugucgcaggcgacgugaagggagugcugacaaagggcaaacgcgcacugacgccucccguuaacgaucucaaguauagcuggaagaccuggggcaaagccaagauauucacccccgaggcccgcaacucaaccuuccucaucgacggaccggacacauccgagugucccaaugaacgccgcgccuggaacuuuuucgaaguagaggacuauggcuuugggauguucaccacuaauaucuggaugaaguuucgagaagggucuucagaaguuugugaccaccgccugaugucagcggcgaucaaggaccaaaaggccguccacgccgacaugggguacuggaucgagagcuccaagaaucagaccuggcagauugagaaggcgucauugaucgaggugaagacaugcuuguggcccaagacacacacacuguggucgaacggggugcucgagagccagaugcuaaucccccgaucguaugccggcccguucucacaacacaacuaccgccagggguacgcgacgcagaccguggguccuuggcaccugggaaaacuugagaucgauuucggugagugccccggaacgacgguggcaauccgggaggacugugaucaccgcgggcccuccuuacgaaccaccacggcuagcgguaagcuugugacccaguggugcugcagaucguguaccaugccuccccuuagguuccucggggaggacggcugcugguacggaauggagauacggccucucuccgagaaggaggagaacauggugaagagccagguaaccgcaggacagggaacgucugagaccuucucaauggggcugcugugccucacccucuucgucgaggagugcuugcgccggcgugugacucguaaacacaugauccugguggucgugauaaccuucugcgcgauaauccucggcggguuaaccuggauggaccuguuacgcgcgcucaucaugcucggcgauaccaugaguggcagaaucgguggccagauucaccucgccaucauggcaguguucaagaugagcccaggauacguccuggggguuuuucucagaaaacuuacuucucgggaaacggcgcuuaugguuauugggauggccaugacaacggucuuuucgaucccccaugaccugauggaacuaauagacggaaucucccugggccugauacuccucaagaucguuacccauuucgauaacacucaggucggaacccuggcgcuuucucugaccuuccuacgguccacgaucccgcucguaauggccuggcggaccauaauggccguuuuuuucguugucacacugauccccuuauguaggaccucgugccuacaaaagcagucccacuggguugagaucaccgcucugauccuuggggcccaggccuuacccguguaccugaugacgcugaugaagggggcuagccgccgcuccuggccgcuaaacgaggguauaauggcggucgggcuggugagcuugcucggcuccgccuuacugaagaacgaugugccccucgcgggcccuauggucgccgguggccuauuacucgccgccuacgucaugagcgguucuagugcggaccuaucccuggagaaggccgcaaacgugcagugggacgagauggccgacaucacugggucaagccccaucaucgaggucaaacaagacgaggacgggucauucagcauccgggauguugaagagacgaacaugaucacacuccuggugaagcucgcgcucauuacgguuucagggcuauacccccuagccauccccgucacaauggcccucugguacaucuggcaggugaagacccaacgcagcggcgcccugugggacguacccucacccgcggcaacccaaaaggccacgcuaagcgaggggguguaccguaucaugcaacgcggccucuucggaaaaacgcaggucgguguuggcauccacauggaagggguguuccauaccauguggcacguaacccgugguuccgucauaugccacgaaacuggccggcucgagccuucgugggcggacgugaggaaugauaugaucuccuacggugggggauggagacugggcgacaagugggacaaggaggaggacgugcaaguccucgccaucgagcccgggaaaaaccccaagcacgugcagacuaagcccgguuuauucaagacucucaccggggagaucggagcagugacuuuggacuucaagccggggacgagcggaucccccaucauaaauaaaaagggcaaggugaucggauuauacgguaacggaguugugacgaaaaguggugacuauguuagugcaaucacccaggcugaacgaaucggggaacccgacuacgagguggaugaagauauuuuucggaaaaagcgccugaccaucauggaccugcaccccggugcaggcaaaacgaagagaauccugcccagcauugucagagaagcucugaaacggcgccuucggacucugauucuugcgcccacgcguguuguggccgcugagauggaggaggcuuugcggggguuacccauccgcuaccagacgccggccgugaagucggagcacaccggaagggagaucgucgaucucaugugccacgcgacauucaccacccgcuuacucagcucaacacgcgugcccaacuacaaucugauaguaauggacgaggcacacuuuaccgauccgugcucgguggcugcucgcggguacauaaguacgagggucgaaaugggcgaggccgcggcuaucuucaugaccgccacgcccccgggggccaccgaucccuucccucaaagcaauagccccaucgaggacauugagcgcgagauucccgaacgaucuuggaacaccggcuucgacuggaucaccgacuaucagggcaagacugucugguucgugcccagcauaaaggcaggcaaugacaucgccaacugccugcgcaagagcggcaagcgcgugauucaguugagcaggaagacauuugauaccgaauaccccaagaccaaguugaccgacugggacuucgucgugacaaccgacaucuccgagaugggcgccaacuuucgcgcuggacgggugaucgacccccgucgcugccugaaaccuguaauccucacagacgggcccgagcggguaauuuuggccgggcccauucccgugacuccggcaucagccgcccaaagacgcgggcguaucgggcgcaacccggcccaggaagacgaccaauacguauucuccggcgacccccugaagaacgacgaggaccaugcccacuggaccgaagcgaaaaugcuccucgauaauaucuacacacccgagggaauuaucccgacgcuguucggcccugaaagggagaagacccaggcgaucgauggagaguuucgccuccgcggagaacagcgcaaaacauucguggagcugaugaagcggggcgaucuccccgugugguuaucauacaagguugccuccgcugggaucagcuacaaggacagggaguggugcuucaccggagaacguaacaaucaaauccuggaggaaaauauggagguugagauuuggaccaaagagggcgagaagaagaaacuucgccccaaaugguuagacgcucggguguacgcggauccgauggcguuaaaggauuucaaggaguucgccuccggacgcaagagcauaacacucgacauccuaaccgagauagccuccuugccaaccuaccuuagcuccaaagccaagcucgcgcuggacaacaucgucaugcuacacacgacagagaagggaggccgggcuuaccagcacgcccucaacgaauugccggaaucccuugaaacgcucaugcugguggccuugcucggagcgaugaccgcagggauauucuuguucuucaugcagggcaagggcauuggcaagcugagcaugggcuugauagcgauagcgguugccucugggcugcuuugggucgcggagauccagccgcaauggaucgccgcuaguaucauacuagaguucuuucugaugguccugcucauccccgagcccgagaaacaacgcacaccucaggacaaccagcuuaucuacgugauccugacuauucucacaauuaucggccugaucgccgcaaacgaaauggggcuaaucgagaagaccaaaaccgacuuuggcuuuuaccaggugaaaaccgaaacuaccauccucgauguagaccuccgcccggcguccgcuuggacacuguacgcgguugcaaccacgauccugacgcccaugcugaggcacaccaucgaaaacaccagcgccaaucugucucucgcggcgaucgccaaccaggccgccguccugauggggcucggcaagggcuggccccuccaccgcauggaccuuggggugccacugcucgccaucggcugcuacagccaggugaacccuacgacucuaaccgcgucccuagucaugcuccucguacacuacgcgauuauagggcccggacuucaggccaaggcuacgagagaagcccagaagcgcacggccgccggcaucaugaagaacccgacagucgacgggauaaccguaaucgaucucgagcccaucaguuacgacccgaaauuugaaaagcagcuggggcaggugaugcuucucgugcuaugugucgggcagcugcuccuuaugcggaccaccugggcccugugcgaggugcugacccuggcgacgggaccagccaugacccuuugggaggggaaucccggacgcuuuuggaacacgacgauagccguguccacugccaacauauucagaggcagcuacuuagcuggggcgggacuggccuucucauuaaucaaaaacgcccagacgccccgucgggggacaggcaccacgggcgaaacauugggugaaaaguggaagagacagcugaacucgcuggaucggaaggaauuugaggaguacaagagauccggcauacucgaggucgacagaacggaggccaagucugcacugaaagacgggaguaaaauuaagcacgcggucagucgcgguuccagcaagauacgguggaucgucgaaagggggauggucaagccgaaaggcaaggucguggaccugggcugcggccggggcggcugguccuacuacauggccacccuaaagaacgucaccgaggugaagggauacaccaagggcggcccuggucaugaggagccuauuccaauggcaaccuacggcuggaaccuggugaaacugcauagcgguguugauguguucuacaagcccacggagcaggucgacacccuccugugcgacauaggggagucgaguucuaaccccaccaucgaagagggaagaacccuucgcguccucaaaauggucgagccguggcugagcagcaaaccugaguucugcaucaagguccugaacccuuacaugcccacggugauagaagagcucgaaaaacuucagcgccgcuacggggguucccugguccggugcccccucucaagaaacuccacucaugagauguacugggucucgggggccuccgggaauauaguuagcucggugaacaccaucucaaagaugcuccugaaccgguucacaacacgccaccggaagccuaccuaugagaaagacgucgacuugggggcgggaacccgcuccguaaguaccgagacggaaaagccggacaugacagugaucggacggcguuuacagcgguuacaggaagagcacaaggagacuuggcacuacgaccaagagaaccccuaccguaccugggccuaccacgggaguuacgaagcccccagcacgggguccgcuagcucuaugguaaaugguauugugaaguugcugaccaagccgugggauguaaucccaaugguaacccagcuagccaugaccgauacgacccccuucggccagcagcggguguucaaggaaaaaguggacacccgaacgccccaaccgaaacccggcacucggaugauuaugaccacuaccgcaaauuggcugugggcccuccugggcaagaaaaagucuccccgucugugcacccgagaggaauucauuuccaaaguccgcagcaacgccgccaucggagcgguguuccaagaggagcaaggauggaccucggcguccgaggccgugaacgacagccgguucugggagcuagucaacaaggagcgcgcccugcaccaggaggguaagugcgaauccuguguguauaacaugaugggcaaacgggagaaaaagcucggggaauucggucgcgccaaagggagccgcgccaucugguacaugugguuaggcgcgcgcuucuuggaguucgaggcccucggauuucucaacgaagaucacugguucagucgcgagaauaguugguccggcguggagggugagggacuccaccggcugggcuauauccucgaagacauugacaagcaggacggagaccugaucuacgccgacgacaccgccgguugggacacccgcaucacggaggaugacuugcuaaacgaggagcugauuacagaacagauggcgccgcaccacaagaccuuggccaaggccauauuuaagcuuacauaccaaaacaaagucgugaagguccugcgucccacaccaaagggcgccgucauggauaucaucagccgcaaagaccaacggggcagcggacaaguggggaccuacggccugaacaccuucacgaacauggaaguccagcuuauccgccagauggaggcagaaggggugaucacacaggaugacaugcaaaaccccaagggccucaaagagcggguugagaaauggcugacagagugcggcguggacagacucaagcggauggcgauaagcggugacgacugcgucgucaagccccuggaugagagauucuccgcgucucuauuguuccuuaacgacaugggcaagguuagaaaggacaucccgcaaugggagcccucgaagggguggaaaaacuggcaggaggucccuuucuguagccaccacuuucacaaaauuuucaugaaagacggccgcucgcugguggugcccugccggaaccaggaugagcucaucgggagagcgcggauaagccagggcgccggcuggucccugcgggagaccgcgugcuuggggaaggcuuaugcacaaauguggucgcucauguacuuccacagacgcgauuugcggcucgccuccauggccaucugcagcgccguuccgacagagugguuuccgacaucgcggacgaccugguccauccacgcgcaccaccaguggaugaccaccgaggacaugcucaaggucuggaauaggguuuggaucgaggauaauccgaacaugacggacaagacccccguccacuccugggaagauauccccuauuuaggaaaacgcgaggaccucuggugcgggucccucaucggccucagcucccgagccaccugggcuaagaacauccauaccgcuauaacccaggugcggaaucuaauagggaaggaggaauacguugacuacaugccggucaugaagagguacagugcgcccuccgaaagcgagggggugcucuga

SEQ ID NO: 26326 - RNA, 9867 nt, Artificial Sequence
  derived and/or modified CDS sequence (opt11) from DENV-4__KC333651__SS-prME
agcaccaugacccugcucugcuugaucccuacgguuauggccuuccaccugagcacccgcgauggagagccguuaaugaucguagcuaagcacgagcgggggaggccccuguuguucaagaccacagagggcaucaacaagugcacacucaucgcgauggaccugggagagaugugugaggauaccgucaccuacaaaugcccucugcucguaaacaccgagcccgaggacaucgacugcuggugcaaucugaccagcaccugggugauguacgggaccuguacccagaacggagagcgacggcgggagaaacgcuccguggcccuuacgccgcacagcgguaugggccuggagacccgugccgagacauggauguccagcgagggggccuggaagcaugcccagcgcguggaaucguggauccugagaaaccccggcuucgcgcugcucgccggguucauggcguacaugauuggccagaccgggauccaacgcauagucuucuucguguuaaugaugcugguggcgccguccuacggcaugcggugcgucggcguggggaaucgcgacuucguggaaggcgucagugggggcgcguggguggaccucgugcuggagcacggcgggugcgucaccaccauggcucagggcaagcccacccucgacuuugagcucaccaagacgaccgcaaaggaaguggcgcuccugcggaccuauugcaucgaggccucuauuuccaacaucacgacugcaacccgcuguccgacccaaggggaacccuaucucaaggaggagcaggaccagcaauacaucugccgucgcgacgugguugaccggggcugggggaauggcuguggccuguucgggaaaggcggcgugguaacgugcgccaaauuucugugcuccggcaagaucacggggaaccucguccagauugagaaccuagaguacaccguggucgugaccguccacaacggcgacacccacgccguaggcaacgacaccuccaaccacggcgugaccgcgacuaucacgcccaggagccccuccguggaggucaagcuaccggacuauggagagcucacacuggacugcgaacccaggagcgguaucgacuucaacgagaugauacugaugaagaugaagaagaagaccuggcucgugcacaagcagugguuucuggaccugccccuccccuggaccgccggcgccgacaccuccgaggugcauuggaaccacaaggagcgcaugguaaccuucaagguaccgcacgccaagcgucaggacgugacgguccuggguagccaggagggagccaugcacuccgcccuggcaggcgcaaccgagguggacucgggcgacggcaaccauauguuugcugggcaccucaagugcaaggugcggauggagaagcugcgcaucaagggcaugagcuacaccauguguuccggaaaguucucuauugacaaggaaauggcagagacccagcacgggacgaccgucgugaaggucaaguacgagggcgcaggggcucccugcaaggucccaaucgaaauccgugacgucaacaaggagaagguugucgggcgcaucaucuccucaaccccguucgcugagaauaccaacuccgugacuaacaucgagcuggagccgcccuuuggggacagcuauaucguaaucggcguuggcgaguccgcccucacccugcacugguucaggaagggguccaguauugguaagauguuugagagcaccuaccgcggugcaaagcgcauggcaauccugggcgagaccgcgugggacuucggauccguggguggccucuucacgagccuuggcaaggcgguccaccagguauuuggguccguguacaccaccauguucgggggcgugucguggaugguccgcauccugaucggguuccucgugcuguggaucggcaccaacucccggaacacgagcauggccaugaccuguaucgccgugggcgggaucacgcuguuccugggcuucaccguccaggccgacauggggugcgugguguccuggaaugguaaggagcucaagugcgggaguggcaucuuugugguagacaacgugcauacguggaccgagcaguauaaauuccagcccgagucccccgcucgcuuagcuagcgcaauccugaaugcccauaaagacggcgucugcggcauacggucgacaacacggcuugagaacgugauguggaagcagaucacgaacgagcucaacuacguacugugggaaggcgggcacgaccuaaccgucguggcuggugacgugaagggcguucugaccaaggggaagcgggcgcugaccccgccugugaacgaccucaaguauuccuggaagacguggggcaaggccaagaucuucacgcccgaggcacgcaacucgaccuuccugaucgacggacccgacaccuccgagugccccaacgagagacgcgcguggaauuucuucgagguggaggauuacggcuucggcauguucacaaccaacaucuggaugaaguuuagagagggcagcuccgaggucugugaccaccgccugaugagugccgcaauaaaggaucagaaggccgugcacgccgauaugggcuacuggauugagucaucgaagaaccaaacuuggcagaucgaaaaagcuagccucauugaagucaagaccugccuguggccuaagacgcacacguuguggagcaacgggguccuggagucccagaugcugaucccgcggagcuacgcgggcccguucucccaacacaacuaccggcagggguacgcuacgcaaaccgugggcccuuggcaccuggggaaacucgagaucgacuuuggcgagugucccggcacgacgguggccauucgggaagacugcgaccaccgcgguccgagccugcgaaccaccaccgccuccggcaagcuggugacgcaaugguguugccguagcugcaccaugccgccacuccgcuuccuuggggaggacggcugcugguacgggauggagauccggccacugagugagaaggaagagaauauggucaagagccaggucaccgccggccagggcaccucggagacguucucuauggggcuccugugcuugacccucuucgucgaggagugccugcgaagacgcgugacccggaagcacaugaucuugguaguggugauuacuuucugcgcgauaauccuaggugggcugacguggauggaccugcuacgcgcccuuauaaugcugggcgacaccaugagcggacggauugggggccagauucacuuagccaucauggcugucuuuaagaugucccccggguacguacugggcgucuuccugagaaaacugaccucccgggagaccgcgcugauggucauaggcauggcgaugaccaccguguucuccauuccacacgacuugauggaacucauugacggcauuagucucggccugauccuucucaagauagugacccacuucgacaacacgcaggucgggacgcuggcccugucccugaccuucuuacgcagcaccauuccccucgugauggccuggcgaaccaucauggccguuuucuucgucgugacccugaucccgcugugccgcaccuccugccuccagaagcauagccacuggguggaaaucaccgcacuaauccugggcgcgcaggcuuugcccgucuaccugaugacccugaugaaaggcgccucccgacgcaguuggccgcucaacgagggcaucauggccgugggccuggucucccugcucggaucggcgcugcugaaaaacgaugucccccucgccggacccaugguugccgggggccuguugcucgccgcuuauguuauguccgggagcuccgcugaccuccuucucgagaaagccgccaacguucagugggacgagauggccgacaucacgggcagcuccccgaucaucgaggugaagcaagacgaggacgggagcuucucaauccgggacgucgaagagaccaacaugaugacgcugcugguuaagcucgccuugaucaccgucuccggccuguacccgcucgcgaucccagugacgauggcccugugguauaucuggcaggucaagacccagcgcagcggggcccugugggacgugccgucccccgccgcaacgcagaaggccacccucagcgaggggguguaccgcaucaugcagaggggccuguucgggaagacgcaagucggcguggggauccacauggaagggguguuccacaccauguggcaugugacccggggcagcguaaucugucacgaaacugggagacuggagccgagcugggccgacguacggaaugacaugaucuccuacggcggaggauggcgacucggcgacaagugggacaaggaggaggacguccaaguccuggccaucgagcccgggaaaaauccgaagcacgugcagaccaaacccgggcuguucaaaacacucacgggagaaaucggcgccgucacccuggacuucaaaccggggacaagcggcucgcccaucauuaacaagaagggcaaggucauugggcuguauggcaacgggguggucaccaaaagcggugacuacguauccgccaucacgcaggcggagcgcaucggcgagcccgacuacgagguggaugaggauauuuuucggaagaaacgccugaccauuauggaccugcauccgggcgcuggcaagacaaagcggauccugcccaguaucguccgcgaggccuugaagaggcgccuucguacgcugauccuggcccccacccgggucguggcagccgagauggaagaggcccuacgggggcugcccauccgcuaccaaaccccagccgucaaguccgagcacaccgggcgggagaucguggaccugaugugccacgcaacguucaccacccgccuucugagcuccacccggguccccaacuauaaucugaucgucauggacgaagcgcacuuuacggacccuuguagcguagccgcccgcgguuauauauccacuagggucgaaaugggggaggccgccgcgaucuucaugacugccacgccgccgggggccacggauccguucccccaaagcaacuccccgaucgaggacaucgagcgcgaaaucccggagcggucguggaauaccggauucgacuggauaaccgacuaccagggcaagaccgugugguucgucccuagcauuaaggccgggaacgacaucgcgaauugccuacgcaaguccggcaagcgcgucauccaacugagccggaaaacguuugacaccgaguaccccaaaaccaaguuaacggacugggacuucgugguuacaaccgacaucuccgagaugggggcgaacuuucgugcaggcagagugauagacccccgccgaugccucaagccgguuauacuaacggacggacccgagcgcgugauucuggccggcccuauccccgucacuccugccagcgcugcccaaagacgcggccguaucgggcggaaccccgcccaggaagacgaccaauacguguucucaggugacccccucaagaacgacgaagaccacgcccauuggacggaggccaagaugcugcuugacaacaucuacacccccgaggggaucaucccgacacucuucggcccugagagagagaagacgcaggcgaucgacggcgaguuucgccugcgcggggagcagcgaaagacguuuguugagcugaugaagaggggugaucuucccgucuggcugagcuacaagguggcauccgccgggaucucguacaaggaccgcgaguggugcuucacuggcgaaaggaacaaucaaauacuggaggagaacauggagguggaaauauggaccaaggaaggggagaagaagaagcuccgccccaaguggcuagacgcaagagucuacgccgauccaauggcgcugaaggacuucaaagaguucgccuccggccgcaagucgaucacacucgacaucuuaacggagauugccucgcugccaacuuaccuuagcaguaaagcuaaguuagcccuggacaacauugugaugcuccacacgacugagaaaggagggcgagcuuaccagcaugcccugaaugagcugcccgagagccucgagacacugaugcugguugcccuccugggcgccaugacggcggggaucuuucuguucuucaugcagggaaaggggauaggcaaacucuccaugggccugaucgccaucgccguggccagcgggcuccucuggguggcugagauccagccgcaguggaucgcggccagcaucauccuggaauucuuccugauggugcuucugaucccugagcccgagaagcagcgcacgccccaggacaaccagcugaucuacgucauccucaccaucuugacgauaauaggacugaucgccgcuaacgaaauggggcucaucgagaagacgaagaccgauuucggcuucuaccaggucaaaacggagaccacgauacuggacguugaucugcgcccggcaagcgccuggaccuuguacgccguugcuaccaccauacugacaccuaugcugcggcacaccauagaaaacacauccgccaacuuaagccuggcggcgaucgccaaucaggccgcagugcucauggggcuuggcaaaggcuggccgcugcaccgcauggaccuggggguaccgcuccuggccaucggcugcuacagccaggucaaccccaccacgcugaccgcgucccucgugaugcugcuggugcacuacgccauuauugggcccggcuuacaggcgaaggcaacccgggaggcgcagaagcgcaccgcugccggcaucaugaagaaccccacggucgacggcaucaccgucaucgaccuggagcccaucagcuacgaucccaaguuugagaagcaacugggccaggugauguugcugguacugugcgccgggcaguuacugcugaugcggaccacuugggcccuaugcgaagugcugacgcuagcaacuggaccagcgaugacacucugggaagguaaucccggccgguuuuggaauaccacgaucgccguguccacggccaacaucuuccguggcaguuaccucgcuggggcuggccuggccuucaguuugauuaagaacgcccagaccccccggcgggggaccggaacgaccggggagaccuugggggagaaguggaaaaggcagcugaacucccucgaccggaaggaauucgaggaguacaagcgcuccggcaucuuggagguugacaggaccgaggcgaagagcgcccugaaggacgggucgaagauuaagcacgcggugagccgcggcuccucuaagaucagguggaucguggagcgcgggauggucaagccgaagggcaaagugguggacuuggggugcggccgaggcgggugguccuacuauauggcaacgcugaaaaacgucaccgaggugaaagguuacaccaagggaggcccagggcacgaagagccaauccccauggccacuuacggcuggaaccuggugaagcuccacagcggcgucgauguguucuacaaaccgacagaacaggucgacacgcuucugugcgauauuggggaauccagcuccaaucccacgaucgaagagggccgcaccuuacggguccugaagaugguggagcccuggcugagcuccaaaccagaguucugcaucaaggucuuaaacccauauaugccgaccgugaucgaggagcuggagaaacugcagcggcgcuacgggggcagccuggugcguugcccccucucgaggaacuccacacacgagauguauugggucucaggcgccucugggaacaucgugagcuccgugaauaccauuagcaagaugcugcugaaccgguucaccacgcgccaucggaagcccacguacgagaaagacgucgacuugggugcggggacgcgcagcgugucuaccgagaccgaaaagccggacaugacggugaucggccguaggcuccagagacuacaggaagagcacaaggagacuuggcauuaugaccaggagaacccguaccgcacgugggccuaccauggguccuacgaggcacccaguacaggcuccgcgagcuccauggucaacggugugguaaagcuccugacgaaaccgugggacgucauccccauggugacccaacuggcgaugaccgacaccacccccuucgggcagcagcggguauucaaggaaaaaguagauacgcgcacgccccagccgaagccaggcacccgaaugaucaugacgacuaccgcgaacuggcucugggccuuacugggaaagaagaaguccccgcgccuuugcacgcgggaggaguucaucuccaaggugagaagcaacgccgccaucggcgccguuuuucaagaggagcaaggguggacguccgcaagcgaagcugucaaugacagucgguuuugggagcugguggacaaggagcgcgcccugcaccaagagggcaagugcgagagcugcguguauaacaugaugggcaaacgugagaaaaagcucggagaguucggccgcgccaaggggucucgggccaucugguacauguggcugggugcgagauuccuggaauuugaggcccucggauuccugaacgaggaccacugguucagucgcgagaacagcugguccggcgucgagggcgaggggcugcaccggcucggcuauauccuggaggacaucgauaaacaggagggugaccugaucuaugccgacgacaccgcgggaugggauacccguauaacugaagacgaccuccugaacgaggaacugaucacggagcagauggcaccccaucacaagacccucgcuaaggccaucuucaagcucacguaccagaauaagguagugaaaguccugcggcccacccccaagggcgccgugauggacauaaucagccgcaaagaccaaaggggguccggacagguggggacguacggccuaaacaccuucaccaacauggaaguccagcugauccgccagauggaggccgaaggggugauuacgcaggacgacaugcagaaccccaagggcuugaaggagcggguggagaaguggcucaccgagugcggcgucgaccggcugaagcggauggcgauaagcggggacgacugcguugugaaaccccuugacgagcgcuucaguacaagccuucuguuucugaaugacaugggcaagguuagaaaggacauaccgcaaugggagcccucgaagggguggaagaacuggcaagaaguuccguucugcagccaccacuuccauaagauauucaugaaggacggccgcucccucguuguccccugucgcaaucaggacgagcucaucgggcgcgccaggaucucucagggagcgggcuggucccugcgcgagaccgccugccucgggaaggccuaugcgcagauguggagccugauguauuuccaccgacgcgaucugcgauuggccuccauggcgaucugcagcgccgugccaacggagugguuucccaccucccgcacgaccuggucgauccacgcgcaccaccaguggaugacgacagaagacaugcugaagguguggaacagaguuuggaucgaagacaacccaaacaugacggacaagacccccgugcauaguugggaggacaucccguaucugggcaagcgugaagaccucuggugugggucguugaucgggcugucgagucgcgcgaccugggccaagaacauccacaccgccaucacccaggugcggaaccucauagggaaggaagacuacgucgacuacaugcccgugaugaagagguauagcgcgcccuccgagagugagggugugcuguga

SEQ ID NO: 26327 - RNA, 9867 nt, Artificial Sequence
  derived and/or modified CDS sequence (opt11) from DENV-4__JN559740__SS-prME
ucgacaauuacacuacuaugccuaauuccgaccgucauggccuuccaccuaaguacgcgagacggggaaccacuaaugauaguagcgaaacacgaacgagggaggccccugcuguuuaaaacaacagaaggaauaaauaaaugcacacucauagcgauggaccugggagaaaugugugaggauacagucacauacaaaugcccgcuucucguaaacacagaaccggaggauaucgauugcuggugcaacuuaacaaguacauggguuauguauggaacgugcacacaaaguggagaaagaagaagggagaaaagaagcguugcacuaacgccccacucagggauggggcuggaaacaagggcagagacauggaugucaucugaaggagcguggaaacacgcccagcgcguggaaagcuggauacuucgaaaccccggauucgcacuccuggcaggauucauggcauacaugaucggccaaacaggcauacaaagaacuguuuucuucguauuaaugaugcucguagccccaagcuauggaaugagaugcguuggcguggggaaucgcgacuucgucgagggcguuuccggaggcgcauggguagaucugguacucgaacacggcggcuguguaacgacaauggcacagggaaaaccgacccuagacuucgaguuaacgaaaacuaccgcgaaagaggucgcguugcuacgaacauacugcauugaggcaaguauaagcaacauaaccacagcgacccggugccccacacaaggggaaccguaccuaaaagaagaacaagaucaacaauauauaugcagacgcgacgucguagacagggguugggggaauggcuguggccuauucggaaaaggagguguagucacgugugcaaaauucaguuguucaggaaagauaacggggaaccuuguccagaucgaaaacuuggaauacacggucgucgugacaguccacaacggcgacacacgcgcaguagggaacgacauaucgaaucacggcgucaccgcgaugaucacaccacgcucgccaucagucgagguaaaauuacccgacuacggagaacucacccuagacugcgaaccgcgaagcggcauagacuucaacgaaaugauacuuaugaaaaugaaaaagaaaacuuggcucguccacaaacaaugguuccuagaccucccauuacccuggacggccggggcggacaccucugaaguacacuggaacuacaaagaacgaaugguuacuuucaaaguaccgcacgcgaaaagacaggacgucacgguccucggaucacaagagggagcgaugcacagcgccuuagcaggagcaacagaagucgauagcggugacgggaaucacauguucgccggucacuuaaaaugcaaaguaagaauggagaaguugcggauuaaaggaauguccuacacaaugugcagcgggaaauucagcaucgauaaagagauggcagaaacccaacauggaacuacgguggugaagguuaaauacgaaggcgccggggccccaugcaaaguacccaucgagauuagagaugucaacaaagagaagguagugggcaggauuauaagcagcacacccuuagccgaaaauacaaacuccguaacaaauaucgaguuagaaccacccuucggggacuccuacauaguaaucggggugggaaacagcgcauuaacguuacauugguuccguaagggguccagcaucgggaagauguucgaaagcaccuaucgcggugcgaaacguauggcaauacucggugagacugccugggacuucgggagcgugggcggcuuauucacaucacucgggaaagcgguccaccagguuuuugggucgguguauacaacgauguucggcggagucaguuggaugauaaggauccucauuggcuuccuaguacuuuggaucgggaccaacucgagaaacacuucaauggcuaugacaugcauagccgucgggggcaucacgcuguuccuugguuucacaguccaagcagacaugggcugcguagugagcugguccggcaaagagcuuaaaugcggaagcgggauauucguugucgacaacguucauacguggacggagcaauacaaauuucaaccagaaaguccugcccgccuagcgucggcaauacugaacgcccauaaagacggagugugcgggaucagaucaacaacccgacuagaaaacgucauguggaaacagaucacuaacgagcucaauuacgugcuuugggaaggcggucacgacuuaacggucgucgcaggagacgugaaagguguucugacaaaaggaaagcgagcucuaacuccacccgugagcgaucucaaauacucauggaagacauggggcaaggcuaaaauauucacaccagaagccagaaacucgacauuccugauagacgggccagacaccuccgagugcccaaacgaaagacgagcauggaacagucucgagguugaggacuacgguuucggcauguuuacgacaaauaucuggaugaaauuccgcgaaggcucgucggaggucugcgaucaccgguugaugucggcagcaauaaaggaccagaaagccguucacgccgauaugggcuacuggaucgagucuagcaaaaaccaaacguggcagauagaaaaagcaucccugauagagguaaaaacgugucuauggccaaagacccacacacuauggucaaacggcguccuagaaagucaaaugcuuauaccaaaaagcuacgcugggccguucagccagcauaacuacaggcagggguacgccacccaaaccgugggcccauggcaucuggggaaacuagagauugacuuuggagagugcccugggacaacaguaacaauccaggaagauugcgaccaccgaggacccucccugcgcaccacgacggccuccggcaagcuagucacgcaauggugcugccgguccugcacgaugccaccccuucguuuccugggcgaagauggcuguugguauggcauggagauuagaccacugagugagaaggaagagaacauggucaaaucucaaguaacagcgggccaaggcaccucugagacauuuucuaugggacuccuuuguuuaacacuuuucguggaagagugcuuacgaaggcgggucacgcgaaaacacaugauauuagucguggucauuaccuuaugcgcgauuauccucggcggauuaacauggauggaccuuuuacgcgcccucaucaugcugggcgacaccaugagcggcaggauaggcgggcaaauccaccucgccaucauggcugucuuuaaaaugucuccgggguauguacucggcgucuuccucagaaaacuaaccagcagggaaacggcauugaugguaaucggaauggcgaugacgacaguacuuucuauaccacacgaccuaauggaacucaucgacggcaucucauuagggcuaauacuguugaaaaucguaacucaauucgacaacacacagguaggcacauuggcauuaagccuaacguuuauucgcuccacaaugccacuugucauggcuuggcggacuauaauggccguccucuucgucgugacccucauaccccucugccgcaccucaugucuccagaaacagucccacuggguagagauuacggcgcucauccuaggcgcacaggcacuacccgucuaccuuaugacacugaugaagggcgcaucaagacgcagcuggccgcucaacgaggguaucauggcaguaggguuagugucgcuccugggaagcgcacuccucaaaaacgacgucccacuagcuggaccgaugguagcuggcggacugcugcuagccgcguauguaaugagcgguagcuccgccgaccugagccucgaaaaggcggcuaacguccaaugggacgaaauggcagacauaacaggcuccaguccaauaauugaagugaaacaagacgaagaugguucguuuaguauccgagacgucgaggagacaaacaugauaacgcugcucguaaaacucgcccucauaaccgucagcggacuguauccccucgcaauuccagucacuaugacacucugguauauguggcagguuaagacccagcgguccggggcgcuaugggacgugccgagcccggcggcaacucaaaaggccgcccucuccgaggguguuuaccggauaaugcaaagaggccuuuucgggaagacgcaaguuggaguggguauccacauggagggaguuuuccacacaauguggcacgucacacgaggaucggucauaugccaugaaaccggccgccuggaaccgucaugggccgacguaagaaacgacaugaucucguacggaggaggguggcgccucggcgacaagugggacaaggaggaagacguacaaguccucgcuauagaaccaggcaaaaaccccaagcacguccagacaaaaccaggacuguucaagacccucacaggcgagaucggcgcagugacauuagacuucaaaccaggaaccucaggcucaccgauaaucaacaggaagggcaaggucaucggccuguacggcaacgggguggugaccaaaucaggugauuacguaucagcgaucacucaagcggagcgaauaggagaacccgacuaugaaguagaugaagacaucuucagaaagaaacggcucacaaucauggaccugcacccaggggccggaaaaacgaaacgaauauuaccgagcaucguaagagaagcauugaagagacgccuaaggacacuaauccucgcuccuacgagaguuguagccgcggagauggaagaggcuuuaaggggacucccaaucagguaccagaccccugcagucaaauccgagcacacagguagggagauagucgaucugaugugucacgccacuuucaccacaaggcugcugagcagcacacgcguuccgaacuauaaccucauuguuauggaugaggcacauuucacagaccccagcucuguggcagcgcgcggauauaucagcacgagaguagagaugggcgaagccgccgcgauauucaugacggccaccccgcccggugcaaccgaucccuuuccacaaucaaauucccccauagaggauaucgagcgggagauuccagagaggagcuggaacacaggguucgauuggauaacggacuaccagggcaaaacagucugguuugugccuuccaucaaggcugguaacgacaucgcaaacugucuccgaaaaagcgggaagaaagucauccagcugaguagaaaaacauucgacacggaauacccaaaaaccaaguugacggacugggacuuuguagucaccacggacaucagcgaaaugggggcaaacuucagagccgggcguguaauagacccaagaaggugucuaaaacccguaauccuaaccgaugguccagagaggguaauccuggcaggaccgauuccgguaaccccggcauccgcggcacagcgacgcggaagaaucgggaggaacccagcgcaagaagacgaccaguacgucuucucaggggauccacucaagaacgacgaagaccacgcacacuggaccgaggcaaagaugcuucucgacaacauuuacaccccagaaggcaucauaccaacucuguucggccccgagcgggagaaaacacaagcaauugauggcgaguuccggcuaagaggcgaacaaagaaaaacguucgucgaauuaaugagaaggggagaucucccagucuggcuuucauauaagguagcauccgcggggaucucauacaaagaccgagaauggugcuucacuggggagcggaacaaccaaauacuggaggaaaacauggaggucgagauauggacucgugaaggagagaagaagaaacuucgcccccgguggcuagacgcccgagucuacgcagaucccauggcacuaaaggacuucaaagaauuugcaaguggacggaaaagcauaacauuagacauacugacggagauugcaagccuaccuacguaccugucuagccgcgcgaaacuugcgcucgacaacauagugaugcugcauaccaccgagagaggcggacgagcauaccaacaugcucuaaacgaacugccagaaucccuagaaacccugaugcucgucgcauugcucggugcaaugacagcaggcauauuccuuuucuuuaugcagggcaaaggcaucggcaaacucucuaugggacugaucacaauagcaguugcuucgggacuacucuggguggcggaaauacagccacaguggauagcagcaagcauaauacuagaguuuuuccucaugguccucuuaaucccugagcccgaaaagcaacguacgccucaagacaaccagcugaucuaugucauacuuacaauacuuacaauaauugggcucauagcagcgaacgagaugggccuaauagaaaagacaaagacagacuucggauucuaccaagucaaaaccgaaacgacgauccuggacgucgaccuaaaaccggcaucagccuggacccucuacgcaguagcuacgacuauacugaccccaaugcuacgccacaccaucgaaaacaccucugcuaaccugagucuggcagccauugcgaaccaagccgcgguccugaugggcuugggcaaaggcuggccgcuccacaggauggacuuaggcgugccacuacuagccaugggaugcuacucccaagugaacccuauaacauugacagcaagccuggucauguuacucguucauuacgcaauaaucggaccagggcuacaggcgaaggcaacacgggaagcucagaaaagaacagcagcggguaucaugaagaauccaacgguagacggcauaacaguuaucgaccuggagccaaucucuuacgaccccaaauucgagaaacagcuaggccaagucaugcuccuaguccuaugugcggggcaacugcugcugaugcguacaacaugggccuuuugugaaguccucacccucgccacgggccccauccuaacacuaugggaaggaaacccagggcgguucuggaacaccacgaucgccgucagcacagcaaacauauuccggggcucuuaccuugccggcgccggguuagcauucucccuaaucaaaaacguucagacgccgcggcgagguaccggaacaacgggagaaacgcuuggugaaaaauggaagcggcagcuuaacagccuagaccgcaaggaauuugaggaguauaaacgaagugguauauuggaaguagaucgcacagaagcaaaaucagcacugaaagacgggucgaagauaaagcaugcaguaucucgggggagcagcaaaaucagauggauaguagagcgcggcaugguaaaaccgaaaggcaaggucgucgaccucggcugcggacgcggugguuggaguuacuacauggcaacgcuaaagaacgucacagaaguuaaagguuauacgaaaggcggaccgggccacgaggagccaaucccaauggcgacuuacggauggaacuugguaaaacuacacagcggaguggaugucuucuacaagccaacugaacaaguggauacacuuuugugcgacaucggcgaaucuagcaguaacccgacuauagaagaagggaggacauuacgaguccucaaaauggucgagccuuggcuuagcucuaagccugaguucugcauuaagguacucaaccccuacaugccaacagucauagaggaauuagaaaaacuucaaagaaaacacggagggaaccuugucagaugcccacucucucgcaauuccacgcaugagauguacuggguaucgggggccucaggaaacauaguuucauccgugaauacaaccucuaaaaugcuccuaaacagauuuacaaccagacacagaaaacccacguaugagaaagacguugauuuaggcgccggcacgagauccgugucuaccgagacggaaaaacccgauaugacaauuaucggacgaaggcuacaacgccugcaagaggagcacaaagaaacauggcauuacgaccaggagaaccccuaucguacaugggccuaucacgguuccuacgaggcccccucgacaggcagugcaucgaguauggugaacggaguaguaaagcuccucacuaagccgugggacguaauaccuauggugacucagcuggcaaugacagacacgacgccauuugggcagcagaggguguuuaaggagaagguagacacacgcacaccccagcccaagcccggaacgcguauggugaugaccacgacagcgaacuggcucugggcccuacugggaaagaagaaaaaucccagacuuugcacucgagaagaguucaucagcaaaguucguucuaacgccgcgaucggagcagucuuccaagaggagcaagguuggaccucggccucggaggcagucaacgacagccgguucugggaacugguagacaaagaacgugcccuccaccaggaggggaaaugcgaaagcugcguauacaacaugaugggaaagagggagaagaaacuaggggaguucggccgcgcgaagggcagccgcgcgaucugguacauguggcuaggagcacgguuccuggaguuugaggcccucggauuuuuaaacgaagaucacugguuuggaagggaaaauuccuggagcgggguagaaggagaaggccuccaccgcuuaggauacauccuugaggaaauugacaagaaagacggggacuugauguaugcagacgacaccgcagggugggacacgagaaucaccgaagaugaucuccaaaacgaggagcucauaaccgaacagauggcuccucaucauaaaauacucgcaaaggccaucuuuaagcucacauaccagaacaaaguagucaaaguccuccgccccacgcccaggggugcugucauggacauaauaucccgaaaggaccaaagaggaaguggacaggugggcaccuauggccugaacacauucacaaacauggagguacaacuaauacggcaaauggaagcagaggggguaauaacccaggaugauaugcaaaacccuaaaggccucaaagagaggguugaaaaauggcuuaaggagugcgggguagacagacucaaaaggauggcaauaaguggggacgauuguguuguaaaacccuuagacgagagguucggcacaagccuccuuuuucuaaacgacauggggaaggugcggaaagacauaccucaaugggagccgagcaaaggguggaaaaauuggcaggaaguaccauuuugcucccaccacuuucacaaaauauuuaugaaggauggacgcucccugguagucccaugccgaaaccaggacgagcuaaucgguagagcaagaauuagccaaggggcaggcuggucauuacgugaaaccgcaugccuggggaaggcguacgcccaaauguggagucuaauguauuuccauagacgcgaucuacgacucgcaagcauggcaaucugcucggcagugcccacugaaugguucccuaccagccguacuacguggucaauccacgcucaccaucaguggaugaccacagaggacaugcuaaagguauggaaucgaguauggauagaagauaaccccaauaugacagacaagacaccgguccacagcugggaagacauacccuaccuggggaaaagagaagaccucuggugcggaucacuaauaggauugucgucaagagcaacuugggcgaaaaacauacacaccgcgauaacacaaguaaggaaccugauuggaaaagaagaguacguagacuacaugccugucaugaaacgguacagcgcaccuagugaaagcgagggcguacucuaa

SEQ ID NO: 26328 - RNA, 9867 nt, Artificial Sequence
  derived and/or modified CDS sequence (opt11) from DENV-4__JN559741__SS-prME
uccaccaucacccugcucugucugauccccacggugauggccuuccacuugaguacccgcgacggcgagccgcugaugauagucgccaaacacgagcgggggcgcccccuucuguucaagaccacggagggcaucaacaagugcacguugaucgcgauggaccuaggggagaugugcgaggacaccguuacguacaaguguccgcuauuagugaacacggagcccgaggacaucgacugcuggugcaaccugacgucgacgugggucauguacggaaccugcacccaauccggggagcggcgccgggagaagaggagcguagcccugacgccgcacuccggcaugggauuagagacccgggcugagaccuggaugagcuccgagggggcguggaaacacgcccagcgcguggagucguggauccuccgaaacccggguuucgcguuacuggccggguucauggccuacaugaucggccagaccggcauccagcgcacggucuucuuuguguuaaugaugcugguggccccuuccuacggcaugcggugcguuggcguagggaaucgcgacuucguggagggcgucagcggcggugcguggguggaccucguacuggagcacggcgggugcgucaccaccauggcacagggaaaacccacccuugacuucgagcucacgaagaccacggcaaaggagguugcccuacugcguaccuacugcaucgaggcccugaucuccaacauaacgaccgcgacccgaugcccgacccagggcgagcccuaccugaaggaggagcaggaccagcaguauaucugccggagagacguggucgaccggggcugggguaacgggugcggccuguucgguaaaggcggggucgugacaugcgcgaaguucagcugcuccggcaagaucaccgguaaccucguacagaucgagaaucuggaguacaccgugguuguuaccgugcacaacggcgacacgcacgccgucggcaacgacaccagcaaccacgggguuacggccacgauuacgccccguucccccagcguggaagucaagcugccagacuacggagagcucacuuuagacugcgagccccgguccgggaucgacuucaacgaaaugauccugaugaagaugaaaaagaagaccuggcucgugcacaagcagugguuccuggaccuaccacucccuuggaccaccggcgccgacacgagcgagguccacuggaacuacaaggagcgcauggucacguuuaaagugccgcacgcgaaacggcaggacgugaccgugcuggggucccaggagggugcuaugcacagcgcccuggccggcgccaccgagguggacagcggggacggcaaccacauguucgcggggcacuugaagugcaaggugcgcauggagaagcugcgcaucaagggcauguccuacacgaugugcagugggaaauuuuccaucgacaaggagauggcggagacccaacacgggaccaccgucgugaagguuaaguacgaaggcgcaggggccccgugcaaggugcccaucgagauccgggacgugaacaaggagaagguggugggccgcgugauuagcgccacaccccuggcggagaacaccaacuccgugaccaacauugagcucgagccucccuuuggcgacagcuauaucgucaucggggugggcaacuccgcccugacuuuacacugguuccggaaggguaguucgaucggcaagauguucgagagcacguaccgcggggcgaagcggauggccauccucggcgagaccgcgugggauuucggguccgucgguggccuguucaccagccuggggaaagcuguccaccagguguuuggauccguguacaccacgauguucgggggcgucucuuggaugauccgcauccuaaucggguuccuggugcuauggaucggcaccaauucacguaacaccagcauggccaugacaugcaucgccgugggcgggaucacgcuguuccucggcuucaccguccaggccgacauggggugcgugguguccuggaguggcagggagcugaagugcggguccggcaucuucgucguggacaacgugcacaccuggacggagcaguacaaguuccagcccgagagcccggcgcggcuggcaagcgccauccucaacgcccacaaggacggcgucugcgggauuagguccacgacucggcuggaaaacgugauguggaagcaaaucaccaacgagcugaacuacguacucugggaagguggacacgacuugacggucguggcgggggacgugaagggcguccugacuaaggggaagcgcgcacucaccccgccugcgagcgaccugaaguacuccuggaagaccuggggcaaggccaagaucuucacuccggaggcccggaacucgacguucuuaaucgacgggcccgacaccuccgagugcccgaacgagcgacgggccuggaacagcuuugagguggaggacuauggcuucgggauguuuaccacuaacaucuggaugaaguucagagagggcuccagcgaggugugugaucauagauuaauguccgcggcuaucaaggaucagaaggcgguccacgcagacaugggcuauuggaucgaaagcuccaagaaccagacguggcagaucgagcgcgcgagccucaucgaggugaaaacgugucuuuggcccaagacccacacccuauggucgaacgggguguuagagagccagauguuaauacccaaguccuacgccggcccguuuagccagcauaacuaccgacaaggguacgccacccagacaguagguccauggcaccucgggaagcuggagaucgauuucggggaaugcccgggcaccaccguaaccauccaggagaacugcgaucaccgcgggcccagucugcgcacgaccaccgccucuggcaagcucgugacccaguggugcugccggagcugcacgaugccgccccugcgcuuccugggggaggacggcuguugguacgggauggagaucaggccccucuccgagaaagaggagaauauggucaagagccaggucaccgccgggcaggguaccuccgaaacguuuagcauggguuugcugugccuaacccuguucgucgaggaaugcuugcgccggagagucacccggaaacacaugauccucgccguugucaucacccugugcgcuaucauccuagggggcuuaaccuggauggaccugcugcgugcccucauaaugcugggcgacaccaugucgggucggauugggggccagacccaccuggccaucauggccguguucaagaugagccccggguacguacucggcgucuuccuacgcaagcugaccuccagagagaccgcccugaugguuaucgguauggccaugacgacaacccugagcauuccccacgaucucauggaacucauugacggcaucucccugggccugauccucuugaaaaucgugacccaguucgacaacacgcaggucgggacccuggcccucagccugaccuuuaucagguccaccaugagccucgugauggccuggagaacgaucauggccgugcuauucgucgugacacugaucccccugugccgcaccuccugccuccagaagcagagucacugggucgaaauuaccgcgcugauccugggagcacaggcccucccugucuaccugaugacacugaugaagggcgccucccgacgcagcuggccccucaacgagggcaucauggcggugggacuggugucucugcucggcagcgcccugcucaagaacgacgucccgcucgccggcccgaugguggcagggggccugcugcucgcagcuuacgugauguccgggagcucagccgaccugucgcuugagaaggccgccaacgugcagugggacgagauggccgacaucaccggcagcucccccaucaucgagguaaaacaggacgaagacgggagcuucuccauccgggacguggaggagacuaacaugaucacccuccuggucaagcuggcgcucaucaccgugagcggauuguacccccuggccaucccgaucaccaugacccucugguacauguggcaagugaagacccaacgcuccggcgcccugugggacguccccucgccagccgccacccagaaggcggcccugagcgaggggguguaucggaucaugcagcgcggucucuucgguaagacacaggugggcgucgggauucacauggagggcguguuccacaccauguggcaugucacucggggcagcgucaucugccacgaaaccggacgacucgagcccuccugggccgacgugcggaacgacaugauaagcuacggcgggggcuggcggcuaggcgauaagugggauaaggaggaagacgugcagguuuuagccauugagccggggaagaaccccaagcacgugcagacgaagcccggccuguucaagacccugacgggggagaucggcgcugugacgcucgacuucaagccggguacguccggcagcccgauuaucaaccgcaaaggcaaggucaucgggcucuacggcaacgggguggugacuaaguccggggacuacgucagcgcgaucacccaggccgaacggaucggggagcccgauuacgagguggacgaggauaucuucaggaagaagcggcugaccaucauggaccuccaccccggcgcgggaaagacgaagcgcauucugccguccaucguacgagaggcccuaaagaggcgucuccgcacccucaucuuagcacccacccggguuguggcagccgagauggaggaggcccugagggggcucccgauccgguaccaaacccccgcugugaaaucggagcacacggggcgagaaauagucgaccuuaugugccacgcgaccuuuaccacccggcugcucuccagcacgcgcgugccgaacuacaaccugaucgugauggaugaggcccacuucaccgaccccagcuccguagccgcccguggguacauuagcacucgcguggagaugggcgaggccgcugccaucuucaugaccgcuacgccacccggggccacagacccauucccucaauccaacagccccaucgaagauauagagcgggagaucccugagcgaucguggaauacgggcuuugacuggaucaccgauuaccagggcaagacggugugguucgugccgaguaucaaagccgggaacgacaucgcgaacugccugcgaaaguccggcaagaaagugauucagcucagccggaagaccuucgacacggaguacccaaaaaccaagcugacggacugggacuucgucgugaccaccgacauauccgaaaugggggcaaacuuccgcgccggccgggugaucgacccccgacggugccucaagcccgucauuuuaaccgacgggccggagcgcgugauccuggcgggccccauccccgugacgccugccagugccgcccagcggcgcggccggaucgggcgcaacccggcccaggaggacgaccaauacgucuuuuccggcgaucccuugaagaacgaugaggaucacgcucauuggaccgaggcuaagaugcuccuggacaacauuuacacccccgagggcaucauccccacucuguucggacccgagcgggaaaagacucaagccaucgauggcgaguuccgccuccggggcgagcagcgcaagacguuuguggagcugaugcggcgcggagaccugcccguguggcucucauacaaggucgccuccgccgggauaagcuacaaggaccgggaaugguguuuuaccggggagcgcaacaaccagauccuggaggaaaacauggagguggagaucuggacccgggaaggggagaagaagaagcugcgacccaagugguuagacgcccggguguacgcugaccccauggcccugaaggacuucaaggaguucgccagcgggcgaaagagcaucaccuuggacauccucacggaaaucgccucccugcccaccuaccugagcucccgcgcgaaguuagcauuagacaacaucgucaugcugcacaccaccgagcggggagggcgcgcguaccaacacgcccuuaacgagcugcccgagagccuggagacacucaugcugguggcccugcugggcgcuaugaccgccgggaucuuccucuucuucaugcagggcaaggggaucgggaaacugagcaugggccucaucaccaucgccgucgccuccggguuacuuuggguagcggagauccagccccaguggaucgcggccagcaucauccucgaguucuuccugauggugcugcuuaucccggagcccgaaaagcagcggaccccgcaagacaaccagcuuaucuaugugauacugacuauccucaccaucaucggccucauagccgcgaaugaaauggggcuaaucgaaaagaccaagaccgacuucggauucuaccagguuaaaacggagaccaccauacucgacguagaccugaggcccgccuccgccuggacccuguacgccguggccacgacuauccucaccccgaugcugcggcacaccaucgagaacaccagcgccaacuugucccucgccgcgauagccaaccaggcugccguccugauggggcugggcaaggguuggccccuccaccgcauggaucugggggugccccugcucgcaaugggcugcuacagccaggugaacccgaccacccuuaccgcgucgcuggucaugcuccugguccauuacgccaucaucggaccgggacuucaggccaaggccacgcgggaggcgcagaagcgcaccgcagccggcaucaugaagaaccccaccguggacgggaucaccgucaucgaccucgagccgaucagcuaugaccccaaguucgagaagcagcuggggcaagugaugcugcucguguugugcgcuggccagcugcuucucaugcggacgacuugggccuucugcgagguccugacccucgcgacgggcccgauccugacgcugugggaggggaaccccggccgcuucuggaacaccacaaucgccguguccaccgccaacaucuuccggggcagcuaccucgccggggccggccuggcguucucccugaucaagaacgcgcaaacgccucguagggggaccggcaccgccggagagacccucggagagaaguggaagaggcagcugaacagccuggaccggaaggaguuugaggaguacaagcgcagcgguauacucgagguggaccggaccgaggccaagagcgcccugaaggaugguuccaagaucaaacaugcggucagcagaggcuccagcaagauucgguggaucguggagcgcgggauggugaagcccaaggguaagguagucgaccugggcugcggccgcggcgggugguccuacuacauggccacgcucaagaacgucaccgaggucaagggauacaccaaaggagggccggggcacgaggagcccauccccauggccaccuacggguggaaccuggugaagcugcauagcggcguugacguuuucuacaagcccacggaacagguggauacucugcucugcgacaucggcgagagcuccagcaauccgaccauagaggaaggccggacccugaggguccucaagaugguggagcccuggcuguccagcaagcccgaguucugcaucaaggugcugaaccccuacaugccgacggugaucgaggaacuggagaagcuccagcggaagcacgggggcaaccugguccgcuguccgcugucccguaacagcacccacgagauguacuggguguccggcgccuccgggaacauugucuccagcguaaacaccaccaguaagaugcuccugaaccgcuucacgacccgucaccgaaagccaaccuaugagaaggauguggaucugggcgcggggaccagaagcgucuccacggagacugagaagcccgacaugaccaucaucggucgacggcuccagcgccuucaggaggagcacaaggagaccuggcacuaugaccaggagaacccauaccggacgugggccuaucacgggagcuaugaggcccccucgaccggcuccgccuccucgauggugaacggcguggucaaguugcucaccaagccuugggacgugauuccgaugguaacacagcuugccaugacagacacgaccccauucgggcaacaacgaguuuucaaggagaagguagacacccggacgccucaacccaagccaggaacccgcauggugaugaccaccacggcgaacuggcugugggcccuccugggaaagaagaagaacccccggcugugcacccgcgaggaguucauauccaagguccgcagcaacgccgccaucggcgcgguguuccaggaggagcagggguggaccagcgcgucggaggccguaaacgauagccgcuucugggagcucgucgacaaagaacgggcacugcaccaggagggcaagugcgaauccugcguguacaacaugaugggcaagcgcgaaaagaagcugggagaguucgggcgugcaaaggggagccgggcaaucugguacauguggcucggcgcgcgcuuccuggaguucgaggcccuuggguuccucaacgaggaccauugguucgguagggaaaauuccugguccggaguugaaggggaaggccugcaccgccugggcuacauccucgaggagaucgacaagaaggacggcgaccugauguacgccgacgacacagcuggcugggacacgcggaucacagaggacgaccugcagaacgaggagcugauuaccgaacagauggcgccgcaccacaagauucuagccaaggccaucuucaagcugaccuaccaaaacaaggucgugaaagugcucagacccacuccgagaggggccgucauggacauaaucuccagaaaggaucagcggggcaguggacaggugggcacguacggcuugaauacauucaccaacauggaggugcagcugaucagacagauggaggccgagggcgucaucacccaggacgacaugcagaaucccaagggccucaaggaacggguggaaaagugguuacgagagugcggaguggaccggcugaagcgcauggcgauauccggcgacgacugcgucguuaagcccuuagacgaacgguucgggacgagccugcuguuccuuaaugacaugggcaaggugcgaaaggacaucccccagugggagccguccaagggguggaagaauuggcaggagguccccuucugcagccaccacuuccacaagaucuuuaugaaagacggccguucccugguggugcccugccgcaaccaggacgagcugauuggccgggcccgcaucagccagggggccggcuggucccuacgcgagaccgccugucuggggaaagccuacgcucagauguggagccugauguacuuccacagacgcgaucugcggcuggccuccauggcaaucugcuccgcggugcccacugagugguucccgaccagccgcacaaccugguccauccacgcccaccaccaguggaugacuaccgaggacaugcuuaaaguguggaaccggguguggaucgaggacaacccuaacaugauugauaagacgccgguccauuccugggaggacauccccuaccuuggcaagcgagaggaucuguggugcgggucccugaucggccucagcucucgggcgacuugggccaagaacauccacaccgcgaucacucaagugcgcaaccugaucgguaaggaggaguacguggacuacaugccggucaugaagcgguacagcgcccccuccgaaagcgagggggugcuguag

SEQ ID NO: 26329 - RNA, 9867 nt, Artificial Sequence
  derived and/or modified CDS sequence (opt11) from DENV-4__JQ513334__SS-prME
agcaccaucacgcugcucugccugaucccgaccgugauggccuuccaccuguccacccgcgacggggagccgcucaugauaguggccaagcaugagcgggggcgcccccugcuguucaagaccaccgaggguauaaacaagugcacccucaucgccauggacuuaggggagaugugcgaggacaccgugaccuacaagugcccccugcucgugaacaccgagcccgaggacaucgacugcuggugcaaccuaacgagcaccuggguaauguaugggaccuguacccaguccggugaacggcgccgggagaaacgcagcguggcccugacgccgcacuccggcaugggcuuggagacccgcgccgagacguggaugagcuccgagggggccuggaagcaugcccaacgcguggaguccuggauacuccggaacccgggcuucgcgcugcucgcugguuucauggccuacaugaucggccagacggggauccagcgcaccgucuucuucgugcugaugaugcugguggcccccaguuacggcaugcgaugcgugggggucgggaaccgcgauuucgucgagggcgucagcggaggcgcuuggguggaccucguacuggagcacggcgggugugugaccacaauggcccagggaaaacccaccuuagacuucgagcucaccaagaccaccgccauggagguggcccuccugcggaccuacugcaucgaagccuccaucagcaacaucacgaccgcgacccgcugcccgacccagggggagcccuaccucaaggaagaacaggaccagcaguacaucugccggcgcgauguggucgacaggggcuggggcaacggaugcggucucuucgggaagggcggcguggugacgugcgccaaguucuccugcagcgagaagaucaccggaaaccucguccagaucgagaaccuugaauacaccgugguggucacugugcacaauggggacacacacgccgucggcaaugacaccagcaaccacggcgugaccgccaccaucacgccccgcucccccucuguggaggucgagcugccggauuacggugagcugacccucgacugcgagccccggagcggcauagacuucaacgagaugauccugaugaagaugaagaagaagaccuggcugguucacaagcagugguuccucgaccugccccugcccugggccgcuggugcggauacauccgagguucacuggaacuacaaggaaaggauggucaccuucaaggugccgcacgcaaagcggcaggacgugacuguccucggcagccaggagggagcuaugcacagcgcccuggcgggagccaccgagguggacuccggcgacgggaaccauauguucgccggccacuugaagugcaaggugagaauggagaagcuccgcaucaaggggaugagcuauaccauguguuccgggaaguucucaaucgacaaggagauggccgagacccagcacggcacgacagucgucaaggugaaguacgaaggggccggcgcgcccugcaaggucccgaucgagauccgggacgugaacaaggagaaaguggucgggagggugaucuccagcaucccccuggcugaaaacaccaacuccgucacaaacauugagcuggagccacccuucggcgacucguacaucgucaucggggugggcaauuccgcccucacgcugcauugguuccgcaagggaaguuccaucggaaagauguucgagagcacauaccggggcgccaaacggguggcgauccugggggagacagccugggacuucggcuccgucggagggcucuucacgagccucgguaaggcggugcaccagguguucggguccguauacacgaccauguucggcggggugagcuggauggugcgcauccugauuggccuccugguacuuuggaucggcaccaacagucggaacacuucaauggccaugacgugcaucgcugugggcggcaucacccuguuccucggguucacugugcaggcggacaugggcugcgucguguccuggagcgggcgagagcugaagugcggcagcgggauuuucguggucgacaacguacacacuuggacggagcaauacaaguuccagccggaaucccccgcccgacuggcgucggccauccuuaaugcccauaaggacggcguaugcggcauacgcuccaccacccggcuggagaacgucauguggaagcagaucacaaacgagcugaauuacgugcucugggagggcgggcacgauuugacgguggucgcgggggacgugaagggcgugcugaccaaggggaagcgcgcccugaccccucccgugagcgaccugaaauacucauggaagaccugggggaaggccaaaaucuucacgcccgaagcccggaacagcacauuccugaucgacggccccgacaccuccgaauguccgaacgagcgccgggcuuggaacagccucgaggucgaagacuacggguucggcauguucacuacaaacauauggaugaaguuccgcgagggguccagcgaggucugcgaccaucggcugauguccgccgccauuaaggaccagaaggccguccacgccgacaugggcuacuggaucgagucguccaagaaccagaccuggcagaucgagaaagcgagccugaucgaggugaagacuugcuuauggcccaagacccacacgcuguggucaaacggcgugcuggaaagccagauguuaauccccaagucguacgccgggccguucagccaacacaacuaccggcagggcuacgccacccagaccgucgggcccuggcaccugggcaagcuugagaucgacuucggcgaaugccccggcacuaccgucacgauccaggaggacugcgaccaucggggucccagccuccgcacaaccacagccuccgggaaacuggucacgcagugguguugccgcagcugcacgaugccgccccuacgcuuccucggcgaggacgguugcugguacggcauggagauccgcccacuguccgagaaagaggagaauauggucaaaagccagguggccgcggggcagggaaccucagagaccuucagcaugggacugcucugccugacacuguucguagaggagugccuucggagacgggugacccgcaagcacaugauccuggcuguggucaucacccugugcgccaucauccucgguggccugaccuggauggaccuucuccgggcccugauaaugcugggggacacgaugagcggccgcaucggcgggcagacucaccucgcaaucauggcuguuuucaagaugucccccggcuacguccugggggucuucuuacggaagcucacgucccgugagaccgcccugauggugaucggcauggccaugacgacgacccugagcaucccgcacgaccucauggagcugaucgacggcauuucccugggccucauucugcugaagaucgucacccaguucgacaacacucaggugggcacccucgcucugucccugaccuucauccgguccacgaugagcuuggugauggccuggcggacgaucauggcggugcuuuucgucgugacccugaucccccuuugccggaccuccugccuacaaaagcagagccacugggucgagauuaccgcacugauccucggggcucaggcauugcccgucuaccugaugacguugaugaaaggagcgucccgacggagcuggccccuuaacgaggggaucauggcagugggccucgugucccuccucggguccgcccugcuuaaaaacgacgucccgcuggccggcccaaugguggccggggggcuccuccuggcggccuacgugaugagcggcuccagcgcggaccugucccuggagaaggcagccaacguucagugggacgaaauggcugacaucaccgguuccucacccaucaucgaggugaagcaggacgaggacgggucuuucuccauccgcgacgucgaggagaccaacaugaucacucugcuggucaaacucgcccugaucacggugagcggucuguacccgcucgccaucccggugaccaugacccugugguacauguggcaggucaaaacccaacgauccggcgcccugugggacguucccagcccagcggcgacgcagaaggccgcccucagcgagggcguguaccgcaucaugcagcgagggcuguucggcaagacccaggucggggugggcauccauauggagggcguguuccauaccauguggcacguuacccgcggcagcgugaucugccacgaaacaggccggcuugagcccuccugggccgacgugcgcaacgacaugaucagcuacggggggggguggcgccucggcgauaagugggacaaggaggaggauguacaagugcuggccauagagccgggcaagaacccgaagcacgugcagaccaaaccagggcuguucaagacauuaaccggagagaucggggcgguuacccuggacuucaagcccgggacguccgggagcccgaucaucaaccggaagggcaagguuauaggacuguacgggaacggcguggucaccaaguccggggacuacgucagcgccaucacccaggcggagcgcaucggcgagccggacuacgaggucgacgaggacaucuuccggaaaaaacgccucacaaucauggaucugcacccaggggccggcaagacgaaacggauccugccuuccaucguccgcgaagcgcugaagcggcgccuccggacccugauccuggcacccacccgcgugguugccgcggaaauggaggaggcgcuacggggccugcccaucagauaccagacccccgccgucaagagcgagcacaccggacgggagauuguagaccugaugugccacgccaccuucaccacccgccuccugucguccaccagagucccgaacuacaaccugauaguuauggacgaggcccacuucaccgaccccagcuccguggccgcuagaggcuacaucagcacccgggucgaaaugggggaggcggccgcgaucuucaugacugccacuccgcccggagccacagauccguucccucaguccaacagccccaucgaggacaucgagcgcgagauuccggagcgguccuggaacaccggcuucgacuggauuaccgauuaccagggaaagacggugugguucgugccgagcaucaaagcgggcaacgacaucgcgaacugucuccgcaaguccgggaagaaagucauucagcugagccgcaagacauucgacaccgaguacccgaagaccaagcugacagacugggacuuuguggucaccacggacaucucggagaugggugccaacuuccgggccgggcgcgucaucgacccgcggcgcugccugaagcccgugauccugaccgacggcccggagagagugauccuggccggacccauccccgugacgcccgccagcgccgcacagagacggggccgcaucggccgcaauccggcccaggaggacgaccaguacguguuuucaggggacccccucaagaacgacgaggaccacgcgcacuggaccgaggccaagaugcuucuggacaacaucuacacccccgagggcauuauacccacccucuucgggccggagcgcgagaaaacgcaggccaucgacggcgaguuccggcugcgcggcgagcagcggaagaccuucguggagcugaugcgccgcggggaucuucccgucuggcugagcuauaagguggcguccgccggcaucagcuacaaggaccgugaaugguguuucacuggggagcggaacaaccaaauccuggaggagaauauggaaguggagaucuggacccgcgagggugagaagaagaagcuccggccccgcuggcuugacgcucgcgucuacgccgacccuauggcccugaaggacuucaaggaguucgcauccggccgcaagucgaucacgcucgauauccugaccgagaucgcgagccugccuaccuaucucagcagccgugcaaagcuggccuuggacaacaucgugaugcuccacacaaccgaacggggcggccgugcuuaccagcacgcccuuaacgagcugcccgaaucccucgagacccugaugcugguggcguuacuaggagccaugacagcaggcaucuuccuguucuucaugcagggaaaggguauugggaaauugucaaugggccugaucaccaucgccgucgccuccggcuugcucuggguggcggaaauccagccccaauggaucgccgcuucgauuauccuggaguucuuccugaugguucucuugauccccgagccagagaagcagcggacgccccaggauaaccaacugaucuacgucauccucgccauccugacgauuaucgggcugaucgccgcgaacgagaugggccucaucgagaaaacgaagaccgacuucggguucuaccaggugaagaccgagacgaccauccuggacguggaucuucgacccgccuccgccuggacccucuacgccgucgccaccacgauccuuacuccgaugcugcggcacaccaucgaaaacaccagcgcgaaccucucccuggcggccauagcaaaccaggccgcggugcugaugggccuggggaagggauggccucuucauaggauggacuuagggguucccuugcuggccaugggauguuauagccaggucaaccccacgacacugaccgccucccucguuaugcuucugguccacuacgccaucaucggcccuggguuacaggcgaaggccacaagggaggcccaaaaacgcacggccgccggaaucaugaaaaaucccaccguggacgguaucaccguaaucgaccuggagcccaucagcuacgaccccaaguucgagaagcaauuaggccaggugaugcuccugguccugugugcgggccaacugcuucugaugcggaccacgugggcauucugcgagguacucacacucgccacugggccgauccucacccucugggaggggaaccccgggcgcuucuggaauacaaccaucgcuguguccaccgccaacaucuuccggggcagcuaccuggcaggugccgggcuugccuuuagucucaucaagaacgcccagacgccccggcggggcacggggaccaccggcgagacccugggggagaaguggaagcgccagcugaacagccucgaccggaaagaguuugaggaguacaagcgcuccggcauccuggaggucgaccggacggaggccaagagcgcgcugaaggacggcuccaagaucaaacacgcagugagccgcggguccaguaagauccgguggauuguggagcgcggcauggucaagcccaaggggaaggugguggaccucggcugcgggcgcggcggauggagcuacuauauggccaccuugaagaacgucacagaagugaaggguuacaccaagggcgggccggggcacgaagagcccaucccaauggcuaccuacggguggaaccuggugaagcuccacuccggggucgacguguucuacaagccuacggagcaggucgacacccugcugugcgacauaggcgaguccucuagcaaccccaccaucgaagaggggcggacccuucgcgucuugaagaugguggagccguggcuuuccaguaagcccgaauuuugcaucaagguccugaaucccuacaugccgacggugaucgaggagcucgagaaacuccagaggaagcacggcgggaaccugguucgcugucccuugucccgcaacagcacccacgagauguauuggguauccggcgcguccgguaacaucgugaguucugugaacacgaccagcaagaugcugcuuaacagguucacgacccggcaccgcaagcccaccuacgagaaggacgucgaccucggggccgggacccggagcguguccacggagaccgagaagcccgacaugaccaucaucgggcgccggcugcagcgccugcaggaagagcauaaggaaaccuggcauuacgaccaagagaacccguaucggacgugggccuaccacggcagcuacgaggcccccuccaccggcagcgccuccagcauggucaacgggguugugaagcuccugaccaagcccugggaugugaucccgauggucacccagcuggcgaugacggacaccacccccuuuggacagcagcgcguguucaaggagaagguggacacccggacgccccagcccaagccggggacccgcauggucaugaccaccacggccaacugguuaugggcccugcuggggaagaagaagaacccccggcucugcacccgagaggaguuuaucagcaaggugaggagcaacgccgccaucggggcuguguuccaggaggagcagggcuggaccagcgccuccgaggcggucaacgacagccgcuucugggaacugguugacaaggagcgcgcccugcaccaggagggcaagugugaauccugcguguacaacaugaugggcaagcgcgagaagaaacucggcgaauucgggcgcgcgaaggguagccgggccaucugguacauguggcugggggcccgcuuccuggaauucgaggcguugggcuuccugaaugaggaccacugguucggacgggagaacuccuggagcggcgucgagggcgaggggcugcaccgccuaggcuacauucuggaggagaucgacaagaaggacggggaccuuauguacgccgacgacaccgcgggcugggacacgaggaucaccgaggacgaccuccagaacgaggagcugauuaccgagcagauggcgccgcaccacaagauccuggccaaggcaauuuucaagcucacuuaccagaacaagguggugaagguccugcgccccacgccgcgcggcgccguuauggacaucauaucacggaaggaccagagagggagcggccaggucgggacauaugggcugaacacauucacuaacauggagguccaacucauccgccagauggaagcagaggggguuauaacccaggacgacaugcagaauccgaagggccugaaggagcggguugagaaguggcugcgcgagugcggcgucgaccgguuaaaacgcauggccaucucgggggacgacugcgucgugaagccccuggacgagcgguucgggacgagucuccuguuccugaacgacauggggaagguccggaaggacaucccucagugggagccguccaagggcuggaagaacuggcaggaggugccguucugcagccaccacuuccauaagaucuucaugaaggauggucggagucuggugguccccugccgcaaccaggacgagcucaucggcagggcccgcaucagccagggcgccggguggucccugcgcgagaccgccugucugggcaaggcguacgcccaaauguggucgcucauguauuuccacaggcgcgauuugcggcuggcgagcauggccaucugcuccgccgugcccaccgagugguucccgaccucccgcacgaccugguccauccacgcacaucaucaguggaugacuaccgaagacaugcuaaagguguggaaccggguauggaucgaggauaaccccaauaugaucgacaagacgcccgugcacuccugggaagacaucccuuaucuggggaagagggaagaccugugguguggcucccucauugggcugagcucacgagccacgugggccaagaauauccacacggcaaucacucaagugcgcaaccugaucggaaaggaggaauaugucgauuacaugccugugaugaagcgguacagcgccccuuccgagagcgagggcguccucuaa

SEQ ID NO: 26330 - RNA, 9867 nt, Artificial Sequence
  derived and/or modified CDS sequence (opt11) from DENV-4__JQ513336__SS-prME
uccacaauaacacuccuuugccucauacccacgguaauggcuuuccaccuaagcacgcgggauggcgaaccacucaugauaguugcuaaacacgaaagaggccguccccuacucuucaaaaccacagaaggaaucaacaaauguacacucaucgcgauggaccucggcgaaaugugcgaagauaccgugacuuacaaauguccacuacucgugaacacggaacccgaagacauagacugcuggugcaaccucaccucuacauggguaauguacgggacaugcacgcaaucaggugaacggagaagagaaaaacgcagcguugcucuaacaccacacagcggaaugggacuggaaacccgagcugaaaccuggaugagcuccgaaggugccuggaaacacgcccaaaggguggagagcuggauucuucguaauccgggguucgcucucuuggcgggguucauggccuacaugauaggccaaaccgguauacagagaacagucuucuuugugcuaaugaugcugguagcuccgagcuacggcaugcguugcgugggagucgggaaccgagacuucguagaagguguuucuggaggagccugggucgaccugguccuagaacacggaggcugcguuaccacgauggcgcagggaaaacccacccucgacuucgaauugacaaaaaccacggcaaaagagguagcccuauuaagaaccuauugcauagaggcuucgaucagcaacaucacaacugccacaagaugcccaacacagggggagccguaccucaaagaggagcaggaccaacaauacauauguagaagagacgugguagacaggggcugggggaacggcuguggacucuucggcaaagggggaguagugaccugcgcuaaauuuucaugcagugagaagauaacgggaaacuuaguccaaaucgaaaacuuggaauacaccguagucguaacgguacacaacggcgacacgcaugcgguggguaacgauacuagcaaccauggaguaacagcaacgauaacgcccagguccccaaguguagaaguagagcugccggauuacggcgagcuaacgcucgacugcgaaccccgauccgguauugacuuuaacgaaaugauccucaugaagaugaagaagaaaacguggcugguccacaaacagugguuccuagaucuaccgcugccaugggcggcaggcgccgacaccagugagguccacuggaacuacaaggaaaggaugguaacguuuaaggucccccacgcuaaacggcaggacgucacggugcuagguagucaggaaggcgccaugcauagcgcucuggccggagccacagaaguagauagcggggauggaaaccacauguuugccggccaucucaaaugcaagguacggauggagaagcugcgaaucaaggggaugaguuacacgauguguaguggcaaauucuccaucgacaaagaaauggccgaaacucagcacggaacgacgguagucaaaguaaaguacgaaggggcgggcgcgccgugcaagguaccgaucgagauccgcgacguaaacaaggagaaaguuguggggaggguaauaucauccauaccuuuggcagaaaacacaaacucagucacuaacaucgaacuggaaccaccauucggggacuccuauaucgucaucgggguuggaaacagcgcacuaacacuccacugguucagaaaagggagcucuaucggaaagauguucgagucaacuuauagaggagcaaagcguauggcaauacuaggagaaacagccugggacuucggaucggucggcggccucuuuacuucgcuagggaaagcggugcaccaaguuuucgggagcgucuacaccacaauguucggaggugugagcuggaugguccgaauacucauaggccuguugguacuauggauuggaaccaacucgcguaauacuagcauggcaaugaccugcaucgcgguaggaggaaucacccuauuccuagguuuuacuguucaggcggauauggggugcguaguaaguuggagcggacgggagcuuaagugcgggaguggcauuuuuguaguagauaacguucacacguggacugagcaguacaaauuucaaccagaauccccagcgagacucgccagcgccauccucaaugcgcacaaggacggaguaugcgguauccggaguacaacuagacuugagaacguuauguggaaacagaucacuaacgaacugaacuacguacuaugggaagggggucacgaccugaccgucguugcuggcgacgucaaaggggugcuaaccaaaggaaaacgcgcgcucacgcccccggugucggacuuaaaauauuccuggaagacauggggaaaagcgaaaauauuuaccccugaggcaagaaacuccaccuuccuuaucgacggcccagacaccagugaaugcccaaacgaacgccgugcguggaacagccuggaaguggaggauuacggguucgggauguuuacuacaaauaucuggaugaaauuccgcgagggaucuuccgaaguaugcgaccacagguuaaugagcgcggcaaucaaagaccagaaggcagugcacgcagacaugggcuauuggauugaauccuccaaaaaccaaacguggcaaaucgaaaaagcgaguuuaauagaaguaaagacaugucuauggccgaaaacccacacauuauggucaaacggagugcuggaaagccagaugcuaauacccaaaagcuaugcgggcccauucagccagcauaacuaucgacaaggguaugccacucaaaccgucggaccauggcaccugggcaagcuagaaauugauuucggcgaaugcccagggaccacugucacgauacaagaggacugcgaucaccgaggucccucacuacgcacgacaaccgcgucuggcaaacuugucacgcaguggugcugcaggucuugcacaaugccaccccugagguucuuaggagaggaugguuguugguauggcauggagauuagaccauuaagcgaaaaggaggagaauaugguaaagucacaaguagcggcgggccaagggacaucagagaccuuuucaaugggacuacuaugccuuacgcuuuuuguggaagagugucugcgacgcagagucacacgcaaacacaugauacucgccgucgucaucacccuaugugcaauaauccuagguggguuaacuuggauggacuuacuacgcgcgcuaaucaugcuuggugacacaaugaguggccgcauagggggccagacacaccucgcgauaauggcggucuucaaaaugagucccggcuacguacucggggucuucuuaagaaagcuaaccucaagagagacggccuugauggucaucggcauggcaaugaccacgacacuuucgauaccccaugaccuaauggaguuaauagacggaaucucucucgggcuaauccuacuaaaaauagugacccaauucgacaauacccaagugggaacacuagcacugucacuuacguucauacgauccacuaugucacugguaauggcauggaggacaauuauggccguauuauucguaguuacgcugaucccgcuauguagaacuucaugcuuacaaaagcagucccacugggucgaaaucacagcccugauccuaggugcacaagcgcuaccaguauaccuaaugacccuaaugaagggcgcgucccgacguaguuggccacuuaacgagggaauaauggcggucgggcuggugagcuugcuggggagcgcacuacuaaagaacgacgugccgcucgcgggccccaugguggccggcggacugcuacuugccgcguauguaaugucaggguccucggcagaccucucccucgagaaagcggccaacguacagugggacgaaauggcagacauaaccgguucgucgccaauaauagaagugaagcaggacgaagacggaucguucucuauacgagacguagaagagacgaauaugauaacccuacucgugaaauuggcguugauaaccgugagcggccuauacccguuggcgauaccgguaacgaugacacuaugguauauguggcaagucaagacccagagaucaggagcccuaugggacguaccaucaccagcugcgacgcagaaagcggcacuaucagaaggcgucuacagaaucaugcagcgcggccuauuuggaaaaacucaaguggggguaggcauacauauggaagguguguuccauaccauguggcacguaaccagaggcagcgugauaugccacgagaccggacggcucgagccgagcugggccgaugugagaaacgacaugaucaguuacggcggaggauggcgcuugggagacaaaugggauaaggaagaagacguccaagugcuagcgauagaaccaggcaaaaacccgaaacacgugcagaccaaaccgggccuuuucaaaacccuuaccggagagauuggggcaguaaccuuagacuucaaaccgggaaccucagguuccccaaucaucaaccgaaaaggcaaggucaucggucuguacggaaacgggguggugacgaagucuggagacuacgucagcgcaaucacacaagcggaacguauaggggagccagacuacgagguugacgaagauaucuucaggaagaaaagacuuacgauaauggaccuccauccgggcgcagggaagacaaagagaauauuaccuaguaucgucagagaagcauuaaaaaggcgacugcggacacugauacucgcgcccacacgugucguggcugcagagauggaagaagcacuccgaggucucccaauacgguaccaaaccccggcgguaaaaagcgaacacaccggcagagaaauagucgaccugaugugucaugcgaccuucaccacacggcucuugucuuccacaaggguaccaaacuacaaccugauagucauggacgaagcccacuuuacggaccccaguucaguggcggcaagaggauacauaucgacucgcguagaaaugggagaggcagcggcaauauucaugaccgcaacuccaccgggcgcuacggaccccuucccccaaagcaauucaccaauagaagacaucgaacgagaaauccccgagcgaagcuggaacaccggauucgauuggauuaccgacuaccaggggaaaacaguuugguucgucccaagcaucaaagcaggaaacgacauagccaacuguuugcggaaaucgggaaagaaggugauacagcuaucacgcaaaacuuucgauacugaguauccgaaaaccaaacugaccgacugggacuucgucgugacaacagauaucagcgaaaugggugcgaauuuccgcgccggaagggugauagacccgaggcgauguuuaaagccgguaauacuaaccgauggcccggaacggguuauucuagcaggcccaauaccuguaacgccagcguccgcggcacagagaagaggccggauuggccguaacccagcacaggaggacgaccaguaugucuuuagcggcgacccgcugaaaaacgaugaggaucacgcgcacuggacugaagcaaaaaugcuccuggacaacauauacacgcccgagggcauaauccccacauuauucggacccgaacgugagaagacgcaagcgaucgacggcgaguuccgacuacgcggagagcagagaaaaaccuucgucgaacucaugcgccgaggagaccuuccaguguggcugaguuacaaagucgcuuccgccggcauaagcuacaaagaucgcgagugguguuucacaggcgagagaaacaaucaaauacucgaagagaacauggaaguagagaucuggaccagagaaggagagaagaagaaacuaagaccccgaugguuagacgcaaggguauacgcugacccaauggcccugaaggacuucaaagaguuugcaucagggagaaagucgauaacacuagacauauugacggagauagccucacucccgacauacuuaucaucacgagcaaaacuagcgcuggacaacaucguuauguuacacacaacugagagaggcgggcgggcauaccagcacgcgcucaaugagcucccagaaucccuagaaacccuaaugcugguagcacuucugggggcgaugacagcgggcaucuuucuauucuuuaugcaaggaaagggaauagguaaacucaguauggggcucaucacuauagcgguggccagcggacuacuuugggucgcugaaauucaaccgcaauggauagcggcgaguauaauauuagaguucuuccucaugguacuauugauacccgaacccgagaaacaacgaacaccacaggacaaccagcuaaucuaugugauccuggcaauacuuacuaucaucggauuaauagcagcaaacgagaugggcuuaauagaaaagacuaaaaccgacuuugguuucuaccaggugaagaccgaaaccacaauacucgauguagaccuacguccggcaucggcauggacccuguacgccguagccacgacuauccugacucccaugcugcgucacaccauagaaaacacaagcgcgaacuuaucccuugcagccaucgccaaucaggcugcaguccuaaugggucuugggaaaggguggccguuacaccggauggacuuaggagugccauuacucgcaaugggauguuacucacaagugaauccaacaaccuuaaccgcaagucuugucauguuacuuguacauuaugcaauaauaggccccggauuacaagcaaaggcaaccagagaagcucaaaagcgcacagccgccggcauaaugaagaaccccacaguagacgguaucacagucauugaccuagagccgauuucguaugacccaaaguucgagaagcaacuaggacagguuaugcuacugguucugugcgcgggacagcuccuguuaaugagaacgacgugggcuuucugcgagguacugacauuggccacugggccgauacugacgcuaugggaggggaaucccggacgcuucuggaacacaacaauagcaguaucgaccgcaaacauauucagggggaguuaccuagcaggagccgggcucgcuuucagccucaucaaaaaugcgcaaaccccaagacggggaacuggaaccacgggagaaacacugggggaaaaauggaagcgacaacucaacagucuagaccggaaggaauuugaagaauacaaaaggucgggcauacucgagguagaccgcacggaggcgaaguccgcccugaaagacggauccaagaucaaacacgccguaucccgaggauccaguaagauccgcuggauaguagaacgagggauggugaagcccaaaggaaaagugguggaucuaggcugcggucguggaggauggucauacuacauggcaacacucaagaacguaaccgaagugaaaggguacacaaaagguggaccaggacacgaagaaccaauaccgauggcgacauacggauggaaccucguaaaacuacacucagggguagauguguuuuauaaacccacugaacaaguugacacucugcugugcgauaucggcgaguccagcagcaauccgacgauagaggaagguaggacacuaaggguacuaaaaaugguagaaccguggcucaguucaaagccggaauuuuguauaaagguucucaacccguacaugccgaccguaauagaagaacucgaaaagcuccaaagaaaacauggcgggaaccuagugcguugcccccucucgcgaaacucuacacacgaaauguauugggucaguggcgccagcggaaacauagucagcuccguaaacacgacaucaaagaugcuccugaaccgguucaccacgaggcauaggaaaccuacauacgagaaagauguagaccucggugcagggacccggucagugagcacagaaacggaaaagccggacaugacaauaauaggucggcgacugcaacgacuccaagaagaacacaaggaaaccuggcacuaugaucaggagaaccccuacagaacaugggcuuaccacggcucauacgaggcaccaagcaccggaagcgcaucguccauggucaacggaguaguaaaacuccuaaccaaaccuugggacguaauaccuauggugacacagcuagcaaugaccgauacuacaccguucgggcaacaacgcgucuucaaggaaaaaguugacacacgcaccccacaaccgaagccgggaaccaggauggugaugacgaccacggcaaacuggcucugggcauuacuggggaagaagaaaaacccgagguuaugcacacgcgaggaauuuauuagcaaagugagguccaaugcggcaauuggagcggucuuccaagaagaacagggauggacgagugcuucagaggcaguaaacgauucccgauuuugggagcugguagacaaagagcgcgcgcuacaccaggagggcaaaugcgaaagcuguguauacaacaugaugggcaaaagagagaagaaacucggugaguuugggcgggccaaagggagccgcgcuauaugguauauguggcuaggcgcacgcuucuuagaguucgaggcgcuaggguucuuaaaugaagaccacugguucggccgcgagaacaguuggagcgggguggaaggcgagggucugcaccgucuaggcuacauauuggaagagauagacaagaaagacggagaccucauguaugcggacgacacugccggaugggacacccgcauuacggaagacgaccuccaaaacgaagaacugauaaccgaacaaauggcaccacaccauaaaauccuagccaaagcaauuuucaaauuaacauaccagaacaaaguugucaaggugcugagaccgacaccccggggagccguaauggauauaaucagucgaaaagaccaacgcggcucggggcagguagguaccuacggguugaacaccuuuacgaauauggagguccagcugauccgccaaauggaagccgaagggguaauaacacaggaugacaugcaaaacccaaaaggacucaaggagcgagucgaaaaguggcuucgagaaugcggaguggacagacugaagcggauggcgauuagcggagacgacugcguagugaaaccacucgaugaaagguucggaaccucccuccuauuucugaaugacaugggcaagguuaggaaagauaucccgcagugggaaccaucaaaaggguggaaaaacuggcaagaaguaccguucuguucccaccauuuccauaaaaucuuuaugaaagauggccgcucgcucgucguaccaugcaggaaucaagacgaguuaaucgggagagccaggaucagccaaggcgcaggguggagccugagggagacggccugccuggggaaggcuuacgcgcaaauguggagucuaauguauuuccauagaagagaccugcgacuagcaagcauggcuauauguucggcugucccgaccgaaugguucccaaccucgagaaccaccugguccauacacgcgcaccaccaauggaugaccaccgaggauaugcucaagguauggaaccgagucuggauugaagacaacccuaauaugauugacaagacacccgugcacucaugggaggacaucccauaccucgggaagagagaggaucuauggugcgggucauuaaucggcuuaagcagccgagcgacaugggcaaagaacauacacacagcaauaacgcaaguucgaaaucuuaucggcaaagaagaauacgucgacuacaugccggucaugaaacguuacucggcuccauccgaauccgaaggaguccuauaa

SEQ ID NO: 26331 - RNA, 9867 nt, Artificial Sequence
  derived and/or modified CDS sequence (opt11) from DENV-4__JQ513338__SS-prME
agcacgauuacccugcucugccugauccccacggugauggcguuccaccuguccacacgggauggcgagccccucaugauaguggccaagcacgagcgggggcgaccccugcuuuucaagacuaccgagggcaucaacaagugcacgcuaaucgcgauggaccugggggagaugugcgaggauaccgugaccuacaaguguccccugcucgugaacaccgagccugaggacaucgacuguuggugcaaccugacguccaccuggguaauguacgggacaugcacccagaguggggagcggcgcagagagaagcgaagcguggccuugacgccccacagcggaaugggccucgagacgcgggccgagaccuggauguccuccgaaggcgcauggaagcacgcccagcgcguggagaguuggauucuccgaaaccccggcuucgcacugcucgccggguucauggcguacaugaucggccagacagguauccaacggaccguauucuucgugcugaugaugcugguggcacccuccuacggcaugcggugcgucggcguggguaaccgcgacuucguggagggggucagcgggggcgcguggguggaccucgugcuggagcacggcgggugugugacgaccauggcccagggcaagcccacccuggacuucgagcuaacuaagaccaccgcgaaggagguggcccugcugcguaccuacugcaucgaggccuuaaucuccaacaucacgaccgcuacccguugcccaacacagggggagcccuaccuaaaggaggagcaagagcagcaguacaucugccggcgcgacgugguugaccguggcugggggaacggcuguggccuguucgggaagggcgggguugugaccugcgccaaguucucaugcuccggcaagauaaccggaaaccucguccaaauugagaaccuggaguacaccgugguggucaccguacacaacggcaacacgcccgcagucggcaacgacaccucgaaucacggggugacagcccccaucacgccgcgcucccccagcguggaggucaagcugcccgacuacggcgaacucacuuuggacugcgaaccccggagcgggaucgacuucaacgagaugauccucaugaagaugaaaaagaagacuuggcucgugcacaagcaaugguuccuggaccugccgcuacccuggaccaccggugccgacaccagcgaggugcacuggaauuacaaggagagaaugguaacguucaagguaccccaugcgaagcggcaagacguuaccgugcuggguagccaggagggcgccaugcacagcgcucuggccggcgccacugaaguggacagcggagacgagaaccacauguuugcgggccaccucaagugcaaggugcgcauggggaagcugcgcaucaaggguauguccuacaccauguguagcggcaaguucucuaucgacaaggagauggccgagacccagcaugggaccaccgucguaaagguaaaguaugagggggccggggcaccaugcaaggucccgauugaaauacgggaugugaauaaggaaaagguggucggccgcgucaucucggcaacuccccuggcagagaacacgaacuccguaacuaacauugagcucgagccgcccuucggagaccgcuauaucgucaucggcguuggcaauagcgcccugacccugcauugguuccgcaaaggauccagcaucggcaagauguucgaguccaccuaccgcggcgccaagcgcauggccauccucggcgagaccgcgugggacuuugggagcguggguggccucuucacuucucuggggaaggccguccaccaaguguucgguucuguauacacaaccauguucggcggcgugucguggaugauccggauccuuaucggguuccuggugcuguggaucggcacaaacucacgcaacaccuccauggccaugaccugcaucgccguaggugggauaacccuguuccucggcuucacgguccaggccgacaugggcugcguggugagcugguccggucgggagcugaagugugggagcggcaucuucguaguagacaauguucacaccuggacagagcaguacaaguuccagccggagagucccgcaagacuggccagugccauccucaacgcccacaaagacggcgucugcggaauccggagcaccacgcgccuggagaacgugauguggaagcagauuaccaacgagcugaacuacgugcucugggagggcggacaugaccuuaccgucguggccggugacgugaaaggcgugcugaccaagggaaagcgggcgcugaccccgcccgccuccgaucuaaaguacagcuggaagaccuggggcaaagcuaaaaucuucacaccggaggcccggaauuccaccuucuuaaucgacgguccugacacgagcgagugcccuaaugaacgccgcgccuggaacagcuucgagguggaagauuauggcuucggaauguuuaccaccaacaucuggaugaaguuccgagagggcagcuccgagguuugcgaucaccgccucaugagcgcagccaucaaggaccaaaaggcuguacacgcggauaugggcuauuggaucgagaguaguaagaaccagacguggcagaucgagcgggcuucccucaucgaggugaagacguguuuguggccuaagacacacacccucuggagcaacggggugcuggagagccagaugcugaucccgaagagcuacgccggacccuuuucccaacacaacuaccgccaaggguaugccacccagacagucggccccuggcaccucggaaagcuggagaucgauuucggcgagugcccgggcacaaccgugaccauccaggagaauugugaucaccgcgggcccagccugcggaccacgaccgcguccggcaaacucgugacccaauggugcugucgcuccugcaccaugccgccacugcgguuccugggggaggacggcugcugguacgggauggagauccgcccacucucggagaaagaggagaacauggucaagucucaagugacggccggccagggcaccucugagacauuuuccaugggccugcugugcuugacccuguucgucgaggaaugccuacgacgccgggugacgcgaaagcacaugauccucgcuguugucauuacccugugugccaucauucuaggagggcucacauggauggaccugcugcgggcucucaucaugcugggcgauacgaugagcggccgcauagguggccagacgcaccuggccaucauggccguauucaagaugucccccggguacgugcuaggcgucuuccugagaaagcugacuagccgugagacugcgcucaugguaaucgggauggccaugaccaccacacuguccaucccccacgaccugauggaacucauagacggcauaagccugggccucauccuccugaagaucgugacccaguucgauaacacccaaguaggcacacuggcccucucccugacauucauucgcagcaccauguccuuagugauggccuggcgaacaauaauggcuguucuuuucguggugacgcuaauaccgcuuugccggacaagcugccuccagaaacagucgcacuggguagagaucaccgcacugauacucggcgcccaggcccucccaguuuaccugaugacucugaugaagggugccucucgccgguccuggccucucaacgagggcauuauggccguggguuuagugucgcugcugggguccgcccugcuuaagaaugacguuccucucgccggcccaaugguggccgggggcuuacuucucgccgcauacgugaugagcggaucuagcgccgacuugagccuggagaaggccgcgaacguccagugggacgagauggccgacaucacgggcuccucaccgaucaucgaggugaagcaggacgaagauggaucguucagcauccgcgauguggaagagaccaacaugaucacacucuuaguaaaacuggcccucaucaccgugagugggcuguacccacuugccauccccaucacaaugacacucugguacauguggcaagucaagacccagcggagcggcgcccugugggacguacccuccccggccgcgacccagaaggcggcccugucagagggcguguaccgcaucaugcagaggggcuuauucgggaagacacaggugggagucgggauccauauggagggcguguuccacacgauguggcacguuaccaggggcagcgugaucugccacgagaccggccgccuggagcccucgugggccgacgugcggaacgacaugauuucuuacggaggggguuggcgccugggcgacaagugggacaaggaggaggacgugcaaguuuuggccaucgaaccagggaagaacccuaaacacgugcagaccaagccaggccucuucaagacgcugaccggggagauaggcgccgugacgcucgacuucaagccuggcaccagcgguucccccauaaucaacaggaagggcaaggucaucgggcuguacggcaacgggguggucaccaagagcggcgacuacgucuccgcgaucacccaggccgagcgcaucggugaaccggacuacgagguggacgaagacaucuuccggaagaagcgucugaccauaauggaccuucaccccggcgccggcaagacuaagcggauacugcccagcaucgugcgcgaagcccugaagcggcgccugcggacgcucaucuuggcgccuacccgggucguggccgcugagauggaggaggcucugcgggggcuucccauccgcuaccaaacccccgcugugaagucugagcauaccggccgggagaucguugaucugaugugccacgcgacguucacuacccgccuguugagcuccacgcgggugcccaauuacaaccugauugucauggacgaggcccacuuuaccgaccccagcagcgucgccgcccgcggguauaucuccacucggguggagaugggcgaagcagcggccaucuucaugaccgccaccccgccgggugccacggaccccuucccccagagcaauaguccuaucgaagacaucgagcgcgagauacccgagcgcucauggaacacuggcuuugacuggaucaccgacuaccagggcaagaccgucugguucgugccaucaaucaaggccgggaacgacauagcgaacugccugagaaagagcggcaaaaagguaauucagcucucccgcaagacuuucgauacggaguaccccaagaccaagcugaccgacugggacuuuguggugacgaccgacaucagugagaugggcgcgaacuuccgggccgggcgcguuaucgacccgcggaggugccugaagccggucauccuaaccgacgggccagagcggguuaucuuagccggcccaauuccggugacccccgcuuccgccgcccagcgccggggccgcaucggucggaacccggcacaggaggacgaucaguaugucuucagcggggacccccugaagaacgaugaagaccacgcacacuggacggaggcgaagaugcucuuagacaacaucuauaccccugaagggaucauacccacccuuuucggucccgagcgcgagaaaacccaggcaaucgauggagaguuccgacuccgcggggagcagaggaagacguucguagagcugaugcgccggggggaccugcccguauggcucuccuacaagguagcaucugccgggaucuccuacaaggaucgugaguggugcuucaccggugagcguaacaaucaaauccuggaggaaaacauggaaguggaaaucuggacccgcgagggcgagaagaagaaacuccggccuaagugguuggacgcccgcguguacgcggacccuauggcccugaaggacuuuaaggaauucgcuagcggccgcaaguccauaacccuagacauccucaccgagaucgccagccugccaacuuaucugucgucgcgcgcgaagcucgcacuugacaacauagucaugcugcauaccaccgagcgcggagggcgagccuaccagcacgcccucaacgaacugcccgagagccuggaaacccucaugcugguggcccugcucggcgcgaugacggccgggauuuuccucuucuucaugcagggcaaaggaaucggaaagcugagcaugggcuuaaucaccauagccguggcuagcgggcugcuuugggucgcggagauccagccccaguggaucgcggccuccaucauauuggaauucuuccugauggugcugcuaaucccugaaccggagaagcagcguaccccgcaggacaaccaguuaaucuacgugauccuuaccauccucacgauuaucggccuuauagccgcgaaugagauggggcugauugagaagaccaagaccgacuucggcuucuaccaggucaagaccgagacaaccaucuuggacguggaccugaggcccgccagcgccuggaccuuauacgcgguggccacgacaauccucacccccaugcugcgccacacgaucgagaacaccuccgcuaaccugagucucgccgcgauugccaaccaggccgccguccugaugggacucgggaagggcuggccccuucaccggauggaccuggggguuccgcugcucgccaugggcugcuacucccaggugaaucccacgacccugaccgccagccugguuauguugcuugugcacuacgccaucauagggcccggccugcaagccaaggcuacccgcgaggcgcagaagcggacggccgccggcauaaugaagaacccaacuguugauggcaucaccguaauagaccucgagccgaucuccuacgauccuaaguuugaaaagcaacuggggcaagugaugcugcucguuuuaugcgccggucagcugcuccugaugcgcacuacgugggccuucugcgaggugcugaccuuggcgaccggccccauccuaacccuuugggaggguaaccccggccgguucuggaauacgaccauugcugugagcacagcgaauaucuucaggggauccuaccucgccggggccggccuggcguucagccucauaaagaacgcucagaccccacggcgcgggacggguaccaccggagagaccuuaggagagaaguggaagcggcaauugaacucccucgaccgcaaagaguucgaggaguacaaacguagcggcauccucgaaguggaccgcaccgaggccaaauccgcccugaaagaugggucuaagaucaagcaugccgucuccagaggcucauccaagaucagauggaucguggagcgcgguauggugaagcccaagggcaaggucaucgaccuugggugcggcagaggcgguuggagcuacuacauggcgacucucaagaacgugacggaggugaaaggauauacaaagggcggccccgggcacgaggagcccauuccgauggccaccuacggauggaaccugguaaagcugcacuccggcguggacgucuucuacaagcccacggagcaggucgauacccuccugugcgacaucggggagaguagcaguaaccccaccauagaggagggccgcacgcuccgggugcugaagaugguggagcccuggcugagcucaaagccugaguuuugcauuaagguccugaaccccuacaugccaacggugauagaggagcuggagaaacuccaacgcaagcaugguggcaaccugguccgguguccccugucccguaacucgacucacgagauguacugggucagcggcgcgagugggaacaucgucagcuccgucaacaccaccagcaagauguuacuaaaccgcuucacgacccgccaccggaagcccacguacgaaaaagacguggaucugggcgcggggacccgcuccgugagcacggagaccgagaagccugauaugaccauaauuggccgccgccuccagcgccuccaggaggagcacaaggagaccuggcacuacgaccaagaaaaccccuaucgcacgugggcuuaccacggguccuacgaggccccgagcaccggcuccgccagcuccauggucaacggcguugugaaauuacucacgaagcccugggacguuauccccauggugacgcagcuggccaugacagacaccaccccauucgggcagcaacguguuuucaaggagaaagucgauacccggacaccgcaaccaaagcccggcacgaggauggugaugaccacgacggccaacuggcucugggcuuugcuagggaagaagaagaacccgcgccugugcacccgggaggaauucaucagcaaagugcgcuccaacgcggccauuggcgcugucuuccaggaggagcaggguuggacuagcgccagcgaggcuguuaacgauucacgguuuugggagcucguagacaaggagcgcgcccugcaccaggagggaaagugcgagaguugugucuacaacaugaugggcaagcgcgagaagaagcugggggaguucggccgggcaaagggauccagggcaaucugguacauguggcucggugcgcgguuccuggaguucgaggcgcugggguuucucaacgaggaccacugguuuggccgcgaaaacagcugguccggcguggagggggagggccugcaccgucugggguacauucucgaagagaucgacaaaaaggacggcgaccugauguacgcggacgacacagccggcugggacacgcgcaucacagaggacgaccugcaaaacgaggagcucaucaccgagcagauggccccgcaccacaagauccuagcgaaggccaucuucaagcugaccuaccagaauaagguggucaaggugcuccggccuacaccccgcggggccguaauggauaucaucagccggaaggaccagcgcgguuccgggcaggucggcacguacggguuaaacaccuucaccaacauggagguccaguugauccggcagauggaggccgagggcgugaucacccaggacgacaugcagaacccgaagggccucaaggagcgcguggaaaaguggcugagggagugcgggguggaccgccuaaaacggauggccaucagcggcgacgacuguguggucaagccgcucgaugagagauucgggacgucccuguuauucuuaaaugacaugggcaaggugcggaaggacaucccucagugggagcccucgaagggguggaagaacuggcaggaggugcccuuuuguagccaccacuuucacaagaucuucaugaaggacggccgcagccuggucgugccgugccggaaccaggacgagcugaucggucgggcccgcauaucccagggggccggguggagcuugcgggagaccgccugccugggaaaggcuuacgcccagauguggucccugauguacuuccaucgccgugaccucagacuggccagcauggccauuugcuccgccgugcccaccgagugguuucccaccagccggaccacuuggagcauacaugcccaccaccaguggaugacaacggaggacaugcuaaaagucuggaaccgcgucuggaucgaggacaaccccaacaugauagauaagacgcccguucacuccugggaggacauccccuaccucggcaagcgggaggaccuaugguguggaagccugauaggccuuuccagccgcgccaccugggcgaagaacauacauacagcaaucacccagguccggaaccugaucggcaaagaagaguacguggauuacaugcccgugaugaagcgcuauuccgcccccagcgaguccgaaggggugcuguag

SEQ ID NO: 26332 - RNA, 9867 nt, Artificial Sequence
  derived and/or modified CDS sequence (opt11) from DENV-4__JQ513339__SS-prME
ucaaccaucacucugcuuugucugauccccacggucauggccuuucaccuguccacccgggauggcgaaccgcucaugaucgucgccaagcacgagcgggggcgaccccugcuguucaagacaacagaaggaauaaacaaaugcacgcucaucgcaauggaccugggggaaaugugcgaggacaccgugacuuacaagugcccuuuauuggugaauaccgagcccgaggacaucgacugcugguguaaccuaaccagcaccugggucauguacggcaccugcacccagucuggggagcgucgccgugagaagcgaaguguugcccugaccccgcacuccgguaugggucucgaaacccgggccgaaacauggaugagcagcgagggggccuggaagcacgcccaacgcguagagagcuggauccuacggaaccccggguuugcgcugcucgcgggguucauggccuacaugaucggccaaaccgggauccagcgcacggucuucuucgugcuaaugaugcuaguggcccccucguacggcaugaggugcguagguguggggaaccgcgacuucguggagggcguaagcggcggcgcguggguggaccucgugcuggagcauggcggcugugucaccacgauggcccagggcaagcccacccuggacuuugagcucacgaagaccaccgccaaggagguagcucugcugcggaccuacuguauugaagcccucaucuccaacaucaccaccgccaccagaugcccaacccagggugagccguaccuaaaggaagagcaggaccagcaguacaucugucggcgcgaugucgucgaucgaggcugggggaacggcugcggguuguucgggaaaggggguguugucacgugcgccaaauucaguugcucgggaaagauaaccgggaaccucguccagaucgaaaaccuggaauacacaguaguugucacagugcauaacggcgauacacaugcugucggaaacgacaccuccaaccacggcguuacugcuaccaucacgccccgcuccccaagcguggaggucaaacugccggacuauggcgaacucacucuggacugcgagccucggucugggauagacuucaaugagaugauacugaugaagaugaagaagaagacguggcucguccacaagcagugguuccuagaccuuccucugccuuggaccaccggggccgacacgagcgaggugcauuggaacuacaaggagcggauggcgacuuucaaaguuccgcacgcaaaaaggcaggacguuacccugcuugguucccaagaaggagccaugcauagcgcccucgccggugcgaccgagguggauagcggggacgagaaccacauguucgcagggcaucugaaaugcaagguccgcaugggaaagcugcgcaucaaaggcaugucuuacacaaugugcagcgguaaguuuucaauagacaaggagauggcggaaacccagcacgggaccaccguggugaaggucaaguaugagggcgcaggcgcccccugcaaagugcccaucgagauccgggacguuaacaaggagaaggucgugggccgcguuuugagcgcgacgccccuggcagagaauaccaacucuguaaccaacaucgagcuggagccaccguucggugacagcuacaucgugaucggggugggaaacuccgcucucacgcugcauugguucacuaaggguucaagcaucggcaagauguuugaaucgaccuacaggggggccaagcgcauggcgauccugggcgagaccgcaugggacuucgggucggucggcggccuauucaccagccugggcaaagccguccaccagguguucggcuccguauacacgaccauguucgggggcgugagcuggaugauccgaauccugaucggguuucucgugcucuggauagggacgaacucccguaacacuagcauggcuaugacguguauagcaguaggcggcauuacccuguuccuaggguucacaguucaggcagauauggggugcguggucuccuggagcggccgggagcucaagugcggguccggcaucuucgucguggauaacguccacaccuggacggaacaguacaaauuucagcccgagagcccggcccgccuggccagcgccauacugaacgcacacaaggauggcgugugcgggauucgguccaccacccgccucgagaacgugauguggaagcaaaucacaaacgaguuaaacuacguucugugggaggguggccacgaccucaccguuguggcaggcgacgucaagggcgugcuaacaaaggggaaacgggcccugaccccgccggccucagaccuaaaguacuccuggaaaaccuggggaaaagccaaaaucuuuacgcccgaggcccgcaacagcacauuccuaauugacgggccggacaccuccgaaugcccgaacgaacgucgcgcuuggaauagcuucgagguggaggacuacggcuucgggauguucaccacgaacaucuggaugaaauuuagggaggguuccagcgaggucugcgaccaccgccugaugucugccgccaucaaagaccaaaaggccgugcacgcggauauggguuacuggaucgaaagcucaaagaaccagaccuggcagaucgagcgggccucacucaucgaggucaagaccugcuuguggcccaagacccacacccuuugguccaauggugucuuggaaucacaaaugcugaucccgaaguccuacgcaggcccguucucacagcacaacuaucgccagggguacgccacgcagaccgugggcccuuggcaucuuggcaaacuugagauagacuuuggagagugccccggcacaaccguaaccauacaggagaauugugaccacaggggccccucccugcgaacgacgacggcgucuggcaagcuggucacgcagugguguugccgcagcugcaccaugccgccccuccgguuucucggggaggacggcugcugguacgggauggagaucagaccccugucagagaaggaggaaaauauggucaaaucccaagugaccgcuggccaaggcacgucagagacguuuagcauggggcuccugugccugacccucuucguagaagagugcuugcggcgccgggucacccgaaagcauaugauucuggcuguggugauuacccuaugcgccauaauucuaggcggacucacguggauggaccuccuucgggcacuaaucauguuaggugacacgaugucuggccgcaucgggggccagacccaccuggccauuauggccgucuuuaagaugagcccgggguacguucugggcguauucuuacgcaagcuaacaucccgcgaaacggcccugauggugauagggauggcuaugaccaccacucugagcaucccucacgaucugauggaguugauagacggcaucucccuggggcuaauccugcuuaagaucguaacgcaguucgacaacacccagguugggacccuggcccugagucucacguuuauccggucuacaaugagcuuagugauggccuggcgaaccaucauggccguacuguucguggugacccucauuccccuuugccgaacauccugccugcagaagcagucacacugggucgagauaacggcccucauccugggcgcacaggcccugcccguguaccucaugacccugaugaaaggggcuucccgcaggagcuggccacuaaacgaggguauaauggccguggggcucgucucucugcuuggcucggcccucuugaagaacgacgugccgcuagccggccccaugguggcagggggccuccugcuggcggccuacgucauguccgggagcagcgccgauuuguccuuagagaaggccgccaacguacaaugggacgaaauggcggauaucaccgguagcucgcccauuaucgagguuaagcaagacgaggacgggagcuucucaauucgugacgucgaggagacaaacaugauuacacuacucgugaagcuggcgcugaucaccguauccggucucuacccccuggccaucccgaucacgaugacccuaugguacauguggcaggucaagacucagcgguccggagcccucugggacguccccagccccgccgcgacgcagaaggccgcccuaucagaggggguuuaccgcauaaugcaacggggccuguuugggaagacccagguggguguggggauccacauggagggggucuuccacacgauguggcacgucacccgcggcucggugaucugucacgaaacgggccggcucgagccuuccugggcagaugugcgcaaugacaugauaagcuacggcgggggguggcgccuaggagacaagugggauaaggaggaagacguccaggugcuagccaucgagccugggaagaaucccaagcacgugcagaccaaaccaggcuuguucaagacucugaccggggaaaucggcgcgguuacgcuggacuuuaagccagggaccucuggcagcccgaucauuaaccggaagggcaaggugaucgggcucuacggcaacgggguggucaccaagucuggcgacuacgugucggcaauuacgcaggcugagcggauaggugagccggacuacgagguggaugaggacaucuuucggaagaagagacuuacaaucauggaccugcaccccggcgccggcaagacgaagcggauccuaccguccaucguucgcgaagcucugaagcggcgcuugagaacgcugauccucgcccccacccgcguaguggcugcagaaauggaagaggccuugcgugggcugcccauccgcuaccagacccccgcggucaaaagcgagcauacaggccgggagauuguggaccucaugugccacgccaccuucaccacccgccuguuauccuccacacgggugccgaacuacaaucucaucgucauggacgaggcccauuuuacggaccccagcucuguggccgcccgcggguauaucucaacucggguggagaugggagaggcggccgccauauucaugacggccacaccuccgggggccaccgacccguucccccagucaaacagccccauagaggacaucgagcgcgagauucccgagaggucauggaauacgggcuucgacuggaucacggacuaccagggaaagaccgucugguucgugccgagcauaaaggcugggaacgacaucgccaacugccugcgcaaauccggcaaaaaggucauccagcugagcagaaagaccuucgacaccgaguaccccaaaacuaaacucaccgacugggauuuugucguuacuacugacaucucugagaugggggccaacuuccgggccggccgcgugaucgacccccgucggugccugaagcccguaauccugacggacgggcccgagcgggucauacuggcgggcccaaucccugucacccccgccagcgccgcgcagaggagaggccgcauagggagaaauccggcucaagaggacgaccaguacguguuuuccggagacccccugaagaaugacgaggaucacgcacauuggaccgaggcgaaaaugcugcucgacaacauuuacacccccgaggggaucaucccgacguuguucggaccugagcgcgagaagacacaggccauugacggggaguuccggcuucgcggggaacagagaaaaacguucgucgaacucaugcgcaggggcgaccugccuguauggcugagcuacaagguggccagcgccggaaucucauacaaagaccgcgaaugguguuucacuggcgagcguaacaaccagauucucgaggaaaacauggaaguugaaauauggacuagggagggggagaagaagaagcugcgacccaaguggcuagacgcgcgcguguacgcugaccccauggccuugaaagacuucaaagaguucgcguccggccggaaaagcaucacacuugauaucuugacugagaucgccagucucccaaccuaucugaguucccgggcaaaacucgcccuagacaacaucgugaugcugcauaccacggagaggggggggcgggccuaccagcacgcccucaacgagcuccccgagagccuggagacgcugaugcuaguggcucuacugggcgccaugacagccggaaucuucuuauucuucaugcaggguaaaggaaucggcaagcugagcaugggucugaucaccaucgccguugccucggggcuccuguggguggcugagauccagccccaauggaucgccgccucuauuauucuggaguucuuucucauggugcugcugaucccugagcccgaaaagcagcgcacgccucaggacaaccaacuuaucuacgucauccugaccauucuaacgaucaucggccucauugccgccaaugagaugggccucaucgagaagacgaagacggacuucggguuuuaccaggugaaaacggaaacgacuauucuggacguggaucuccggcccgccucggcguggacucuauaugcaguggccaccaccauccugaccccgaugcuccgccacacuaucgagaacacauccgccaaccuaucccucgccgcuaucgccaaccaggccgcgguguuaauggggcuuggaaagggguggccucugcaccggauggaccucggggucccccugcucgcgaugggcuguuacagccaggucaaccccacuacccucacggcuuccuuggugauguuacuggugcauuaugcaaucauagggccaggauugcaagccaaggcgacccgcgaagcucagaagcggaccgccgccggcaucaugaaaaauccaaccguugacggcaucacagugauagaccuggagccgaucagcuacgaucccaaguucgagaagcagcucggacaggucaugcuguugguucuaugugcagggcaacugcuguuaaugagaaccacgugggcauucugcgaagugcuaacucuggccacgggccccauccuaacccuuugggaggggaaccccgguagauuuuggaacaccaccaucgccguuaguacggcaaacaucuuccggggcagcuaccuggccggugcgggccucgcuuucagucugaucaagaacgcccagacuccccggcgggggaccggcaccacuggcgagacgcuuggcgagaaguggaaacggcaguugaacagucuggaccgcaaggaauuugaagaauauaagcgcuccgguauccucgaggucgaccgcaccgaggcuaagagugcccucaaggauggcucgaaaaucaagcaugcggugucucguggcuccucgaaaauacgcuggaucguggagcgggguauggucaagcccaaaggcaaggugaucgaccuugggugcggccgagggggguggaguuacuacauggccacccugaaaaauguuaccgaggucaagggcuacacgaagggaggccccgggcaugaagaaccgauaccaauggccaccuauggauggaaccucgugaagcuacacagcggcgucgacgucuuuuacaagcccacggagcaaguggacacgcugcucugugacaucggggagagcuccagcaacccgacgauagaagaggggcggacccuucggguguugaagauggucgagcccuggcuuuccucgaagcccgaguuuugcaucaagguauugaacccauacaugccgaccgugaucgaagaacuggagaagcugcagaggaagcacggcggcaaccucgugcgcuguccccugucccgcaacagcacgcacgagauguacuggguguccggcgccucagggaacaucguauccuccgucaauacgaccagcaagaugcugcugaaccguuucaccacccgccaccggaagccaacuuacgagaaggacguggacuugggcgccggaacuaggucaguaucgaccgagacggagaagccagauaugacgaucaucggacggagguuacagcggcuacaggaggaacacaaagagaccuggcacuacgaucaagagaacccguaccgcaccugggcauaccacgggaguuacgaggcgcccuccaccggcagcgcuuccagcauggucaacggcguggugaagcuguuaacgaaaccuugggacguaaucccgauggugacccaacuggccaugacugacaccacgcccuucggucaacagcgcguauucaaggagaagguggacacccgcacuccucagccgaaaccgggcacccgcauggugaugacaacgacugcaaacugguuaugggcauugcucgggaagaaaaagaauccccgccugugcacccgggaagaguucauuuccaagguucgcucuaacgcagccaucggcgccgucuuccaggaggagcagggguggacgagcgcgucggaggcggugaacgacucuagguucugggaacuggucgauaaggaacgcgcccuccaccaggaaggcaagugcgaauccugcguguacaacaugauggguaaacgagagaagaagcugggggaauuuggccgcgcuaaagggucacgcgccauaugguacaugugguuaggcgcacgcuuucucgaauuugaggcgcuuggguuccucaaugaagaccacugguuuggccgcgagaacucguggagcggcguggaaggggagggccuccaccggcugggguacauccuggaagagauagacaagaaggacggcgaccuaauguacgcugacgauaccgcgggcugggauacgcgaauuaccgaagaugaccugcagaacgaggaacugaucaccgaacaaauggcgccccaccacaaaauccucgcaaaagcuaucuucaaacuuacguaccagaauaaggucguuaaagucuuacggcccaccccucggggggcaguuauggacauaauuucccggaaagaucagcgcggcagcggccaaguuggcacguacggacucaacaccuucacaaacauggaagugcaacuuaucaggcagauggaggcggagggcgucauuacccaggacgauaugcagaauccaaaaggccuaaaggaacgcguggagaaauggcuucgggaaugugguguugaccgccugaagcggauggcgaucuccggugacgacugcguuguuaaaccgcuugaugagcgcuucgggaccagccuccuguuucugaacgauaugggcaaagugcggaaagacauaccccagugggagccuuccaaagguuggaagaacuggcaggagguaccauucugcucacaccacuuccacaaaaucuucaugaaagauggccgcucgcucguagugcccugccggaaucaagacgaacuaaucggucgagcccguaucagccagggugccgguuggaguuuacgagagacagcgugccuagggaaagcauacgcgcagauguggagccugauguacuuccaccgccgggauuuaagacucgcuaguauggccaucugcagcgccgucccaacggagugguucccgacgucccggaccaccugguccauacaugcccaccaccaguggaugacaacggaggauaugcugaaagucuggaaccgcguauggaucgaggauaaccccaacaugaucgacaaaacgcccguucacagcugggaggacauccccuaccucggcaagcgugaagauuuauggugcgggucgcuaauuggucuaagcagccgcgccaccugggccaaaaacauccacacagccauaacccagguccgaaaucucaucgguaaagaggaguauguggacuacaugccggucaugaagcgguacucugccccuucagagagugaaggagugcuuuga

SEQ ID NO: 26333 - RNA, 9867 nt, Artificial Sequence
  derived and/or modified CDS sequence (opt11) from DENV-4__JQ513343__SS-prME
agcacaaucacccugcucugccuuauuccgacagugauggccuuucaccuguccaccagagauggcgagccucucaugaucguggcgaagcaugagagaggacgcccccugcucuucaagacaacugaggggaucaacaagugcacguugauugccauggaucuaggggaaaugugcgaggacacggugaccuacaagugcccucucuugguaaacaccgagcccgaggacaucgacugcuggugcaacuugacgaguaccugggugauguacgggacgugcacgcagucgggggaaagacgacgggagaaacgcagcguggcccugacgccucacuccgguaugggccucgagacccgagccgagaccuggaugagcagugagggagccuggaagcacgcccagcgcguggaaagcuggauccugcggaaccccggcuucgcgcugcucgccggguucauggccuacaugauuggccaaaccggcauacagcgcaccgucuuuuucgugcugaugaugcugguggccccgagcuacggcaugcggugugucggcguggggaaccgcgacuucguggagggcgucucggggggcgcgugggucgaccucgugcuggagcacggugggugcguaaccacaauggcccagggcaagcccacccuggacuucgagcucacgaagaccaccgcaaaggaaguggcccugcuccggaccuacugcaucgaggcuuugaucucaaacaucacgaccgcgaccagauguccuacccagggggagcccuaccugaaggaggaacaggaccagcaguacauaugccggcgcgacguggucgaccggggcugggggaacggcugcggccuguucggaaagggaggaguggugacgugcgccaaguuuucguguaguggcaagaucacagguaacuuaguucaaaucgagaaccuggaauauacggucguuguaaccgugcauaauggcgauacgcacgccgucggcaacgacaccagcaaccacggggugaccgcaacgaucacgccgcggucgccuucugucgagguuaagcugccggacuauggcgagcugacgcuugacugugagccccggagcgggaucgacuucaacgagaugauccugaugaagaugaaaaagaagaccuggcucgugcacaaacagugguuccuggaccugccccucccguggacuaccggagccgacacgagcgaggugcacuggaacuauaaggagcguauggagacauucaaggucccccacgcgaagcggcaggacgugacccugcuggggucccaggagggcgcuaugcacagugcccucgccggcgccacugaggucgacuccggugacgagaaccacauguucgcgggacaccucaagugcaaggugcgcauggagaagcugcgcaucaaggggauguccuacacgauguguagcgggaaguucucaaucgacaaggagauggcugagacccagcaugggaccaccgucgugaaggucaaguaugagggcgccggcgcucccugcaaggugcccaucgagauccgggacgugaauaaagagaaggucgugggcagaguuaucuccgccacaccccucgccgagaacaccaacuccguaaccaacaucgagcuggaaccacccuucggcgacagcuacauagugauagguguuggcaacuccgcccugacucuccacugguuccggaagggcagcuccaucggaaaaauguucgagagcacguaccgcggcgcuaaacggauggccauccugggggagaccgcgugggacuucggcucagucgggggccuguucaccagcuugggcaaggccgugcaccaggucuucggguccguauacaccacgauguuuggagggguuuccuggaugaucaggauccugaucggcuuccuggugcuguggauagggacaaacaguagaaacaccagcauggccaugacgugcauagccgucggcgggauaacccucuuccugggguucaccgugcaggccgacaugggcuguguagucuccuggagcgggcgcgagcucaaauguggcuccggaaucuucgugguugacaacguccauaccuggaccgagcaguacaaguuccaacccgagagccccgcacgguuagcuagcgcuauccugaacgcccacaaggauggcgugugcggcauccguuccacaacgaggcucgagaacgugauguggaagcagaucacuaacgagcucaacuacguccugugggagggcgggcacgaucugaccgugguggccggggacgucaagggagugcuaacgaagggcaagcgcgcucugacuccgcccgccucagacuuaaaguacagcuggaagaccuggggcaaagccaaaauauucacucccgaggcccgaaacagcacguuccucauugacggaccagacacuuccgagugcccuaacgagcgccgggcauggaauucuuucgaggucgaggacuacggguucggcauguuuaccaccaauaucuggaugaaguuccgugagggguccagcgaagucugcgaccacaggcugaugucggccgccaucaaggaucaaaaggcuguucacgccgacaugggcuacuggauagagagcuccaaaaaccagacguggcagaucgaacgcgcgagccugaucgagguuaagacuugucucuggcccaagacccacacccuauggagcaauggcguccuggaaagccaaauguugauccccaagucguacgccgggcccuuuagccaacacaacuaccgucagggcuacgccacccaaacgguggggcccuggcaccuggggaagcuggagaucgacuucggcgagugcccagguacgacggugacaauccaagagaauugugaccacaggggcccgagucuucgcacgaccacugcgagcgggaagcuugucacccagugguguugccggucaugcacgaugcccccccugcgguuucucggagaggacgggugcugguacgguauggaaauucgaccacuguccgaaaaggaggagaacauggucaagagccaggugacugcgggacagggcacuucagaaaccuucagcaugggccuccuaugccugacguuguucgucgaagagugccucagacggcgagugacccgaaaacacaugauccuggcaguuguuauuacccugugcgccaucauauuagggggcuuaaccuggauggacuugcuccgcgccuugaucaugcugggagacaccauguccggccggauagguggacagacucaccucgcaaucauggccguauucaagaugagccccggcuacguccugggggucuuucugaggaaguugacgagccgggagacugcgcucauggugauuggcauggcaaugacgaccacccugucgaucccccacgaccucauggaguuaaucgacggaaucucccugggucucauccugcugaaaaucgugacccaauucgauaacacgcaggugggaacccucgcgcugagccugacguucauacgcucuaccaugucacuggugauggcuuggcggacgaucauggcgguucuguucguaguuacccugaucccccucugccgcaccuccugccugcagaagcaaagccacugggucgaaaucacggcucugauccucggagcccaggcccugcccguguaccucaugacgcucaugaagggcgccagccggaggucuuggccguuaaacgaaggcaucauggcggugggacucgucucccucuuagggucagcccugcucaagaacgacgugccgcuggcgggccccaugguagccggcggacugcuccuggcugcguacguuaugucaggcagcucugccgaccugucccucgagaaggccgccaacgugcaaugggacgagauggcggacaucaccgggagcucccccaucaucgaagugaagcaggacgaggacggcagcuucagcauaagggacgucgaggagaccaacaugauaaccuugcugguuaaauuggcgcuuaucacgguguccggccuguacccccucgccauuccuauaaccaugacucugugguacauguggcaagucaagacccagcguucaggcgcgcugugggacgugccuagccccgccgccacccaaaaagcugcccucuccgagggcguguaccggaucaugcagaggggguuauucggcaaaacgcagguuggcguuggcauccacauggaggggguguuccacaccauguggcacguaacgcggggcucuguaaucugccacgaaacgggccgccucgaacccuccugggcugacgugcgcaacgacaugaucagcuauggagggggguggcggcucggcgauaagugggacaaggaagaggacguccagguacuggccaucgagccgggcaagaacccaaagcacgugcagacuaagccagggcuguucaagacccucaccggagaaaucggcgccguaacccuggacuucaagcccgggacauccgggagcccgaucaucaacaggaagggcaaagugaucggucuguacgggaauggcguugucaccaaguccggggacuacgugagcgcuauaacgcaggccgaacggauuggagaacccgacuacgaaguggacgaggacauauuucgcaagaaacgguuaacgaucauggaccugcacccuggagcggggaagaccaagcgcauccugccguccauaguacgugaggcauuaaagcgccggcuccguacccugauucuugcacccacccgggugguggcagccgagauggaggaggcccuucgugggcuaccgauucgguaccagacgcccgccgugaagucggaacacacgggacgggagaucguggaucucaugugccacgccaccuucacaacccggcuccuguccagcacgcgaguuccgaacuacaaccuaaucgucauggaugaggcgcauuucacagaucccucgagcguagccgcccggggcuacauuagcacccgcguggagaugggggaagccgcggccaucuucaugacugcgacgccgccuggcgccacugacccguucccgcagucgaacagcccuaucgaggacaucgagcgcgagaucccagagcgcucguggaacacugguuuugacuggaucacugacuaccagggcaagacugugugguucguaccguccaucaaggccggcaacgacaucgcgaauugccuucgcaaguccgggaagaaggugauccaguugagccgaaagaccuucgacacugaguaccccaagacuaagcugacggacugggacuuugucgugaccaccgauaucuccgagaugggugccaacuucagagccgggcgggucaucgacccccgccguugccucaaaccugugauacuaacugauggcccggagcgcgugauccuggccgggcccauccccgucacgcccgcgagcgccgcccagcggcgcggacgcaucggccgcaauccggcccaggaagacgaccaguacguguucaguggugacccauuaaagaacgaugaagaccacgcccauuggaccgaggccaagaugcuucuggacaacauauacacacccgagggcaucauccccaccuuauuugggccugagcgggagaagacacaggcgaucgacggugaauuucgacuucggggcgaacagcgcaagaccuucguggagcugaugcggcgcggggaccucccggucuggcucagcuacaaaguggccucagcggggaucagcuauaaggaccgcgaguggugcuucaccggugagcgaaauaaccagauccuggaggagaacauggagguagagaucuggacaagagagggcgaaaagaagaagcugcgccccaaauggcucgaugcccggguguacgcggacccgauggcuuugaaggauuucaaggaauucgccucugggcgcaaguccaucacccucgacauacuuacggagaucgccucccugccaaccuaccuuagcucccgcgccaagcuggccuuggauaacauugugaugcuccacaccaccgaacgaggcggccgcgccuaucagcaugcccugaaugagcugcccgaaucgcucgagacgcuuauguuaguggcccuccuaggggcgaugaccgccgggaucuuccucuuuuucaugcaggggaagggcaucgguaaacuuagcaugggccugaucacuaucgccgucgcguccggccuacuauggguggccgaaauccagccccaauggaucgcagcuagcaucauccuggaguucuucuuaauggugcucuugauuccggagcccgagaagcagcggacgccacaggacaaccagcugaucuacgucauccucacgauucugaccauuaucgggcugaucgcggccaaugagaugggcuuaauagagaaaacuaaaaccgauuuuggguucuaccaggugaagaccgaaaccaccauccucgacguugaucugcgcccggccuccgcguggacccucuacgccguugcaacgaccaucuugacgccgaugcugcgucacacgauagaaaacacgagugccaaccucucccuugcagcgaucgcgaaccaggccgcggugcuaaugggacucggcaagggcuggccccugcacaggauggacuugggcgugccgcuauuagccauggggugcuacagccaggucaaccccaccacccugaccgcaagccuagugauguugcuggugcacuaugccaucaucggcccggggcuccaggccaaggcaacucgcgaggcgcagaagcgcacugccgccggcaucaugaagaaccccaccgucgacggcaucaccgugaucgaccucgagcccaucagcuaugacccgaaguucgagaagcaguugggucaggugaugcuccugguccugugcgcgggccagcugcugcugaugcggacgaccugggccuucugcgaggugcucacacuggcgaccgggccaaucuuaacauuaugggagggaaaccccgguagauucuggaacaccaccaucgccguuuccaccgcaaacaucuuccgcggcaguuaucuggccggggccgggcuggcguucuccuuaauaaagaacgcccaaacgccccgcagagggaccgggaccacuggcgagacccucggggaaaaauggaagcgccagcugaauagccucgacaggaaggaguucgaggaguacaagcgcuccggcauccuggagguugauagaacggaagccaagagcgcccugaaagacgguuccaaaaucaagcacgcugugucucgcgggagcucaaagauccgguggauuguugaaaggggcaugguuaagcccaaagguaagguaauagaucugggcugcgggcgaggaggcugguccuacuacauggccacccucaaaaacgugaccgaggucaagggguacacgaagggcgggccgggacacgaggagcccauccccauggcaacauacggguggaaccuggugaaguugcacagcggaguggacgucuucuacaagcccacagagcaggucgacacucugcugugcgacaucggcgagucuuccuccaacccgaccaucgaggaagggaggacacuacgcgugcuuaaaaugguagagcccuggcuguccagcaagccugaguucugcaucaaagugcuaaaccccuacaugccgaccguuaucgaggagcucgagaagcugcagcggaagcacggcgggaaccucgugcgcugcccguuaucccgcaacagcacccaugagauguacuggguauccggcgccucugguaacaucguauccucugugaacacaacgucaaagauguugcugaaccgcuucaccacccggcaccgcaagcccaccuacgagaaggauguagaccucggggccggcacgcggucgguaucgaccgagaccgagaagcccgauaugacgauaauagggcgccggcugcagcgucugcaggaggagcacaaggagacauggcacuaugaccaggagaacccguaccguaccugggcguaccacgguagcuacgaggcccccuccacugggagcgccuccucgauggucaacggcguggucaagcuccuuaccaagcccugggacguaaucccgauggugacgcagcuugccaugaccgacacgacaccauucggccagcagagagucuuuaaggagaagguagacacgcggacgccccagcccaagccugggacacgcauggugaugaccacgacggccaacugguugugggcguugcugggcaagaagaagaacccccggcucugcacccgagaggaauucauuagcaagguccggagcaacgccgcaaucggagccguguuccaggaggagcaaggcuggaccucugccucggaggcgguuaaugacagccgcuuuugggaguuagucgacaaggagcgggcgcugcaccaggagggaaagugcgaguccugcgucuacaacaugaugggcaagagagagaagaagcucggcgaguuugggagagccaaggguagccgggcuauuugguacauguggcugggagcacgcuuccuggaauucgaggcccucggauuccuaaacgaagaccauugguucgggagggagaacuccugguccggcguggaaggagagggucugcaccgcuuaggcuacauuuuggaggagaucgacaagaaggacggggaucugauguacgccgaugacacggccggcugggacacccggauaacugaagacgaccuccagaacgaggagcugaucaccgagcagauggcgccccaccacaagauccuagccaaagccaucuucaagcuaaccuaccagaauaagguuguuaagguccuaaggcccacuccgcggggcgccgugauggauaucaucuccagaaaggaccaaaggggaaguggccagguggggaccuauggcuuaaauaccuucaccaauauggaggugcagcucaucagacagauggaggccgagggaguuaucacccaagacgacaugcagaaccccaagggccuuaaggagagaguagagaaguggcugcgcgagugcggcguagaccgucuaaagcgcauggccaucucuggggacgacugcgucguaaaaccccucgaugaacgguucggcaccucccuccuguuccuaaaugacauggggaaggugcgcaaggacaucccccaaugggaaccgucaaaaggcuggaagaacuggcaggaggugcccuucugcagccaccacuuccacaagauuuuuaugaaggauggccggucccuggugguccccugucgcaaccaggacgagcucaucggucgggcucgcaucagccagggcgccggauggucccugcgcgagacggccugccuggggaaagcguacgcccagauguggucgcucauguauuuucaccgccgcgacuuacgccuggcgucuauggcgaucuguagcgccguacccacggagugguucccgacuagccgcaccaccuggucuauccacgcccaccaccaguggaugacaacggaggacauguuaaaggucuggaaccgcguauggauugaggacaauccgaacaugaucgauaagacucccguccacucaugggaggauauccccuaccuuggaaagcgcgaggaccuguggugcgggucccuaaucggucuuagcucccgggccacuugggcgaagaacauccacaccgccauuacgcagguacgcaaccugaucggaaaagaagaauacguggacuauaugccggucaugaaacgguacagcgcccccucggaaagcgagggcguccucuaa

SEQ ID NO: 26334 - RNA, 9867 nt, Artificial Sequence
  derived and/or modified CDS sequence (opt11) from DENV-4__KT276273__SS-prME
agcaccaucacccugcuuugccuuauccccacggugauggcguuucacuugucgacccgcgacggcgagccgcucaugaucgucgccaagcaugagcgggggcgcccccugcuguucaaaaccaccgagggcaucaauaaguguacgcucauagccauggaccuuggggagaugugcgaggauaccgugaccuacaagugcccccuccuugugaacacagagcccgaagacaucgauugcuggugcaaccugacgagcacgugggucauguacggcaccugcacccagucgggggagcggcgccgggagaagcgcagcguggcccugacgccgcacuccggcaugggccucgagacccgggccgagacguggaugagcagugaaggggccuggaagcacgcacaacgcguggagagcuggauacugcggaacccgggcuucgcucugcucgccggguuuauggccuacaugaucgggcagaccgggauccagcgcacggucuucuuugugcugaugaugcuagucgcccccuccuauggcaugcggugugucggcguggggaaucgcgacuucguggagggcgucagcgggggcgcguggguggaccucgugcuggagcacggcgggugcgucacaaccauggcccaaggccggcccacucucgacuucgagcugaccaagaccaccgcuaaggagguggcguuacugcgcaccuacuguaucgaggcgagcauuucgaacauuacaacggccacccggugcccgacccagggggagcccuaccuuaaggaggagcaggaccaacaguacaucugccgccgggacguugucgaccgcggcugggggaacgguugcggccuauucggaaagggcgggguggucacgugcgcuaaguuuuccugcagcggcaagaucaccgggaacuugguucagaucgaaaaccucgaguacaccguggugguaaccgugcacaauggagacacgcacgcagucgguaacgacaccuccaaccacggggucaccgccaccaucacgccccggagccccuccguggaaguggaguuaccggacuacggcgaacugacccucgacugcgagccccgcuccgggaucgacuucaaugaaaugauccuaaugaagaugaacaagaagacauggcugguacacaagcagugguuccuggacuugccccugccauggaccgccggggcggacaccuccgaggugcacuggaacaacaaggagcggaugguuaccuucaaaguuccgcacgccaagcgacaggacgugaccguccucgggucacaggaaggggccaugcacagcgcguuagccggcgcgacggagguggacuccggggacggcaaccacauguucgccggucaccuuaaaugcaagguccgaauggagaaguuacggaucaaggguaugagcuacaccaugugcucgggcaaguucagcaucgauaaggaaauggcugagacgcagcacgggaccacuguggugaaggugaaauacgagggcgcuggggcccccuguaagguacccaucgagauccgcgacgugaacaaagagaaggugaucggccgagucauuuccagcauaccccuggcggagaauacgaacuccgugacgaacaucgagcuggagccgcccuucggggacagcuauaucgugaucggcgucggcaacuccgccuuaacccugcacugguuccgcaaggguagcagcaucggcaagauguucgaguccaccuaucgcggggccaagcgcauggccauccuuggcgagacggccugggacuucggguccgugggcggccucuucacgucacucgggaaggcggugcaccaggucuucggguccguuuacaccacuauguuugggggugugagcuggaugauccggauccugaucggcuuccucguccuguggaucggcaccaacagcaggaauacgagcauggccaugacuugcaucgcugugggugggaucaccuuguuccugggcuucaccgugcaggccgauauggggugugucgugucuuggagcggacgggaacucaaaugcgggagcggcaucuucguaaucgacaacguccauacguggacugagcaguacaaguuccagcccgagucccccgcgcgccuggccuccgccaucuuaaaugcccacaaagacggcgucugcgggaucagauccaccacccggcucgagaacgugauguggaagcagaucacgaacgagcugaacuacguccuuugggaaggcgggcacgaucucaccgucguggccggugacgugaagggcgugcugacuaagggaaagcgggcccugaccccgcccgcaagcgaccuaaaguauuccuggaagacguggggcaaagccaagaucuucacccccgaggcccgcaacagcaccuuccugaucgacgggcccgacacgucagagugcccgaacgagaggcgagccuggaacagccuggagguggaagacuacggguuuggcauguucacgaccaacaucuggaugaaguuccgggaaggcuccagcgaaaugugcgaccaucgccucauguccgcggcaauaaaggaccagaaggccguccacgccgacaugggcuacuggaucgaaagcaguaaaaaccagaccuggcagauugagaaggcgagccugaucgaggugaagaccugccuguggcccaagacgcacacccucuggucuaacggggugcuagagagccagaugcuaauacccaagucguacgccgguccguucucacagcauaacuaccgacagggguacgccacccagaucgcaggccccuggcaccuggggaagcuggagauagacuucggugagugccccggcaccaccgucacgauccaggaggacugcgaccaccgcgggcccagccuuaggaccaccacugccuccggcaagcucgugacacaguggugcugccggagcugcaccaugccgccccugagguucuuaggggaggacggcugcugguacgggauggagauucggccccucagugagaaggaggagaacauggugaagucacaggucgcggccgggcagggcacuuccgagaccuucucuauggggcuacugugucucacgcuguucguggaagagugccugcgccggcgagugacucggaagcacaugauccucgucguggucaucaccuuuugcgccaucauccuaggcggccugaccuggauggacuuacugcgcgcccugaucaugcucggggauacgaugucuggccggaucgggggccagauccaccuugcaaucauggcgguguucaagaugagccccggguacgugcugggcgucuuccucaggaaguugacgucccgggaaaccgccuugauggucauuggaauggccaugaccacggugcucaguauuccguacgaccuaauggagcugaucgacggcaucucccucggccucauccugcucaagaucguaacccaguucgauaacacccagguggggaccuuagcccugagccucacguucauccgcaguaccaugccccuggugauggccuggcggaccaucauggcggucuuauuuguggugacccucauacccuuaugccgcacgagcugccugcagaagcagucccacugggucgagaucaccgcccucauccugggcgcccaggcucugcccguauaccucaugacucugaugaagggggcuagccguagguccuggccgcugaacgagggcaucauggccguggggcucgucagucugcugggcuccgcccuccugaaaaacgacgugccccucgcaggacccaugguggcggggggccuccuauuggcggcauacgugaugagcggguccuccgccgaccucagccuggagaaggccgccaacgugcagugggacgagauggcggacauuacaggcuccagccccaucaucgaggugaagcaggacgaggauggcuccuucagcauccgggacgucgaggaaacgaauaugauaacccugcuggugaaacuggcucugaucaccgucuccggacucuacccgcucgccaucccggucaccaugacguuaugguauauguggcaggugaagacccagcggagcggugcucucugggacgugcccucccccgccgcgacccagaaggccgcccuuagcgagggcgucuaccggauaaugcagcgcggccuauucgggaagacacaggugggcguggggauccacauggagggcgucuuucauacgauguggcacgucacccgggguuccguaaucugccacgagaccgggcgccucgagccgagcugggccgacgugcgcaaugacaugaucuccuacggagggggcuggcgcuugggcgacaaaugggacaaggaggaggacgugcaggugcuggccaucgagcccgggaagaaccccaagcacguucagaccaagcccggccucuucaaaacccugacgggggagaucggcgcgguaacccuggacuucaagccggggacuucaggcucccccaucauaaaucgcaaaggcaaggucauugggcuguacggcaacggggucgugaccaagagcggcgacuacgucucagccaucacgcaggccgaacggaucggggagcccgacuacgaggucgacgaagacaucuuuaggaaaaagcgccugaccaucauggaccugcacccuggcgccggcaaaaccaaacgcauucuucccuccaucguacgggaggcgcugaaacgccgucuccgaacccugauccucgcacccacgcgggugguagccgccgagauggaagaggcacugcgagguuugcccauccgguaccagaccccggcgguuaaguccgaacauaccggccgcgaaaucguggacuugaugugccacgccaccuucacgacccggcugcugagcagcacccgcguccccaauuacaaccucauagugauggaugaagcccacuuuaccgaccccuccagcguggccgcucggggguacaucuccacgcgcgucgagaugggcgaggcugccgccaucuucaugacggccacuccccccggggccaccgaccccuuuccucagagcaacucccccaucgaggauaucgagagagagaucccggagcgcagcuggaacacgggcuuugacuggaucaccgacuaccagggcaagaccgucugguucguccccuccaucaaggcggggaacgauaucgccaacugccugcgcaagagcggcaagaaggugauccagcugucacggaagaccuucgacacggaauauccuaagaccaagcucaccgacugggacuucgugguuaccacggacauuagcgagaugggagccaacuuccgcgccggccgggugauagacccacgccggugucugaagccggugauccugaccgacgggccugagcgcguaauacucgcgggucccauccccgugacuccggcauccgcugcccagcggcggggccggaucgggcgcaacccagcccaggaggaugaccaguauguguuuagcggcgacccccugaagaacgacgaagaucacgcgcauuggacagaagcgaaaaugcugcucgauaacauauacacucccgaggggaucaucccuacgcuguucggccccgagcgggagaagacccaagcaaucgauggagaguuucgccugcggggggagcaacgcaagacguuugucgagcucaugcggcgcggcgaccuccccguguggcuguccuacaagguggccagcgccgggauuucauacaaggaccgggaguggugcuuuacgggcgagcgcaacaaccagauccucgaggagaacauggaggucgagaucuggacccgggagggggaaaagaagaagcugcgcccccggugguuggacgcacgcguguacgccgacccuauggcacucaaagacuucaaggaguucgccagcgggcgcaagucaaucacccuggacaucuugacagagaucgccagccuccccacguaucuguccagccgggcgaagcuggcccucgacaacaucgugauguugcacaccaccgagcgaggagggcgggccuaccagcacgcccugaacgagcuccccgagagccuggaaacccugaugcucgucgcgcuccugggugccaugacugccgggauuuuucucuucuuuaugcagggcaaggguauaggcaagcuguccaugggccugaucacgaucgcgguggccagcgggcuccuuuggguggcggagauucagccacaguggaucgccgccuccauuaucuuggaguuuuuccucaugguccugcugauccccgagccagaaaagcagcgcaccccccaggacaaccagcucauauacgugaucuuaaccauccugaccaucaucggcuuaauagccgccaacgaaauggggcugauagagaagacgaagacagauuucggcuucuaccaggugaagaccgagaccacgauccuggacgucgaccuccggccggcgagcgccuggacccuguacgccguggccacaaccauccugaccccgaugcuccgacacaccaucgagaacacauccgcuaaucugagccuggcggccaucgccaaucaggcagcggugcugaugggucugggcaagggcuggccacugcaccggauggaucucggggucccgcugcuggcgaugggaugcuacucccaggucaacccgaccacacucacagccagccuggugauguugcucguccacuacgccaucauuggacccgggcuccaggccaaggcuacccgggaggcccagaaacgaaccgccgcaggcaucaugaagaaccccacgguggacgggaucaccguuaucgaccuggagcccaucuccuacgacccgaaguucgagaagcagcucggccagguuaugcugcuggugcucugcgcugggcagcugcugcucaugcgcaccaccugggcguucugugaggugcugacgcuagccaccggucccaucuugacccugugggaggggaacccaggccgguucuggaauaccacgauugcggucaguaccgccaauaucuuucgcggcuccuaucucgccggggcgggccuagccuucagcuuaaucaagaacgcccagaccccccggcgcgggaccggcacgaccggagagacccucggcgaaaaguggaagcggcaguugaacucccuggaccgcaaggaguucgaggaguacaagcggucaggcaucuuagagguggaccgcaccgaagccaaauccgcucucaaggacgguagcaagaucaagcacgcgguuucccggggcagcuccaagauucgcuggauaguggaacgcgggauggugaagccgaagggcaagguggucgaccuggggugcggccggggcggguggagcuacuacauggcgacgcuuaagaacgugacugaggugaagggcuauaccaaggggggccccggacacgaggagccuauucccauggcuaccuacgguuggaaccucgucaagcugcacagcggaguggacguguucuauaagccgaccgaacaggucgacacgcugcucugcgacaucggggaauccagcuccaacccgaccaucgaggagggccgcaccuuacguguucugaaaaugguggagcccuggcucagcuccaagcccgaguucugcaucaagguucugaacccguacaugcccaccguaauugaagaauuggagaagcugcagcgcaaacacgggggcaaccuagugcggugcccccugagccgcaacaguacgcacgagauguacugggucucaggugcauccgggaacaucgugagcuccguaaauaccacgagcaagaugcuacucaaccgguucaccacgcgccaccggaagcccaccuacgaaaaagacguggaccugggggcgggaacccgauccgugagcaccgagacggagaagccggacaugaccaucaucggccggcgccugcagcggcuccaggaggagcacaaggagacuuggcacuacgaccaggaaaaccccuaccgcaccugggccuaucacggguccuacgaggccccaagcacgggcuccgccuccuccaugguaaacgggguagugaagcugcuaaccaagccgugggaugucauccccaugguuacccagcucgccaugaccgacacgacccccuucgggcagcagcggguguucaaggagaaggucgacacccguaccccccagccgaagcccggcacccggauggugaugacgacgacggcgaauuggcugugggcucugcucgguaagaagaagaacccacgccuguguaccaaggaggaguuuaucagcaaggugcgggccaacgccgccaucggcgcggucuuucaagaggagcagggguggacaagcgcuuccgaggcggugaacgacucucgcuucugggagcuaguggacaaagagcgggcuuuacaccaggaaggaaagugcgaguccugcgucuacaacaugauggggaagagagagaagaagcugggggaguucggccgcgcaaaggggagccgggccaucugguacaugugguugggagccagauuccucgaguucgaggcccugggguuccugaacgaggaccacugguuuggccgggagaacuccuggucuggcguggagggggaggggcugcaccgccugggauacauacuugaggagaucgacaagaaggacggcgaccucauguacgcggacgacaccgcaggcugggacacccgcaucacggaggacgaccuacagaacgaggagcuaaucacggagcagauggccccccaccacaagauccucgcaaaagccaucuucaagcucaccuaccaaaacaaggugguuaaggugcugcgcccuacuccccggggggcugugauggacaucaucagccguaaggaccagcggggcagcggacaggucgguacguaugggcucaacaccuuuaccaacauggaggugcagcugauccgccaaauggaggcggagggagugauuacccaggacgacaugcagaauccaaagggccugaaggagagggucgagaaguggcuccgcgagugugggguggaccggcugaagcggauggcgaucuccggggaugacugcguggucaagccccuggaugagcgguucgccaccagccuccuguuccucaacgacauggggaaagugcgcaaggacaucccgcagugggagcccuccaagggguggaagaacuggcaggagguuccauucugcucgcaccauuuccauaagaucuuuaugaaggacggacggucccucgucgugcccugccggaaucaggacgagcugaucggccgugcacgcaucucccagggcgcuggguggucgcuuaaggagacggcgugccucgccaaggccuacgcccagauguggagcuugauguacuuccaccgccgggaucugcggcucgccucgauggcgaucugcagugccgugcccacggagugguuccccacaagcaggaccaccugguccauccacgcccaccaccaauggaugaccaccgaggacaugcugaagguguggaaccgcgucuggaucgaggacaaccccaacaugaucgacaagaccccgguacacucaugggaggacaucccguaccugggcaaacgagaggauuuguggugcgggucauuaaucggccugagcucccgggccacgugggcaaaaaacauccacaccgcgauaacucagguacggaaucucauagggaaggaggaguauauggacuacaugcccguuaugcggagauacagcgccccauccgaaagcgagggcgugcucuaa

SEQ ID NO: 26335 - RNA, 9867 nt, Artificial Sequence
  derived and/or modified CDS sequence (opt11) from DENV-4__KU523872__SS-prME
agcaccaugacccugcucugccugauccccacggugauggccuuccaccugucuacccgcgacggcgagccgcuaaugaucguggcuaagcacgagcgggggcgcccccugcuguucaagaccaccgagggcauuaacaagugcaccuugaucgcgauggaccugggugagaugugcgaggacaccgugaccuacaagugcccccugcucgugaacaccgagccggaggacauugacugcuggugcaaccugaccucgacaugggugauguacgggaccugcacccagagcggugagcggcgccgcgagaagcgcagcguggcccugacgccgcacuccggcaugggccucgagacccgggccgagaccuggaugagcuccgagggcgccuggaaacacgcccagagaguggagagcuggauccuccggaacccaggguucgcacugcucgccggguuuauggcccacaugaucggccagacugguauccagcgaacggucuuuuuugugcuuaugaugcugguggcgccguccuacggcaugcggugcguuggagucgggaaccgcgacuucguggagggagucagcgggggagcguggguggaucuagugcuggagcacggcgggugcgucacuaccauggcccagggcaagcccacccuggacuucgagcucacgaaaacgaccgcuaaggagguugcgcugcugcggaccuauugcaucgaggcuuccaucucuaacauaacgaccgcgacccgcuguccuacccagggggagcccuacuugaaggaggaacaggaccaacaguauauaugccggcgcgacguggucgaccggggcugggggaacggcugcggccuguucgggaagggcggcgugguuacgugcgccaaguucuccugcagcggcaagaucaccgggaaccugguccagaucgaaaaccuugaguacaccgucgucgucaccgugcacaacggcgacacacacgccgucgggaaugacaccuccaaccauggggugaccgccaccaucacgccccgcucacccuccguggagguaaagcugccggacuacggcgagcugacccucgacugcgagccccggagcgggaucgacuucaaugagaugauucucaugaagaugaagaagaagaccugguuagugcauaagcaaugguuccucgaccucccccuaccauggaccgccggcgcggacacuucggaggugcacuggaacuacaaggagcgcauggucacauuuaaggugccacacgccaagcgccaggacgugaccguccucgggagccaggagggggccaugcacagcgcacuggcaggggcgaccgagguggacaguggggacggcaaccacauguuugccgggcaucuuaaaugcaaggugcgcauggagaagcuucgcauuaagggcaugagcuacaccaugugcuccggcaaguucagcaucgacaaggagauggccgaaacgcaacacgggaccaccgucgugaaagugaaauacgagggcgcgggggcccccugcaaagucccuaucgagauccgugaugugaacaaggagaagguggucggccgcaucaucucaagcacccccuucgccgagaacacgaacucggugacaaacauagagcuggagccgccguucggggacagcuacaucgugauuggggucggcgacucugcccugacccuucacugguuccggaaggggagcuccauaggcaagauguuugagagcaccuacaggggggccaagcggauggccauccugggcgaaacugcgugggacuucggguccguggggggccuguucaccagccucgggaaggccguucaccaggucuuuggcuccguguacaccaccauguucgggggcgugagcuggaugauccgcauccucaucggguuccugguccucuggaucgguacgaacucccggaauaccagcauggcgaugaccugcaucgccgugggcgggaucacgcuauuccugggcuucacuguucaggccgacauggggugcgucguguccuggaacggcaaggagcuuaagugcggaaacggaaucuucguggucgacaaugugcacacauggaccgagcaguacaaguuucagcccgagagccccgcgcgcuuggccagcgcgauccugaacgcccacaaggacggugugugcgggauucgguccacuacgcgccuugaaaacgucauguggaagcagaucaccaacgagcucaauuacgugcugugggagggcggacacgaucugaccguggucgccggcgacgugaaaggcgugcucacgaaggggaagcgggcgcugacgccgcccguuaacgaccugaaguacagcuggaagaccuggggcaaggccaaaaucuucaccccggaggcccgcaacucaaccuuccucaucgacgggcccgacacgagcgagugcccgaacgagcgccgcgccuggaacuucuucgagguggaggacuacggcuuugggauguucacgacaaacaucuggaugaaguucagagaaggcuccagcgaggucugcgaccaccgccugauguccgccgcgauaaaggaccagaaggccguccacgccgacaugggcuauuggaucgaaagcuccaaaaaucagaccuggcagaucgagaaggccagccugauagagguaaagacuugccucuggcccaaaacgcacacccuguggucuaacggcguccuggagagccagauguugaucccacggucauacgcgggacccuucagccaacacaauuacaggcagggguacgccacccagaccgcuggccccuggcaccugggaaagcuggagaucgacuuuggcgagugucccgguacgacggugacuauccaagaggacugcgaccaccgggggcccucccucaggaccacgacugcuagcggcaagcuggugacgcaauggugcugccgcuccugcaccaugccgccccugcgguuccugggagaggacggcugcugguacgggauggagauacgcccccugagcgagaaggaggagaauauggucaagagccaaguaacggcgggccagggcaccuccgagacauucagcauggggcugcucugccuuacccuguucguggaggagugcuugcgccgccgggucacgcgcaagcacaugauccuuguaguggucaucaccuuuugcgcgauuauucuaggcggucucaccuggguggaccugcugcgggcccucaucaugcuuggcgacacaauguccggucgcaucggaggccaaauccaccucgccaucauggccguguuuaagaugagcccuggguacguauugggcguguuccugcguaagcugacaucccgcgagaccgccuuaauggugaucgguauggcgaugaccaccguuuuuagcaucccgcaugaccugauggagcucaucgauggcaucucccucggccugauccugcucaagaucgugacgcacuucgauaacacccagguggggacccuagcucugucacucaccuucauccggagcacgaccccccuggucauggccuggagaaccaucauggccguguucuucguagucacccugaucccccucugccggaccagcugccugcagaagcagucccacuggguggagaucaccgcucugauccucggcgcgcaggcccugcccguguaccugaugacccucaugaagggugcgagccgccggagcuggccgcugaaugagggcaucauggccgucggccugguuagucuccugggcagugcgcugcucaaaaacgaugugccucuggccgggcccauggucgcagggggccugcuccuggccgccuacgugaugagugggucaagcgcggaccugucccucgagaaggccgccaauguucagugggaugagauggccgacauuacuggaagcagcccggucaucgaggugaagcaggacgaggacggguccuucuccauccgcgacguggaggagacgaacaugaucaccuuauuggucaagcucgcccugaucacuguguccggccuguacccgcuagcgauccccgugaccauggccaucugguacauauggcaggucaagacgcagcggucuggcgcccugugggacgugcccucccccgcugccacccagaaggcgacccugagugaggggguguaucgcaucaugcagcggggccucuucgguaagacccaggucggcguggggauccacauggaggggguguuccacaccauguggcacgucacgcgcggguccgugaucugccacgagaccgggcggcuggagcccagcugggccgacgugcgcaacgacaugaucuccuacggcgggggcuggaaguuaggcgacaagugggacaaggaagaggacguccaggugcucgccaucgagcccgggaagaaccccaaacacgugcaaaccaaacccggucuguucaagacccugacgggugagauuggcgccgucacccucgacuucaagccagggacuagcggcucccccaucaucaacaagaagggcaaggugaucgggcuguacggcaacggggucgucaccaagagcggcgacuacguguccgcuaucacgcaggcggaacgcaucggggagcccgacuaugagguggacgaggauaucuucaggaagaagcgccugacgauaauggaccuccacccgggcgccggcaagaccaagcgcauacugccaucgaucguccgcgaggcccugaagcggcgccucaggacccucaucuuggcccccacucgcgugguggcggcagagauggaagaggcgcuccgcggccugcccauccgauaccagaccccggccgucaaguccgaacacacaggacgggagaucguugaccuuaugugccacgccaccuucacgacccgguuacucagcucuacgcggguccccaacuacaaccugaucgucauggacgaggcgcacuucaccgaccccugcagcguggccgcccggggcuacauuuccacgcgggucgagaugggugaggcugccgcgaucuucaugaccgcgacgcccccggguagcaucgaccccuuuccccagagcaacucucccauugaagacaucgagcgcgagaucccggagagaagcuggaacacuggcuucgacuggaucacggacuaccagggcaagaccguuugguucgugcccuccauuaaggccgggaacgacauugccaauugucuccgcaaauccggcaagcgggucauccagcucuccaggaagaccuucgauaccgaguaucccaagacgaagcuaaccgacugggacuucguugugaccaccgauaucagcgagaugggggcgaacuuccgcgcaggccgggucaucgauccccgcaggugccugaagccggugauccucacggacgggcccgagagggugauccuggccggcccgauaccagucaccccugccagcgccgcgcaacgucgcggucggaucggucgcaaccccgcccaggaggacgaucaguacguguucagcggcgacccguuacggaacgacgaggaucaugcacacuggaccgaggccaagaugcuccuggacaacaucuacacgcccgaagggauaaucccgacgcuguucggcccagagcgcgaaaagacccaggcuauugacggcgaguuccggcugcgcggggagcagaggaaaaccuucgucgagcugaugcgccggggagaccugcccgucuggcucucguauaagguggcgagcgcuggcaucuccuacaaggaccgcgagugguguuucaccggcgagcggaacaaccagauccuggaggagaacauggagguggaaauauggacucgcgagggggagaagaagaaacuccggcccaaguggcucgacgcccgagucuacgccgacccgauggcccugaaggacuucaaagaguucgcuagcggccggaaguccaucacucuggacauccucaccgagaucgccacccugccaaccuaccugucguccaaggcaaagcucgcccuggacaauaucgugaugcugcacaccaccgaaaaaggcggccgcgccuaccagcacgcucucaaugagcugcccgagagucuggagacccucauguuaguggcguugcucggggccaugaccgccgggaucuuucuguucuucaugcaggggaaggggaucggaaaacuguccaugggacuaauugcgaucgcagucgcuucagggcuccuguggguggccgagauacaaccucaguggaucgcggcuuccaucauccucgaguucuuccugauggugcugcugauccccgagcccgagaagcagcgcacgccccaggacaaccagcugaucuacguaaucuugaccauccucaccaucauaggccugguugccgccaacgaaauggggcugaucgagaaaaccaagacggacuucggguucuaccaagugaagaccgagaccaccauccucgaugucgaccugcggccggccagcgccuggacucuuuacgcuguggccaccaccauucucaccccaauguuacgccacacgaucgagaacacaagcgccaaccugucacucgccgccaucgcgaaccaagccgccgugcugauggggcugggcaagggauggccccuccaccggauggaccugggggucccccugcuugccaucggcuguuacagccaggucaacccgaccacccugacggccagucuggugaugcuccugguccacuacgcgauuaucggaccgggcuuacaggccaaggccacacgggaggcccaaaagcggaccgcagccggcaucaugaagaaccccacgguggacgggaucacggugaucgaccucgagcccaucagcuaugacccgaaguucgagaagcagcugggccaggucaugcugcuaguccugugugucgggcagcugcucuugaugcgcaccaccugggcccugugugagguccuuacccuggccacgggccccaucaugaccuugugggaggggaaucccggccgguucuggaacaccaccaucgccguuaguaccgcgaacauuuuccguggcaguuaccucgccggggccggccuggccuucucccugaucaagaacgcgcagacgccccggcgugggaccggcacuacaggugagacccucggggagaaguggaagcggcaguuaaacagccuggaccgcaaggaguucgaggaguauaagcguuccggcauccucgagguggaccgcaccgaagccaagagcgcccugcgggacggauccaagacuaagcacgccguuagccggggcuccucgaagauccgcuggauaguggagcgcgggaugaucaagccgaaaggcaagguugucgaccuggggugcggacggggcgggugguccuacuacauggcgacucucaagaacguaacggaggugaagggcuauaccaagggcggcccggggcacgaggaacccauccccauggccaccuacggguggaaccucgucaaacugcauagcggcgucgauguguucuacaagccgaccgagcaagucgacacgcuccugugcgacauuggggaauccagcuccaaccccaccaucgaagagggcaaaacccuuagagugcucaagauggucgaaccguggcucagcagcaagccagaguuuugcaucaagguucugaauccuuauaugccaaccgugauagaggagcucgagaagcugcagaggaggcacgggggcucccuaguucgcugcccauugagccggaacucgacucacgagauguacugggugucuggcgcguccggcaacaucguaagcuccgucaacacgaucagcaagaugcugcugaaccgcuucaccacgcgguaccgcaagcccacuuacgagaaggacguggaccugggggccggaacccgguccgugagcaccgagacagagaagccggacaugacuauaaucggccgccggcuacagcgccuucgggaggagcacaaggagacauggcacuacgaccaagaaaaccccuacaggaccugggcauaccacgggucauacgaagcccccuccaccggcucagcgagcucuauggucaacggcguagugaaacugcucacuaagcccugggacgucgugcccauggugacccaguuagccaugaccgauacuacgccuuucgggcagcagcgggucuucaaagagaagguggauacccgcacgccgcagccgaagcccgguacucggaagauaaugacuaccaccgccaauugguugugggcgcuccuugggaaaaagaaguccccacgccugugcacccgggaggaguucauauccaaggugcgaagcaaugccgcgaucggggccgucuuucaggaggagcaggguuggacguccgccagcgaggccgugaacgacagucgguucugggaguuagucgacaaagagcgcgccuugcaccaagagggccggugcgagucuugcguguacaacaugaugggaaagcgcgagaagaagcuuggggaguuuggcagggccaaggggagccgagccaucugguacauguggcuaggcgcccgcuuccuggaguucgaggcccugggguuccucaacgaagaucacugguucucccgggagaauuccuggucaggcguggagggcgaggggcugcaccgccugggcuacauccucgaggauauagacaagaaggacggugaccucaucuacgcggacgauacagcgggcugggacacccggaucacggaggaugaccuccucaacgaggagcugaucacugagcagauggcaccccaccacaagacacuggccaaagccaucuucaagcucaccuaccagaacaagguggucaagguguuacgccccacccccaagggggcagugauggacauuaucagcagaaaagaccagaggggauccggccaagucgggacauacggccugaacacguucaccaacauggaggugcagcucauccggcagauggaagcagagggggugauuacccaggacgacaugcagaaucccgaaggccugaaagagcgugucgagaaguggcugaaagagugcggcguggaccggcucaagcguauggccaucaguggggacgauugcguggucaagccacuggacgagcgguucuccacgucacuccuguuucugaaugauaugggaaaggugcgcaaggacaucccgcagugggagcccagcaagggguggaagaacuggcaagaggugcccuucugcucgcaccauuuccacaagaucuucaugaaggacggccggucccugguugugcccugccgcaaccaggacgagcuaaucgggcgggcccgcaucagccagggagccggcuggucccugcgggagacggcgugucugggaaaagccuacgcccaaauguggagccucauguacuuucaccggcgcgaccugcggcuggccucgauggccaucugcagcgcggugccgaccgagugguuucccaccagccgcacgacguggagcauccaugcccaccaccaauggaugaccacagaggauaugcucaaggucuggaaucggguguggaucgaagauaaccccaacaugaccgauaagacgccuguucauagcugggaagacaucccguacuuaggaaagcgggaagaccuguggugugggucccucaucggccugagcucccgggcaacgugggcgaagaauauccacacugcuaucacucaggugcgcaaccuaaucgggaaggaggaguacguggacuacaugcccgcuaugaagagguacagcgcccccuucgaguccgagggcguacucuga

SEQ ID NO: 26336 - RNA, 9867 nt, Artificial Sequence
  derived and/or modified CDS sequence (opt11) from DENV-4__KP140942__SS-prME
agcaccauuacccugcucugccugauccccacgguuauggccuuccaccuguccacacgugacggcgagcccuuaaugaucguagccaagcacgagagagggcgcccucugcuguucaaaaccacagagggaaucaauaagugcacguugaucgcgauggaccugggagagaugugcgaggacacagugacuuacaaguguccucuacucgucaauacagagcccgaagacauagauugcuggugcaaccugacaagcacguggguaauguacgggaccugcacccaguccggcgagcggcgacgggagaagaggucaguggcccuaacaccgcacuccggaaugggucuagagacccgcgccgagaccuggauguccuccgagggggccuggaaacacgcccagagaguagagagcuggauucugcgcaacccaggcuucgcucugcuagccggguucauggccuacaugaucggccagacugguauucaacgcaccgucuucuucgugcugaugaugcugguggcccccuccuacggcaugcggugcgucggcguaggaaaccgagauuuuguggagggcguaagugggggcgcguggguggaccuggugcuggagcauggcgggugcgucaccaccauggcccagggccggcccacucuggacuucgagcucacuaagacgaccgcgaaagagguggcccugcugcgcaccuacugcauugaagccuccaucagcaauauaacuaccgcgacacgauguccgacacagggugagccuuaccucaaggaagagcaggaccagcaguacauaugucgccgggacguugucgaccgcgggugggggaaugguuguggccuguucgggaagggcggggugguaacuugcgccaaguucuccuguaguggcaagauaaccgggaaccugguucagauugagaaccucgaauacacggugguggucaccgugcacaacggcgacacgcaugcaguagggaacgacacguccaaccacgggguuaccgcaaccaucacuccgaggagccccuccguggaagucgaacuuccggacuacggcgagcugacccucgacugcgagccucgcucugggauugacuuuaaugagaugauacucaugaagaugaauaagaaaacguggcugguucacaagcagugguuucucgauuuaccccugccauggacagcgggcgcggacaccuccgaaguacacuggaauaacaaggaaagaauggucaccuucaaagugccgcacgccaagcgccaggacgugacugucuuggguagccaggagggcgccaugcauagcgcccuggccggcgcgaccgagguggacuccggggacggcaaccacauguucgcugggcaccugaagugcaaggugcgaauggagaaguugcguaucaagggcaugagcuacaccaugugcuccggcaaauucagcauagacaaggagauggcggagacgcagcacgggaccaccgucgugaagguuaaguaugaaggugcgggggccccuugcaagguuccuaucgagauccgcgaugugaauaaagagaaggugaucggccgcguuauuuccagcaucccccuggcggagaacaccaacucugugaccaauaucgaacuggaaccgcccuuuggggauagcuauauuguaauuggcgucgguaacuccgcccucacccugcacugguuucguaaaggaagcuccauuggcaagauguucgagagcacauaccguggggccaagcgcauggccauccugggugaaaccgccugggauuucgggucaguuggcggacucuuuacgagcuuggggaaggccgugcaucaggucuucggcucgguguauacaaccauguucgggggcguguccuggaugauaaggauccugaucggguuccucguccuguggaucgggaccaacucccgcaauacaucaauggcgaugaccuguaucgccguaggagggaucacccuguuccugggcuucaccgugcaggccgacaugggcugcgucguuuccuggaguggccgcgagcucaaaugcgggagcgggaucuuugugaucgacaacguccacacguggacagagcaguacaaguuucagcccgaaucuccggcgagacuggccagcgccauccugaacgcccacaaggacggcgugugcgggauacggagcaccacccgccucgagaaugucauguggaaacagaucacgaaugagcugaacuacguccugugggagggcgggcaugaccuaaccgugguggcaggagaugucaagggcguccugaccaaaggaaagcgggcguuaaccccgcccgccagcgaucugaaguauuccuggaagacuuggggcaaggccaagauauucacuccggaggcacgcaacagcacguuccugaucgacgggcccgacaccuccgagugcccgaacgagcgccgcgccuggaacagccuugaaguggaggauuauggguuugggauguucacgaccaacaucuggaugaaguuccgggagggcuccagcgagaugugcgaccaccgccucauguccgcggccauaaaggaccagaaagccguccacgccgacaugggcuauuggaucgaaagcuccaagaaccagacguggcagaucgagaaggcgucacugauagaagucaagaccugccuguggcccaagacccacacccuuuggucuaacgggguguuggagucucagaugcugauccccaaaucuuacgccggcccguucagccagcauaacuaccgucagggauacgccacccagaucgccggccccuggcaucucggaaaacuugagaucgacuucggcgagugccccggcaccacagugacuauucaggaggacugcgaccaccgcggccccagccugcgcacuaccaccgcgagcggcaagcucgugacccaauggugcugccggaguugcacgaugcccccacugcgcuuucugggcgaggauggguguugguacgggauggagauccggccacucucggagaaggaggagaacaugguuaaaagccaggucgcugcaggccaggggacauccgagaccuucagcaugggguuguuaugccucacgcuguuuguugaggagugcuuacgccggcgcgugaccagaaagcacaugaucuuggcgguugugaucacacugugugccaucauccugggagggcucacguggauggaccugcuucgcgcucucaucauguuaggcgacacgaugucuggccggaugggggggcagacucaccuggcuaucauggcggucuucaagaugagccccggguauguacucgggguguuccuucgcaagcugacauccagagaaaccgcccucauggucaucgggauggccaugacgacgacgcuuagcaucccgcacgaucugauggagcugaucgacgguaucuccuugggccugauucuccugaaaaucguuacccaauucgacaacacucaagugggcacccuggcccugagccugaccuucauccgcucaaccaugucucucgucauggccuggcggacgauaauggcuguccucuucguggucacccugaucccccugugccguaccuccuguuugcagaagcagucucauuggguggagauuacagcccugaucuugggugcucaggcgcucccggucuaccuuaugacgcuaaugaagggggcgucgaagcggagcuggccccucaaugaagggaucauggcagucggucuugucucgcugcucggcucagcccucuuaaagaacgacgugccgcucgccggacccaugguggccggcgggcugcugcucgcugcguauguuauguccggcucaagcgccgaucugucucuggagaaagccgcaaacguucagugggacgagauggcggacauaaccgggagcucucccauuaucgaaguuaaacaggacgaagacgguagcuuuagcauccgcgacguggaggagaccaacaugaucacgcuccuggugaagcuagcccucauuaccgucagcggccuguacccgcuagccaucccaguuacaaugacccucugguacauguggcaggucaagacccagcgguccggcgcccugugggacguccccagccccgccgccacgcagaaggccgcccugagcgagggaguguacaggaucaugcaaaggggucucuucgggaagacacagguggggguagguauucacauggagggcgucuuccacacaauguggcacguaacccgcggcagcguaauuugccacgaaaccgggagacuggagcccuccugggccgacgugcguaacgacaugaucagcuauggcgggggcuggcgcuuaggugauaagugggacaaagaagaggacgugcagguccucgcgaucgagccggggaagaaucccaagcacgugcagacuaagcccggacuguucaagacccugaccggcgagauaggcgcggugacccuagauuucaaacccgggacguccggcagcccgaucauuaaccggaagggcaaaguaaucgggcuguauggcaacgggguuguuaccaaguccggugacuacgucagcgcuauaacccaggcagaacguaucggggaacccgacuaugaaguggacgaggauaucuuccgcaagaagcgccugaccaucauggacuuacaccccggcgcugguaagaccaagcggauccuaccguccauugugagagaggccuuaaagcggcgccugcgcacccuuauccuggccccgaccagaguaguggcugccgagauggaggaggcacugcggggccuccccauccgcuaccagacucccgcagucaagucggagcacacuggaagggagaucgucgaccugaugugucaugccaccuuuaccacgcgccugcugagcuccacuagaguaccgaacuauaaccugaucguaauggacgaggcccacuucacagaucccucuagcgucgccgcccgcggguacaucagcacucggguugagaugggagaggccgccgcuauuuuuaugacugccacgccccccggggcgacugacccguucccucaaucgaacucccccaucgaggauaucgagcgcgaaaucccugaacgguccuggaacaccggcuucgauuggaucaccgacuaucagggcaagacggucugguucgucccgagcaucaaggccgggaaugacaucgcuaacugccugcgcaaaucgggaaagaaggugauucagcucagccgcaagacauuugacaccgaguaucccaagaccaagcugacugacugggauuucgucgugacgaccgacaucagcgagaugggugccaacuuccgggcggguagagugauagacccccgcagaugucugaagccugucauucuaaccgacgguccggagcgcgucauccuugccggacccaucccagugacccccgccagcgccgcccagagaaggggccgcaucgggcggaacccugcgcaggaagacgaccaauacguguuuucgggcgacccccugaagaacgaugaggaucacgcccacuggaccgaggcaaagaugcuucucgacaauaucuacaccccggaagggaucauccccaccuuguuuggccccgagcgggagaagacucaggcgaucgacggagaguuccggcuccgcggggagcagcgcaagacauucguggaguugaugcgccgaggcgaccuucccguaugguugucguacaaggucgcguccgcaggaaucucguacaaggaucgcgaguggugcuucacuggagagcggaauaaccaaauccuggaggaaaauauggagguggagaucuggacccgcgagggggagaaaaagaagcugcggccucgcugguuagacgcccggguguaugccgacccgauggcccugaaggacuucaaggaguucgcuucuggccgcaagagccugacgcucgauauccugaccgagaucgcgucccugcccaccuaucucucgucgcgcgccaagcuggcccuagauaacaucgucaugcuccacacuacggagcggggcgggcgggcguaccaacacgcgcugaacgagcuccccgagucccucgagacccuuauguugguggcucuccuaggcgccaugacugcagggaucuuccuguucuuuaugcagggcaaggggaucggaaagcucagcaugggccugaucaccauagccguggcguccgggcugcucugggucgccgagauccagccccaguggaucgccgccuccaucauccuugaguucuuucugauggugcuccugaucccugagcccgagaaacagcgaacgccccaggacaaucagcugauauacguuauccucacuauccugaccaucaucggccugauagcggcgaaugagaugggucugauagagaagaccaagaccgauuucggcuucuaccaggucaagacggagaccaccauacuggacguggaucugcgaccagccucggccuggacuuuauacgccgucgccacaacuauccucaccccgaugcugcggcacacgaucgagaauacgagcgcuaauuugucccucgccgcuaucgccaaccaagccgccguacucauggggcucgggaagggcuggccccuucaucgcauggaccuagggguuccgcuccuggccaugggcugcuacucucaggugaaucccacgacucugacggccucccuggucaugcuuuuggugcacuacgccaucaucgggccgggccuccaggcgaaggccacgcgggaagcccagaagcgcaccgcugccggcaucaugaagaaccccaccguggacgggaucaccgucaucgaucuggaacccaucagcuacgaccccaaguucgagaagcagcugggacagguaaugcuccuggugcugugcgcaggccagcugcuccugaugcggacgaccugggcguucugugaggucuugacccuggccacggguccgauacuaacgcucugggaggggaacccgggacgcuucuggaacaccaccaucgccgugucaaccgccaacaucuucagagguuccuaucucgccggggcuggucucgccuucagcuugauuaagaacgcccagacuccucgccggggcaccggcacgaccggggagacgcugggcgagaaguggaaacgccagcuuaacucacucgaccggaaagaguucgaggaguauaagcgcuccggcauccuggaaguggaccgcaccgaggccaagagcgcgcugaaggauggguccaagaucaaacacgccgugucaagaggcucgagcaagauccgguggaucguagagagaggcauggugaagcccaaaggcaaagucguggaucucgguugcggccgcggugguuggagcuacuacauggccacccucaagaacgucaccgaaguuaagggauacacgaaaggcggaccuggucacgaggagcccauccccauggccacguacggcuggaaccuggugaagcuucacuccggcguggacgucuuuuacaagccuacagagcaaguugauacucugcucugcgacauaggggagagcuccagcaacccgaccaucgaggagggccgcacucuucgcguccugaagauggucgagcccugguugucaagcaagccagaauucugcauaaaggugcugaaccccuacaugccuaccgugaucgaggaacuugagaaacugcagcggaagcacgggggcaaccugguccgcugcccgcuaucccggaacuccacccacgagauguacuggguauccggcgcaagcgggaacaucguguccagcgucaacacuacguccaaaaugcugcugaaccgcuucacuacgcggcaucgcaaaccaaccuacgagaaggacguggaucucggcgccgggacucggagugucuccaccgagaccgagaagccagacaugaccaucauuggccgccgacugcagcgccugcaggaggagcacaaagaaacguggcacuacgaccaggagaauccguaccggacuugggccuaucacgggaguuacgaggcccccucaaccgguucggccuccagcauggugaacggcguggucaaguuacugacgaagccaugggacgugaucccgauggugacccagcuggcgaugaccgauaccaccccuuucgggcaacagagagucuucaaggagaaggucgacacccggacgccccagcccaagccgggaacucgaaugguaaugaccacgaccgccaauuggcucugggcccugcuggggaagaagaagaacccccggcucugcacuaaagaggaguucaucagcaagguccgagcgaacgcagcgaucggagcaguauuccaagaggagcaaggguggacaagugccagugaggcagugaacgacucccgguucugggaacugguggacaaggagagggcguugcaccaggagggaaagugcgagucuugcguauacaacaugaugggcaagcgggaaaagaagcucggggaguucggucgcgccaaggggucccgcgccaucugguacauguggcuaggcgcccgguuucuggaguucgaagcccuuggguuucugaacgaagaucauugguuuggccgcgagaacagcugguccggcguggagggggagggucugcacaggcucggguacauccuagaggagaucgacaaaaaagacggcgaccuaauguaugcggacgauacggccgguugggacacaaggaucaccgaggacgaccuccaaaaugaggagcugaucaccgagcagauggcaccccaccacaagauacucgccaaagccaucuucaaacuaacguaccagaacaaggucgugaagguucugcggccgaccccgcgaggggcggucauggacauuauuucacggaaggaccaacgcgguucaggccaggugggcacguacgggcugaacaccuucaccaacauggaggugcagcucauccggcaaauggaagccgagggcgugaucacacaggaugacaugcagaaccccaagggacugaaggagcgaguggagaaguggcuucgggagugcgggguugaccggcucaaacguauggccaucagcggcgacgacuguguagugaagccacuggacgagcgcuuugcaaccucccuccuguuccugaacgauauggguaagguacggaaggauaucccccagugggagccaagcaaaggcuggaaaaacuggcaggaaguccccuuuugcucccaccacuuccauaagaucuucaugaaggacgggcgcagccugguugugccgugccggaaccaagaugagcucaucggccgcgcccggaucucccagggcgcuggauggucgcugaaggagaccgccugucuggccaaggccuacgcucagauguggucccucauguacuuucacaggagggaccugaggcuggcuagcauggccauauguagcgcagucccaaccgagugguucccgacaucccgcaccacauggucuauccaugcgcaccaccaguggaugaccaccgaggacaugcucaaagucuggaaccggguguggaucgaggacaaccccaacaugaucgauaaaacccccguccacuccugggaggacauuccuuaccugggcaagcgagaggaccuauggugugggucucugauaggccuguccagccgggccaccugggcgaagaacauccacaccgcuaucacccagguccggaaccuuaucgggaaagaagaguacauggacuauaugccggugaugcgacguuacuccgcacccucggaaagcgagggcguccucuga

SEQ ID NO: 26337 - RNA, 9867 nt, Artificial Sequence
  derived and/or modified CDS sequence (opt11) from DENV-4__KU523871__SS-prME
ucgaccaugacccuauugugcuuaauaccgacaguaauggccuuccauuuaagcacacgggauggagaaccucugaugauaguggcaaaacacgaacgagggcgcccgcugcuauucaaaacgacggaaggaauuaacaaaugcacccugauagcaauggacuuaggcgaaaugugcgaagauacagucaccuacaaaugcccccugcugguaaacaccgaacccgaagacauagacuguugguguaacuuaacauccacaugggucauguacgggacgugcacacaaaauggggaacgccgaagagaaaagagaagugucgcucucacaccacacuccgggauggggcuagaaacacgagcagaaacauggaugucaagcgaaggggcguggaagcacgcacaacgagucgaauccuggauacugcgaaacccaggguucgcacuccuggcgggguucauggcauacaugaucggacaaaccggcauacaacgcauaguguucuucguacuaaugauguugguugccccaucguaugguaugagaugcguggguguaggcaaccgcgacuucgucgaaggcguaagcggaggggcaugggucgaccugguccuagaacacggcggaugcgucaccacaauggcucagggaaaaccaacgcuggacuucgaacugacgaagacaacugcgaaagaaguagcacuauuacguacguacugcaucgaggccucaaucucgaacaucacaacagccaccagauguccuacgcaaggggagccguaucuaaaagaggagcaagaccaacaauacauaugccgaagagacgucguagacagagggugggggaauggcugugggcuauucggcaagggagggguagucacgugcgccaaguuuagcuguucagguaaaauaacaggaaaucuugugcaaauagagaaucuggaguacacagucgucgucaccgugcacaacggagauacccaugcagucggaaacgauacaucuaaccacgguguaacagcaaccauaacaccaagaucccccucagucgaaguaaaacucccggauuacggcgaacugacccuagacugcgagccuagaagcggaauagauuucaaugagaugauacucaugaagaugaaaaagaagacguggcuuguacacaagcaaugguuccucgaccucccgcugccauggaccgcaggcgcagacaccucggaaguacacuggaaccacaaagagcgcauggucacguucaaggucccucaugccaagaggcaagacguuacagucuugggcucccaagagggagcgaugcacucagcguuagccggggccacggagguagacuccggagacggaaaccacauguucgcgggacaucuaaaauguaaaguacguauggagaagcugaggaucaaggggaugucuuauaccaugugcagcgggaaguucagcaucgacaaagaaauggccgaaacccaacacgggacgacuguagucaagguaaaauacgaaggcgcaggagcucccugcaaaguaccgauugagaucagagauguaaacaaggaaaaaguaguaggacgaaucauuaguuccacaccguucgcggagaacacaaacucggucaccaauaucgaacuagaaccgccauucggcgauagcuacauaguuaucggcgucggagaaagcgcucucacucuucauugguucaggaagggaucgagcaucgguaagauguucgaauccacauaccgcggcgcgaagcggauggccauccuaggcgaaaccgccugggauuuuggaagcguggguggacuauucacuucccuuggcaaggcgguucaccaaguguuugggucugucuauacuacaauguucggaggcgucucauggaugguucgaauacuuaucggauucuuaguacucuggaucgguacaaacucgagaaacacaagcauggcaaugaccuguauagcgguagguggcauaacccuguuccuaggcuucacaguacaagccgacaugggaugcguagugagcugguccggcaaggaacuaaagugcggcucaggaauauucguuguagacaauguccauaccuggacagaacaauacaaauuccaacccgagagccccgccagauuggcaucggcaauacucaacgcacacaaggacggagucugcggcauccgcucaacgacaagacuggagaaugugauguggaagcaaauuaccaacgaacucaacuaugugcugugggaagguggccacgaccuaacuguaguggcgggagacgucaaagggguauuaaccaggggaaaaagggcgcuaacaccaccaguaaacgacuuaaaguacuccuggaaaacguggggcaaagcaaaaauuuuuacucccgaagcgagaaacaguacauucuuaauugaugguccggauacaagugaaugccccaacgagagacgggccuggaacuucuucgaaguugaagacuauggauucggcauguucacuacuaacauuuggaugaaauucagagagggcuccagugaaguaugcgaucaccgauuaauguccgccgccauuaaggaccagaaagcaguacacgccgauaugggcuauuggauagagucguccaagaaccaaacauggcaaauagaaaaagcgagccuaauagaaguaaagacgugccuauggccgaaaacgcacacgcuguggagcaacggaguccuagaaucccaaaugcuaauuccgcggucguacgcgggaccauuuagucagcacaacuacaggcagggcuacgcgacacagacugucgggccuuggcaccugggaaagcuggagaucgauuucggggaaugcccgggaaccacggucgccauacgggaagacugugaccaucgaggaccuucgcugcgaacgaccacagccagcggcaagcucguuacacaaugguguugucguagcugcacaaugccgccccugcguuuccucggggaggacggcugcugguauggcauggaaauuagaccccuaucagaaaaggaggaaaacaugguaaagucccaagcaacggccggccagggcacguccgagacuuuuagcaugggacuccuuugccucacccucuucguagaagaaugccugagacgacgagucacgaggaagcacaugauacuggucguaguaaucacauucugcgcaaucauacucggaggucuaacguggauggaccucuuacgagcccucauaaugcucggggauacaaugaguggaaggauaggugggcagauacaucuagcaauaauggcuguguucaagaugagucccggauauguacuaggcguguuccuucguaaauugacaagccgagagaccgcucucaugguuauagggauggcuaugacaaccguauucuccaucccgcacgaucucauggaguugaucgacggcaucagccucggucugauacuacuaaagauugugacacacuucgacaacacucaaguggggacgcucgcccuaucacucaccuuccuacgcagcacuacccccuuaguaauggccuggcgaacgaucauggcaguuuucuuuguagucacgcucauaccgcugugccgcacgagcugccuacaaaaacagagccauuggguagaaauaacagcgcuaauacuaggcgcccaggcacuccccguguauuugaugacccucaugaagggagccagcagacgauccuggccgcucaacgaagguaucauggcaguggggcuaguaagccuauuaggcucagcacugcucaaaaacgacgucccccuggcagggccgauggucgcaggcggccuacuacuugcagcguacgucaugucgggaagcucagccgaccuaagucuggaaaaagcagccaacguacaaugggaugagauggcggacauaaccggaucuucacccauuauugaagucaagcaagacgaagauggcagcuucucgauucgggacgucgaagaaacgaacaugaugacacuacugguaaaacuugcucuaaucacagucuccggauuguacccccucgccauaccagugacaauggcccucugguacauauggcaaguaaagacacaaagaaguggugcgcuaugggaugucccaucccccgcagcaacccaaaaggcaacacugucggagggcguguaucgaauaaugcaacggggacuauucggcaagacgcagguaggcguaggcauacacauggaggggguuuuucacacgauguggcauguuacccgcgguucgguaauaugccacgaaacaggacgacuggaaccgagcugggccgacguacguaaugacaugaucagcuaugguggaggguggaggcuuggcgacaaaugggacaaagaggaggacgugcaagugcuggcgaucgagcccggcaaaaauccgaagcacguccaaaccaaaccaggucuguucaaaacauuaacgggcgaaaucggagcgguuacgcucgacuucaagcccggaacgagcggcucgccaaucauaaacaagaaaggcaagguaaucggacuuuacgggaacggagucgugacaaaaaguggcgacuacgugagcgccaucacacaggcugaaagaaucggcgagccagacuacgaaguagacgaagacaucuucagaaagaagcgccugaccauuauggauuuacauccaggugcgggaaaaacgaagagaauacuaccguccauuguccgagaagcgcuuaagcggagacuccgcacgcucauccucgcacccacacggguaguagcagcagaaauggaagaagcccuacgaggcuugccgaucagauaccagacaccagcggucaagagcgaacacacaggcagggagauaguagaucugaugugccacgccacauucaccacacgacugcuuuccuccacccgaguuccaaacuacaaccuuaucguaauggacgaggcacacuuuaccgaucccugcagcgucgccgcucgcggcuacauaagcacacgcgucgagaugggugaagccgcagcgaucuuuaugacagcgacaccaccgggggcgaccgauccguuuccgcaaucgaacucgccaaucgaagacaucgaacgugaaauaccggaaagguccuggaacacugguuucgacuggaucacagacuaccaaggaaagacugucugguucguuccgagcauaaaagcgggcaacgacauugcaaacugucugagaaaauccggaaagcgaguaauacagcuaucacgcaagaccuucgauacggaauacccaaagaccaaacuaacagacugggacuucgugguaacaacggacauuucagagaugggagccaacuuccgcgccgggcgaguaauagacccaagacggugucuaaaacccguaauacuaaccgacgggccagagaggguuauauuagcaggcccaauacccguaacuccagccagugcagcacaaagaagaggccgcauaggaaggaaccccgcgcaagaagacgaccaauauguguucucuggggacccacuuaaaaaugaugaagaccacgcccauuggaccgaggccaaaaugcugcuggacaauauauacacgccagagggaaucauuccaacccuuuucgggcccgagcgcgagaagacacaagcuauagauggggaguuccgccuccggggcgagcaaagaaaaaccuucgucgaacucaugaagagaggagaccugccagucuggcucagcuacaagguagccagugcggggauuaguuacaaggacagggaguggugcuucacgggggaacggaacaaucagauccuggaagagaauauggagguggagauauggaccaaagagggcgagaaaaagaaacuacggccuaaauggcuagacgccagagucuacgcagaccccauggcccugaaagacuucaaagaguucgcgagugggcgaaaauccauaacgcucgacauacucaccgagaucgcaucacuacccaccuaccucagcagcaaggcgaaacucgcacucgauaacauuauuaugcuccauacuaccgaaaaagggggacgagcauaccagcaugcccuaaacgaacugccagagagcuuagagacccucaugcucguggcgcuucuuggggcgaugaccgccgguauuuuucuguuuuucaugcaggggaagggaauaggaaaguuaagcauggggcucaucgccauugcgguggcaucaggauugcuaugggucgcggagauucagccccaguggauagcggccagcauaauccuggaguucuuucuaaugguccuucuaauacccgaaccggagaagcaaagaacaccacaggauaaccagcugauauauguaauucuaaccauuuugacgauaaucggccugauagcggcgaacgagauggggcuaaucgagaagacaaagacggacuucggauucuaccaagugaaaaccgagacuacuauacuugauguagaccuaaggccugcaagcgcauggacacucuacgcaguagccacuacgauccugaccccuaugcuccggcacacaaucgaaaacacaagugcgaaccucucgcuggccgcaauagcgaaccaggcugcagugcuaaugggacuagggaaaggauggccauuacacagaauggaccuggguguuccauuauuagcgauaggcuguuacucucaagucaacccaaccaccuuaaccgcgucgcugguaaugcuccugguccauuacgcaaucaucggcccagggcuccaggcaaaagcgaccagagaagcccagaaacgaacagccgcaggcaucaugaaaaaucccacagucgacggcauaacaguaaucgaucuggagccaauuucguacgaucccaaauucgaaaagcaacuaggccaagugauguugcuaguacuaugcgcaggccagcuccuguuaaugagaacaacaugggcacucugcgaagugcuaacacucgccacaggaccagcaaugacccugugggaagguaacccaggccgcuucuggaauacgaccaucgccgucagcacagccaauauauucagaggcucguaccucgccggugcaggccuagcuuuuucccuaaucaaaaacgcacaaacgccucgaagggggacaggaaccacgggagaaacgcuaggugaaaaauggaaaagacaguuaaauagccuagaucggaaggaguucgaggaauacaagcgcagcgguauacuagaagucgaccgcaccgaggcaaagagugcccugaaggacggaucaaaaaucaaacaugcugugucccgcgggagcucgaagauaagauggaucguagagagggggauggucaaaccgaaagguaaggucguagaccuaggcugcggcagagggggcuggucguacuacauggccacacugaaaaacguaaccgaggucaagggguacacgaagggcggcccagggcacgaggaaccaaucccgauggcuacguacggcuggaaccuagucaagcuacacagcgguguggacguauuuuacaaaccaacagaacagguagacacccuccucugcgacaucggggaaucuagcagcaaccccacuauagaagaagggcgcacucuccgcguguuaaagaugguugagccaugguuaagcuccaaaccagaguucugcauaaaaguucugaacccauacaugccgaccguuauugaggaguuagaaaaacuccaacggcgccacgggggcagucuggugagaugcccauuaucccgcaauuccacccacgaaauguacuggguaaguggggccuccggaaacaucgucagcucaguaaacacaaucucgaaaaugcuccuaaaccgauucacaaccagacaccgcaaaccuacauaugaaaaggacguugaucugggcgcaggaaccaggagcgucucaacagaaaccgaaaaacccgacaugaccauuaucgggagacgacuccaaagacucagggaggaacacaaggaaacauggcacuacgaucaagaaaauccauacaggacgugggcauaucauggaucauacgaagcuccaucgaccggcagugcuaguuccauggugaacggcguugucaaacuacucacaaagccuugggacgucgucccaauggugacucaacuggccaugaccgacaccacgccuuuuggacagcagagagucuucaaggaaaaggucgauacccgcaccccacaacccaaacccggaacuagaaugauaaugacuacaacugcgaacugguuguggacccuccugggcaagaagaaaucaccacgucuaugcacccgagaagaguucaucuccaagguacgaagcaaugcugccauaggagccguuuuccaggaagaacagggauggacaucggccuccgaagcagucaacgacagucgcuucugggagcugguagacaaagagcgcgcacuucaccaagaaggcaaaugugaaagcuguguauacaacaugaugggcaagcgggagaagaaacucggagaguucggccgagcgaaaggaagcagggcaaugugguauauguggcugggggcaagauuucuggaguucgaggcucuaggguuccucaacgaggaccacugguucucacgcgagaacuccuggucgggcguggaaggcgaagggcuacaccgacucggauacauucuugaggacauagacaagaaggauggugaucucauauacgccgaugacacggcuggcugggacacccggaucacggaagacgaccuuuuaaacgaagaacugaucaccgaacaaauggcaccacaccacaagacacuggcaaaagcaaucuucaagcuaaccuaccaaaacaaggucgucaagguccuucgcccaacacccaaaggcgcaguaauggacaucauaucgaggaaagaccaaagaggcaguggccaggucgggacguacggauuaaauacguucacuaacauggagguacaacucauccgacaaauggaagcagagggcguaaucacgcaagacgacaugcaaaacccuaaaggacugaaagaacgagucgagaaaugguugacagaaugcgggguagaccggcucaagcggauggccauaagcggggaugacugcguagugaaaccacuagacgaaagauucuccacaucacugcuauuccucaacgauauggggaaagugaggaaggacauaccucaaugggaacccucgaaagguuggaaaaacuggcaagaggucccauucugcagccaccacuuccacaagaucuucaugaaagacgggagguccuuggucguacccugccgaaaccaagaugagcugauagggcgagcgcggauaagccaaggggcaggauggucccugcgcgagacggcuugcuugggaaaagcguaugcacagauguggagccuuauguacuuccacaggcgggacuuaaggcucgcaagcauggccauaugcagcgcaguaccgacggagugguucccuacaagucggacuaccuggagcauccacgcccaccaccaguggaugaccaccgaagauaugcugaaggucuggaaccgcguauggaucgaagauaacccuaacaugacagacaaaacgccuguuuacucaugggaggauaucccauaccucggaaaacgagaagaucugugguguggcagucugaucgggcuaucgagccgggcgacgugggccaagaacauccacacggcgauaacacaaguaagaaaccucaucggcaaagaagauuacguagacuacaugccgaucaugaaacgcuacagcgcgcccagugagucagaaggcguccucuaa

SEQ ID NO: 26338 - RNA, 9867 nt, Artificial Sequence
  derived and/or modified CDS sequence (opt11) from DENV-4__HQ332175__SS-prME
ucuaccauuacccugcucugccugauucccacuguuauggcuuuccaccuuucaacucgugacggggagccccucaugaucgucgccaaacaugaacgggggcgcccgcugcuguuuaaaaccaccgagggcaucaacaaaugcacgcucauugcgauggaucugggugagaugugcgaggacaccgugacauauaagugcccccugcucgugaacacagagcccgaggauaucgacuguugguguaaccugacuagcaccugggucauguauggaaccugcacgcagagcggggagcgccgccgggagaagcggucgguggcucucacgccgcacagcgggaugggucuugagacccgugccgaaaccuggaugagcuccgaaggggcuuggaagcacgcucagcgugucgagucauggauccugaggaaccccggcuucgcgcugcuggccggguuuauggcuuacaugauaggccaaaccgggauacagcgaacggucuucuucgugcucaugaugcugguggcccccucuuacgggaugcggugcgucgggguggggaaucgcgacuucguggaaggcgucagugggggcgcguggguagaccucguguuggagcacggcggcugcguuaccaccauggcccagggaaagcccaccuuggacuucgagcucacgaagacaacggcgaaagaggucgcuuuauugcguacuuacugcaucgaagcacucaucuccaauaucacgaccgcgacacgcugcccgacccagggggagcccuaccugaaagaggagcaggaccagcaguacauuugccggcgcgacgucguugacaggggaugggggaauggcugcggacuguucgggaaaggcggggugguaacaugcgcgaaauucagcugcuccgguaagaucacggggaaccucgugcagaucgagaaccuggaauacaccguggugguuaccgugcacaacggggacacacacgcaguugguaacgacaccagcaaccaugggguaacugccaccaucacgccccgauccccgaguguggaggugaagcugccggacuacggagagcuuaccuuagacugcgagccacguaguggcauugacuuuaacgaaaugauacuaaugaaaaugaagaaaaagaccuggcucgugcacaagcagugguuccuggaucuuccgcuccccuggaccaccggcgcagacacgagcgaggugcacuggaacuacaaggagcgcauggucaccuuuaaggugccgcacgccaaacgacaggacgugaccguccuggguucgcaggaaggagccaugcacagcgcacuggcuggugcaacagagguggacagcggagauggcaaucacauguucgcugggcaucucaaguguaaggugcgcauggaaaagcugcgcaucaagggcauguccuacacgaugugcaguggcaaauuuaguaucgacaaagagauggccgagacccaacaugggacgaccguggugaaggucaaguacgagggagcgggcgcccccugcaagguccccaucgagauccgggacgugaauaaagaaaagguagucggcagagugaucagcgccacgccccucgcggaaaacacuaauuccgugaccaacaucgagcuggagccgccuuuuggggacagcuacauuguuauuggggugggcaacuccgcccugacccugcauugguuccggaagggcagcucgaucggaaaaauguucgagucgacuuacagaggggccaagcggauggccauacugggagagacagcgugggauuucgggucuguaggaggccuguucaccagccuggggaaggccguccaccaaguguucggcuccguguacacaacuauguucgggggcgucuccuggaugauccggauucucauuggauucuugguccuguggaucggcacuaacuccagaaauacgagcauggccaugacgugcauagcgguaggcgguaucacgcuguuccucggauucacaguccaggccgacaugggcugcguaguaucgugguccggucgggagcuuaagugcgguucuggcauauucgucguggacaauguucauacauggaccgagcaauacaaguuccagcccgagagccccgccaggcuggccagcgcuauccucaacgcccauaaggacggcgucugcggcauccgcuccacuaccaggcuggaaaaugugauguggaagcagauaaccaacgagcugaacuacgugcucugggagggcgggcaugaccuaaccguaguggccggggacgugaaggguguccugacgaaagggaaacgcgcuuugaccccgccugccagcgaucuaaaguacuccuggaagacaugggggaaagcgaaaaucuucaccccggaagcacggaacucaacguuucugaucgacggccccgauaccucugaguguccuaacgaaaggagagccuggaauagcuucgagguggaagauuacggguuugggauguucacuacaaauaucuggaugaaguucagggagggcaguagcgagguaugcgaccacaggcucaugagcgccgccaucaaggaccagaaggccguccacgccgacaugggcuacuggauugagagcucuaagaaucaaacguggcagauagaacgcgccucccuaaucgaggugaagaccugcuuguggccaaaaacgcacaccuugugguccaauggcgugcuggagagccagaugcucauccccaaguccuacgcaggucccuucagccagcacaacuacaggcagggguaugccacccagacgguuggcccuuggcaccucgggaagcuagagaucgacuucggagaaugccccggaacuaccguaacaauccaggagaacugcgaccaucguggacccucccugaggacuaccaccgccagcggcaaacucgugacgcaguggugcugucgguccuguacgaugccgccucugcgguuccugggggaggacggcugcugguauggcauggaaauccggccccucucagagaaggaggaaaauauggucaagagccagguaaccgcaggccagggcacguccgaaaccuucucuauggggcugcuuugccuuacgcuguuugucgaagagugccugcgccggcgcguuacacgaaagcacaugauuuuggccguggugaucacccugugugccauaauccugggcgggcugacauggauggaccugcugcgcgcccucauuaugcugggcgauacgaugaguggacggauaggaggccagacccaccuggccauaauggccgucuucaagaugagccccggcuaugugcucggggucuuccugcgaaagcugaccucccgggagaccgcguuaauggugaucggcauggcaaugacuaccacccugagcaucccgcacgaucuaauggaacucaucgacggaaucagccugggccugauucugcugaaaaucgucacccaauucgauaacacgcaggucgguacguuggcucucucccugaccuucaucagauccaccaugucauugguaauggccuggcggacaaucauggcgguucucuuuguggugacccugaucccacuaugccgcaccuccugccuucaaaagcaaagccacuggguggagaucacugcgcugauacuuggcgcccaggcacuucccgucuaccugaugacguuaaugaagggggccucucggcgcagcuggccccuaaacgagggaauuauggcgguggggcuggugagucugcucggcagcgcccugcugaaaaacgacgucccacuggccggcccaaugguggccggaggcuuacuucucgccgcguacgugauguccggguccucagucgauuugagccuggagaaggcggccaacgugcagugggacgaaauggccgacaucaccggcagcuccccuaucaucgaggugaagcaggaugaagauggguccuucuccauccgugacguagaggaaacaaacaugauaaccuugcuugugaaacuugcccucaucacugugagcggcuuauacccucuggcgaucccgauuacgaugacccucugguacauguggcaaguaaagacccagcgaucgggcgcccugugggaugugccgagccccgccgcgacccaaaaggccgcguuguccgagggggucuaccggaucaugcagcgaggccucuuuggaaagacacagguaggaguagggauucacauggaaggcguauuucauacuauguggcaugucacaaggggaagugugaucugucaugagaccggaaggcuagagcccucaugggccgacgugcgaaaugacaugauuagcuacggagggggcuggcgguuaggggacaagugggacaaggaggaagacguccagguucuugcuaucgagccggggaagaaucccaaacaugugcagacgaagccaggccuguucaaaacccugaccggagagauuggugccguuacccucgacuucaagcccgggaccagcggcagcccgaucaucaaccgcaagggcaaagugauugggcuauacggcaauggaguugucacuaaguccggugacuacgucagcgccauuacccaggccgagcgaauaggggagccugacuaugagguggacgaggacaucuuccgcaaaaagcgguuaaccauaauggacuuacauccgggggcagguaaaacgaagcgaauccuaccgucgauagugagggaggcccugaagcguaggcugcguacucucauccuugcccccacccgcguuguggcagcagagauggaggaggcgcugcguggccuccccauccgguaccaaacccccgcggucaagucggaacacaccgggcgggaaaucguagaccugaugugucacgccaccuucacgaccagacugcucucuagcacuagggucccuaauuauaaccuaaucguuauggacgaggcccacuucaccgaucccagcagcguugccgcccggggguacauaagcacuagagucgagaugggcgaggcggccgccaucuucaugaccgccacaccgccuggggccaccgacccauuuccgcaaaguaauucgccgauugaagacaucgagcgggagauccccgagcgcucauggaacaccggcuuugacuggauaaccgacuaccagggcaagacuguuugguucguaccuagcaucaaggcugggaacgacauagccaacugccugcgcaaguccgggaagaagguuauacaacucagccggaagaccuucgauaccgaauaccccaagacgaagcugacggacugggauuucguggugaccacugacaucucagagaugggugcaaacuuuagggccggccgggucaucgacccccgcagaugucugaaacccgugauccucacugacggcccggagcgcguuauacuggccggucccauccccgucacuccugccucugccgcacaacgccgaggccggauagggcgcaauccagcacaagaagaugaccaauacguguuuucgggcgacccccucaagaacgaugaggaccaugcacacuggaccgaggcaaaaaugcuccuggauaauaucuacacaccagaaggaaucaucccuacccuuuucggaccggaacgugagaagacgcaggcgauugauggagaguuccgccuccggggugaacagagaaagaccuucguugaguuaaugcgucgcggagaccugccaguauggcucagcuacaagguggccuccgccgggaucagcuauaaggauagagaguggugcuucaccggugagaggaacaaccaaauccuggaggagaacauggagguggaaaucuggacccgcgagggggagaaaaagaagcugcgccccaaguggcucgaugccagaguguacgcagacccaauggcgcugaaggauuuuaaggaguucgccucaggaagaaagagcauaacacucgauauccucaccgagauagccaguuugcccacguaccuuaguucacgggccaagcuagccuuagacaacauugugauguugcacaccaccgaacggggagggcgugcauaucagcaugcucucaacgaacuaccugagucuuuggagacgcucaugcugguggcccuccucggcgcgaugacggcugggaucuuccucuucuucaugcagggcaaggggaucggcaaguugucaaugggccucaucaccauagccgucgccuccggcuugcuguggguggccgagauccaaccccaguggaucgcggcgagcaucauuuuggaguucuuccuaauggugcugcucaucccggaaccagagaagcagcgcacaccccaggacaaccaguugauauacgucauccugacgauccucaccauaaucggcuugaucgcagcuaaugagauggggcugauugagaaaacuaagaccgauuucggcuucuaccaggugaagaccgaaaccaccauuuuggacguggaucuccggcccgccuccgccuggacccuguacgcggucgccacuaccauucucacacccaugcuccgucauacaauagagaauacgagcgcgaacuuaaguuuagcggccauugcgaaccaggcugccgugcugaugggccugggcaagggcuggccauuacaccgaauggacuuggggguaccccuguuagccaugggcugcuacagccaagucaacccgaccacgcugaccgcuucccuagugaugcuccugguccacuacgcaauaauugggccgggacugcaggcgaaggccacuagagaagcccagaaacggaccgcagccggcauaaugaaaaaccccacagucgacggcaucacaguaaucgaucucgaacccaucucuuaugaccccaaguucgaaaagcagcuaggccaggugaugcugcugguccuuugcgccgggcaacugcucuugaugcggacaacaugggccuucugcgaggugcucacguuggccaccgggcccauauugacgcugugggaggggaaccccgggcgcuuuuggaauacuacuauugcagucucuacggcaaacauuuuccgggguuccuaccuggccggggcaggccuugccuucagccuuaucaagaacgcacagacucccaggcggggcaccggcaccaccggcgagacccugggcgaaaaguggaaaaggcagcugaacucucuugaccggaaggaguucgaggaauauaagcgauccgguauuuuggaggucgaccgcacagaggccaaaucagcguuaaaggacggcuccaagaucaagcacgccgugagcaggggcuccucuaaaauacgguggauuguggagcgcgggauggucaaacccaagggaaagguggucgaccucggguguggccgcggcggcuggucguauuacauggccacccugaagaacgucacagaggugaagggcuacacaaaaggagggcccgggcacgaggagccgauucccauggcgacguacggcuggaaccuugugaagcugcauagcggcgucgauguguucuacaagcccacggaacagguggacacccucuuaugugacauaggagagaguaguagcaacccaacaauagaagagggucggacgcugcgcgugcucaagaugguggagcccuggcuuuccaguaagccagaguucugcaucaagguacugaaccccuacaugccaaccgugaucgaagaacucgagaaguugcagcggaagcacggcggcaaucuagugcgcugccccuuaucccguaacucaacccacgagauguacugggucuccggagcguccgguaacaucguuuccagcgucaacacaacguccaagaugcuccugaacagguucacgacccggcaccgcaagccgacauacgagaaagacguugaccuaggugccgguacacggucuguguccacggaaaccgagaagcccgacaugacgauuaucggccgccggcuccagagguuacaggaggagcacaaggagaccuggcacuacgaccaggagaaccccuaccggacuugggccuaccacggguccuacgaagcacccuccaccgggucggcuuccagcauggugaacggagucguuaagcugcugaccaaacccugggaugugaucccuauggucacccagcuggccaugaccgauaccacccccuucgggcagcagaggguguuuaaagagaaaguagacacgcggacgccccaacccaagccuggcacccgcaugguaaugacgacgacagcgaauuggcugugggccuuacucgggaaaaagaaaaacccacgccugugcaccagagaagaguucauuuccaaggugcggagcaaugcugcgaucggagcuguguuucaggaggagcaaggguggacguccgccagcgaggcagucaacgacagccgcuucugggagcuggucgacaaggagcgggcguuacaccaggagggcaagugcgagagcugugucuacaacaugauggguaagcgugagaaaaaguuaggggaguucggacgcgcuaaggggagcagagcaaucugguacauguggcucggugcacgcuucuuggaguucgaggcucugggguuccucaacgaagaccacugguucggcagagaaaauucauggagcggaguagaaggggaaggauuacauagguuaggguacaucuuggaggagaucgacaagaaagacggcgacuugauguacgcagacgauacagccggcugggacaccagaaucaccgaggaugaccugcagaacgaggagcucaucaccgagcagauggccccucaccacaagauccuggcgaaggcgauuuucaagcucaccuaccaaaacaagguggugaagguccuccgccccacgccgcggggcgcagugauggacaucauuucacgcaaggaucagcgaggguccgggcaaguggguaccuacgggcugaacaccuucacgaauauggaaguccagcugaucagacagauggaggccgaaggugugaucacacaggaugacaugcagaacccaaagggacucaaggagaggguggagaaguggcugcgugagugcgggguugaccgacugaagagaauggcgaucucgggcgacgacugcguggugaagccccucgacgagcgcuucgggaccagccugcuguuccucaacgauaugggcaagguacgcaaggacauaccccaaugggagcccuccaaggguuggaagaacuggcaggaggugcccuucuguagccaucacuuucacaagauauucaugaaggacggccguucucuggucguccccugucgcaaccaggaugagcugaucggccgggcccgcaucagccagggggcggguuggucccuccgcgaaacugccugccuggguaaagccuacgcgcagauguggagccucauguauuuccaucggagggaccuucggcuggccaguauggcgaucugcuccgcagugccgacugaaugguucccaacaagucguaccacauggucaauccaugcgcaucaccaguggaugaccacagaagacaugcugaagguauggaaucgggucuggaucgaggacaaccccaacaugaucgacaagaccccaguccauagcugggaggauaucccuuaccuuggcaagcgcgaagaccuguggugcggcaguuuaaucggcuugucaucccgggcuaccugggcuaagaacauacacaccgcgauugcgcaagugagaaaccucaucggcaaggaggaguacguggacuacaugccaguaaugaagcgguacucggcacccuccgagagcgaggggguucuguga

SEQ ID NO: 26339 - RNA, 9867 nt, Artificial Sequence
  derived and/or modified CDS sequence (opt11) from DENV-4__HQ332172__SS-prME
aguacgauuacccugcucugucugauacccacggugauggccuuucacuugagcacccgcgacggcgagccgcuaaugauugucgccaagcacgaacgugggcgcccccugcuauuuaaaaccacggagggcauaaacaagugcacguugauugcgauggacuugggcgaaaugugugaagacaccguuaccuacaaguguccccuguuggugaauaccgaacccgaagacauugacugcugguguaaucugacaagugcuugggucauguacgguacuugcacccagucuggggagcggcgucgggaaaagcgcagcguagcccugaccccucauuccggcaugggccucgagacgcgggccgagaccuggaugagcuccgagggcgccuggaagcacgcgcagcgcguagaaagcuggauccugcggaacccaggcuucgcccuguuagccggguucauggcguacaugaucggacagaccgggauccagagaacgguuuucuucgugcugaugaugcuaguggcgccgucauacgggaugcgguguguagggguggggaauagggacuucguggagggcgucuccgggggcgcauggguggaccucgugcuggagcacggcgggugcgucacgaccauggcccagggcaagccgacccuugacuucgagcucaccaaaacgacugccaaagagguugcccugcucaggacuuauugcauugaagcgcucaucuccaacaucacgacggcaacccgcugcccuacccaaggggagcccuaucuaaaggaagagcaagaccagcaauacaucugccggcgcgauguggucgaccgugguugggguaauggcugcggccuauucgggaaaggcggaguggugaccugcgccaaguuuuccugcucuggcaagauaacggggaaccucguccagauagagaacuuagaguacaccgugguggugaccguccacaacggugacacccaugcagucggcaaugauacgagcaaucauggugugaccgccacuaucacgcccaggucgccgagcguggaagucaagcuucccgacuacggcgagcugacgcuggacugcgagccccguuccgggaucgacuucaacgagaugauccuaaugaagaugaagaagaagaccuggcucgugcacaagcaaugguucuuggaccucccccuccccuggacuaccggcgcggacaccagcgaggugcacuggaacuacaaggaacgcauggucaccuuuaaagucccacacgccaagcgucaggacgugacgguccuggggucccaggagggcgccaugcacagcgcccuggccggcgcgacggagguggacagcggggacggaaaccacauguucgccgggcauuuaaaaugcaaggugcgcauggagaagcugcgcauaaagggcaugucauacaccaugugcagcggaaaauucuccauagauaaggagauggccgagacccagcacggcaccacugucguuaaggugaaguaugagggggcuggggcccccugcaagguacccaucgagauccgggauguaaauaaggaaaagguggucgggcgcgugaucagugcaacccccuuagccgagaacacgaacuccgugacgaacaucgagcucgagccgcccuucggugacagcuacaucgucaucggcgugggcaacuccgcguugacucugcacugguuucggaaggggagcuccaucggcaagauguucgagucaaccuaccguggggccaaacggauggcgauccucggcgagacggccugggacuucggaucgguggguggccuuuucaccucacuggguaaagccguccaccagguguucggcucugucuauaccaccauguuugggggcgucagcuggaugauuaggauccucauuggguuccuggugcuuuggaucggcacgaacagccggaacacaagcauggccaugacuugcaucgccguuggcgggaucacgcuguuccuuggcuuuacgguccaggcggacauggggugcgugguguccuggagcggccgcgagcugaagugcgggagcggcauuuucguagucgacaacgugcacaccuggaccgagcaguacaaguuccagcccgagucucccgcccgccuggccucggccauccucaacgcccauaaagauggggucugcgggauucgaucuaccacgaggcuggagaacgugauguggaagcaaauuaccaacgagcugaacuacgugcucugggagggggggcacgaccugaccguuguggcgggggacgugaagggcguccugaccaaggggaagcgcgcgcuuacgcccccugccagcgaccugaaauacuccuggaaaaccuggggcaaggccaagauuuucacucccgaagcccggaacagcaccuuccugaucgacggccccgacacgucugagugucccaacgagcgcagagcauggaacagcuucgaaguggaggacuacggguucgguauguucacaaccaacaucuggaugaaguuccgggagggcuccagcgaggugugcgaccaccggcucaugagugcugccaucaaggaucaaaaggcugugcacgcggacaugggguacuggaucgaaucgagcaagaaccagaccuggcaaaucgagagagccucucugaucgaggugaaaacgugccuguggcccaagacccacacccuguggucgaauggagugcuggagagccaaaugcugauccccaaguccuacgccggcccguucagccagcacaacuaccgacagggcuacgcgacgcagacagucggaccauggcaccucgggaaacuugagaucgacuuuggggagugucccggcacgaccgugaccauucaagagaauugcgaccaccgggggccuucccugcgaaccacaaccgccagcggcaagcucgugacccaguggugcugccggagcugcaccaugccgccacugcgcuuccugggggaggauggcugcugguacgggauggaaauccggccccucuccgagaaggaggaaaacauggucaagagccagguaaccgcgggccagggcaccucagagaccuucagcaugggucuccugugccuaacacuguucgucgaggaaugccugcgccgccgcgugacgcguaagcacaugauccucgccguugucaucacucugugugccaucauuuugggaggucucaccuggauggaccugcuucgugcccugauuaugcugggcgacaccauguccggccgcaucgggggccaaacgcaccucgcaaucauggcgguuuucaaaaugagccccggguacguacuuggaguauuccugcgcaaacugacaucccgggaaacggcuuugauggugauuggcauggccaugaccacgaccuugagcaucccgcacgaccugauggaacucaucgacgguaucuccuuggguuuaauccuauuaaagaucgugacccaguucgacaacacacagguugggacauuggcccugucccugaccuuuauccguagcacuauguccuuagugauggccuggcggacgauuauggcggugcucuuugucgugacccucauccccuugugccguaccuccugucuccagaagcaaagccacuggguggagaucaccgcccugauccugggcgcccaggcccuccccguuuaccuaaugacccuuaugaagggggcguccagacguucauggccccucaaugaaggaaucauggccgugggacuggucagucuguugggcagcgcccuguugaagaacgacgucccgcucgccggccccaugguagcggggggccugcuguuggcggccuacgugauguccggcagcagcgccgaucugucccuagaaaaggccgcaaacguccaaugggaugagauggccgacaucacgggcagcucgccuaucaucgaggugaagcaggacgaagaugggagcuucuccauacgugacguggaggagaccaauaugauuacccuguuagucaagcuggcccuuaucaccgugagcgggcuguaucccuuagccaucccaauuacgaugacccucugguacauguggcaggugaagacccagcgcucuggcgcccugugggacguacccagccccaccgccacgcagaaggccgcguuguccgagggggucuaccggaucaugcagcgcggccucuucggaaagacucaggugggugucgggauucacauggagggcguguuccacaccauguggcacgugacccguggcagugucauaugucacgagaccgggcgacuggagcccuccugggcagaugugaggaacgauaugauuagcuacgggggaggguggcggcugggggacaagugggacaaggaggaggaugugcagguauuggcuaucgagccggguaaaaaccccaagcacguucagacgaaacccggucuguucaagacacugaccggcgagaucggcgccguaacccucgacuucaagccggguacgaguggcucucccaucauaaacaggaagggcaaggugaucggucuguacggcaacgggguugugacaaaauccggcgacuacgucagcgcaaucacgcaggccgagcggauuggugaacccgacuaugagguggacgaggacaucuuucgcaagaaacggcugacaaucauggacuugcaccccggcgccggcaagacaaagcgcauauugcccuccaucguacgggaggcucugaagcgccggcuacgcacguugauccucgcucccacucggguaguggcggcagagauggaggaggcucugcgagggcuucccauacguuaucagacgcccgccgugaagagugaacacacaggacgcgaaaucgucgaccugaugugccacgcgacguuuaccacccggcuguuaucuucuacucgcgugccgaacuauaaccugaucguaauggacgaagcccauuucaccgaccccagcuccgucgccgcgcggggguauaucagcacucgcguggagaugggggaggccgcggcaaucuuuaugaccgccacgcccccuggagccaccgacccuuucccccaguccaacagcccuaucgaagacaucgagcgggaaauccccgagcgcagcuggaacaccggcuuugacuggaucaccgacuaccagggcaagacgguaugguucgugccgaguaucaaggccggaaacgacaucgcgaacugccuucguaaauccggcaagaagguaauucaacucagccggaaaaccuucgacacugaguaccccaagaccaaacuuacggacugggacuucguugugaccacagacaucuccgagaugggggccaacuuccgcgccggccggguaaucgaccccaggagaugcuugaagcccgucauccucaccgacgggccggagcgcguaauucuagccggaccgaucccugugacgcccgcgagcgcagcccagcgccgcggcaggauagggcgcaacccggcucaagaagaugaccaguaugucuucucaggcgacccccugaagaacgacgaggaccacgcacacuggaccgaggcgaaaaugcucuuagacaauaucuacacaccagaggguaucauuccaacgcuguucggcccggagcgggagaagacacaggcaaucgauggcgaauuucgccuucggggggagcaacgcaaaaccuucgucgaacugaugcggaggggugaccuccccguguggcucagcuacaagguugccucggccgggaucagcuacaaggaucgugagugguguuucaccggggagcgcaacaaccagauuuuagaagagaacauggaaguagagaucuggacccgggagggggagaagaaaaaauuacgcccaaaauggcucgacgcucgcguauaugcagaccccauggcucugaaggacuucaaggaguucgcauccggucgcaagagcaucaccuuggacauccugacagaaauagcgucgcuucccacguaucugucaucccgcgccaaguuagcguuagacaacaucgucaugcugcacaccaccgagaggggcgggcgcgccuaccagcacgcccucaacgagcugcccgagucgcuggagacacucaugcugguggcccugcucggggcgaugaccgccgggauuuuucuguucuuuaugcaggguaaggggaucggcaagcugagcaugggccucauuaccaucgccgucgccuccgggcucuugugggucgccgagauucagccgcaguggaucgcggcuagcaucauuuuagaguucuuccuaauggugcuguuaaucccggagcccgagaaacagcggaccccccaggacaaccaacugaucuacgugauccugacaaucuuaaccaucauuggucuuauugccgccaacgagauggguuuaaucgaaaagacuaagaccgacuucggcuucuaucaggugaagaccgagaccaccauccucgauguggaccugagaccagccagcgcguggaccuuauacgccgucgccacgacaaucuuaaccccgaugcuucggcacaccaucgagaacacgagcgccaaccugucccucgccgcgaucgccaaccaagcugccauucugauggggcuuggcaaaggcuggccccuccaucgaauggaccugggggucccccuguuagcgaugggcugcuacagccaggugaaccccacgaccuugaccgcgucccuggugaugcuccucguccacuacgccaucaucggacccggccuccaggccaaagccacucgggaggcgcagaagagaacugccgccggaaucaugaagaaucccaccguggacgggaucaccgucaucgaccucgaacccaucagcuacgaccccaaguucgagaaacaacuggggcaggucaugcugcuugccuuaugcgcugggcagcuucuccugaugcggacgaccugggcguucugugagguucucacucucgccaccgggccgauacuaacacugugggagggcaaccccggacgcuucuggaauacaaccauugccgugucuaccgcaaacauauuccgaggguccuaccuggcaggcgcgggccucgcauucucccugaucaagaaugcccagaccccuagacgggguacuggcacuacaggggagacccucggugagaaauggaagcgccaacugaacagccuugaccggaaggaguucgaagaguacaagcgcucggguauacucgaggucgaccggacggaggcaaagucggcccugaaagacggcuccaagaucaagcacgcggugagccgcggcagcaguaagauacgguggaucguggagagagggauggucaaaccuaagggcaagguggucgaccugggguguggccgcggaggguggucuuauuauauggcaacccucaagaacgucaccgaggugaagggcuauaccaagggggguccugggcacgaggagcccauccccauggcaacguauggcuggaaccugguaaagcugcauagcggcgucgauguguuuuauaagcccaccgagcaggucgacacccuccugugugacaucggggaaagcuccagcaaccccaccaucgaagagggccgcacgcugcguguacuuaaaauggucgagcccuggcuauccagcaagccagaguuuugcaucaagguucuaaaccccuacaugccgaccgucaucgaagaguuggaaaagcuccaacggaagcaugggggcaaccuggugcgcugccccuuaagucggaacagcacccacgaaauguauuggguguccggggccagcgguaacauugucuccaguguuaacaccaccuccaaaaugcuccugaaccgcuucacgacccggcacagaaagcccaccuaugagaaggacgucgaccuuggcgcagggacccggucuguuuccacagagaccgagaagccagacaugaccaucaucgggcgcaggcuccagcgccugcaagaagagcacaaagagacguggcacuacgaccaggagaacccguaccggacgugggcguaccacgggagcuacgaggcccccucgaccggcagcgccagcucuauggugaacggagucgucaagcugcuaaccaagcccugggacguaaucccgauggucacucagcuggccaugacagacacuacccccuuuggccagcagagaguguucaaagaaaaggucgacacgcggacaccccagccuaagccgggaacccgcauggucaugaccacgacugcgaauuggcucugggcacuccuggguaagaaaaagaacccucgguuaugcaccagggaggaguuuaucuccaaggugcgaagcaacgccgcuauuggcgcgguguuccaagaggagcagggguggaccagcgcuucggaggccguuaacgauagccgcuucugggagcugguggacaaggagcgggcccugcaccaggaaggcaagugcgaguccugcguguauaacaugauggguaagcgcgagaaaaagcugggagaguuuggccgcgcuaaggggagcagggcgaucugguacauguggcucggcgcgcguuuccucgaguucgaagcccucggguuccuuaacgaggaucacugguucgguagagaaaauuccuggaguggugucgagggagagggccugcaccgccucggguacauccuugaggaaaucgacaaaaaggacggugaccugauguaugcggacgauacggccgguugggacacccguauaacagaggacgaccugcagaacgaggaacucaucaccgagcagauggcgccccaucacaaaauccuggccaaagcaaucuucaaacugaccuaccaaaacaagguugugaaggugcuccgccccacuccgcguggggccgucauggacauuaucagucgcaaggaccagcggggcucuggccagguaggcaccuacgggcugaauacguucaccaauauggagguucaacuaauccgccaaauggaggccgagggcguaaucacgcaggacgacaugcagaaccccaagggcuugaaagaacgaguggagaaguggcugcgggaaugcgggguggacagauugaagcguauggccaucuccggcgacgacugcguggugaagccccuagacgaacgguuugguaccagccugcuguuuuugaacgacaugggcaagguucgcaaggacauaccccaaugggagccaucuaagggguggaagaacuggcaggagguucccuucugcagccaccacuuccacaagaucuucaugaaagacggccggucgcucgugguacccugcagaaaccaagaugaacugauaggucgggcccgaaucucacaaggggccgguuggagucuccgugagaccgccugccuggggaaggcauacgcucagauguggagccucauguauuuucauagaagggaccugcggcuggccagcauggccaucugcagcgccgugcccacugaaugguucccgacgagccgaaccaccugguccauccacgcccaccaucaguggaugaccaccgaagacaugcugaaggucuggaaucgggucuggaucgaggacaaccccaacaugaucgacaaaacccccgugcacucuugggaagacauccccuacuugggcaagcgcgaggaccuguggugcggaucccugaucggccugagcagucgggcgaccugggcaaaaaacauccauacugcgauaacacaggugcguaaccugaucggcaaagaagaguacguggacuacaugccaguuaugaagcgguacagcgcacccagugaaucggagggggugcuguaa

SEQ ID NO: 26340 - RNA, 9867 nt, Artificial Sequence
  derived and/or modified CDS sequence (opt11) from DENV-4__HQ332176__SS-prME
ucaaccaucacccuguugugccugauacccacugugauggccuuccaccuguccacgagggacggcgaaccuuuaaugaucgucgcccggcacgaacgcgggcgcccccuguuauucaagaccacggaagggaucaacaaauguacgcucaucgcgauggaccugggugagaugugcgaagacaccgugaccuacaagugcccccuucucgugaacaccgagcccgaggacaucgacuguuggugcaaccugacguccaccugggucauguaugggaccugcacccagagcggcgagcgacggcgggagaagcggagcguugcucugacgccgcacuccggcaugggccuugagacgcgcgcggagacuuggaugagcuccgagggggccuggaagcaugcccagcggguggagagcuggauccuucgcaaucccggguucgcucugcuugcaggguucauggccuacaugaucggccagacggguauucagcgcacgguguucuucguccucaugaugcugguggccccguccuacggcaugcgcugcgucgggguugggaaccgggacuucguggagggcguaagcgggggugcauggguggaccucgugcuggagcacggcgggugugugaccaccauggcgcagggcaaacccacccuggacuucgaguugaccaagaccaccgccaaggagguggcucuguuacggaccuacugcauugaggcccucauauccaacaucacgaccgcgacccggugcccgacccagggggagcccuaccuaaaggaggagcaggaccaacaguacaucugccgccgggacguggucgaucgcggcugggggaacgggugcggccuuuuugggaagggcgguguaguuaccugcgcuaaauucagcugcuccgguaaaauaaccgggaaccuuguccagaucgaaaaccuggaauacaccgugguggugaccgugcauaacggugacacgcacgccgucggcaacgacacgagcaaccacggcgugaccgccaccauaacgccccggaguccgagcguggaggucaagcugccggacuacggcgaauugacccucgauugcgagccccgcuccgggaucgacuucaacgagaugauacucaugaagaugaagaagaagaccuggcucguccauaagcagugguuucuggaccugccccuccccuggaccaccggugccgacacgucagaggugcacuggaacuauaaggagcggauggugaccuucaaggugccgcacgcgaagcgccaggacgugacaguccuggggagccaagagggggcgaugcacagcgcccuggcgggcgccacagagguggacagcggggacggaaaccacauguuugcuggccaccucaaaugcaagguccgcauggagaagcugcggaucaagggcauguccuacacgauguguagcggcaaguucagcaucgacaaagagauggccgaaacccagcacggcaccaccgucgucaagguaaaguacgaaggcgcuggagcgcccugcaaggucccaauugagauccgcgacgugaacaaggagaaaguggucggacgggugaucagcgccacgccacuggcggagaacacaaacuccgugacgaacauagaguuggagccgccguucggggacucauacaucgucaucggcgugggcaacuccgcucugacucugcacugguuccguaaggggagcuccauaggcaagauguucgaaaguacguaucgcggggcuaagcgcauggccauucucggcgagaccgcaugggacuucggguccgugggcggccuguucaccucccucgguaaggccguucaccagguguuuggcuccguguacaccacuauguucgguggcgucuccuggaugauccgaauccucaucggguuuuuagugcuguggaucggcaccaacucgcgcaacaccagcauggccaugacaugcaucgccgugggcgggauaacgcuguucuugggcuucacaguccaggccgacauggguugcgugguuuccuggagcggucgcgagcugaaguguggauccggaaucuucguuguagacaacguccauaccuggaccgagcaguacaaguuccagcccgagagucccgcucggcuggccagcgcuauccucaaugcccacaaggacggcgugugcgggauccgauccacgaccagacuggagaacgugauguggaagcaaaucacuaacgaacuaaauuacguguuaugggaaggcgggcaugaccugacggucguggccggcgacgugaagggcguccucacgaaggggaagcgggcuuugaccccgccagccagcgaccugaaguacuccuggaagacuugggguaaggccaagaucuucacaccugaggcccggaacagcacauuccuaaucgacgggccugacaccuccgaauguccgaaugagcggcgcgccuggaauagcuucgaaguggaggacuacggcuucgggauguucaccacaaauaucuggaugaaguuccgggagggcuccagugaggugugcgaccaccgccucauguccgcggcaaucaaggaccagaaggccguccacgccgacaugggcuacuggauagagagcuccaagaaucaaacauggcagaucgagcgggcgagccugaucgaggugaagacgugccuguggccgaagacccacacacucugguccaacggcgugcuggagagccagaugcuuauaccgaaguccuacgccgggccguucagccagcacaacuacagacagggcuaugccacccaaacggucgguccguggcaccucggaaaacuugagaucgauuucggcgagugccccggcaccacggucaccauccaggagaacugcgaccaccgcgggcccuccuugcggacgaccaccgccagcggcaagcucgucacccaguggugcugucgcagcugcacgaugccgccccugcguuuccugggugaggacggcugcugguaugggauggagauccgcccccucagugagaaggaggagaacauggucaaaagucaggugaccgccggccagggcaccuccgagaccuucaguaugggucugcugugccucacacuguuuguggaagagugccugcggaggcgagugacccgcaaacacaugauccucgcgguggucaucacccugugcgccaucauuuuggguggccucaccuggauggaccugcugcgggcccuuaucauguuaggcgacacgauguccggccggaucggagggcaaacccaccuggccaucauggccguauuuaagauguccccuggguaugugcucggcgucuuccugcggaagcugaccucccgcgagaccgcgcucauggugaucgggauggccaugacgaccacccugaguauaccgcacgaccugauggaguugaucgacgguaucucccuggggcugauacuccucaagaucgugacccaauucgacaacacgcaggucgggacgcuugcccucucacuuaccuuuaucagaucuaccaugagccugguuauggccuggcgcacgaucauggcgguacucuucgugguaacccugauccccuugugccgaacuuccugccuccagaagcaaagccacugggucgagaucaccgcguuaauccugggagcccaggcccuaccggucuaccugaugacacugaugaagggggcgucccggagaucuuggccccucaacgagggcaucauggcgguggggcuggucucccugcucggcagcgcccugcugaagaacgacgugccucucgccggccccaugguggcugguggccugcugcucgccgcguacgugauguccgggagcucagccgaccugucccuggagaaggccgcgaacguccagugggacgagauggcugacauuaccggcucguccccgaucaucgaggugaagcaggacgaagacgggagcuucuccauccgcgacguagaagagacuaacaugaucacccuccuggucaagcuggcgcuuaucacaguaucgggccuauacccucuggccaucccgaucaccaugacccucugguacauguggcaagugaagacccagagguccggcgcacugugggacguuccuagccccgccgccacucaaaaggcggcccuguccgaggggguguaccgcaucaugcaacggggccucuucgggaagacacaggugggcgucgggauccacauggagggcguguuccacacuauguggcacgugacccgugguagcgucauuugccacgagacagggaggcuggagcccuccugggccgacgugcggaacgacaugaucagcuacggagggggcuggcgucugggcgacaaaugggacaaggaggaggaugugcagguccucgccaucgagccggggaagaaccccaagcacgugcagacgaagcccggacuguucaagacgcugaccggggagauaggcgccgugacccucgauuuuaagcccgggacauccgguagccccaucaucaaucgaaagggcaaggucaucgggcuguacggcaacggggugguuaccaaguccggagacuacguaagcgcgaucacccaggccgagcgcaucggggaaccggacuacgagguggacgaggacaucuuccgcaagaagcgacuaaccaucauggaccuccaucccggcgcaggcaagacuaagcggauccugccuaguaucgugagggaggcucugaagcggcgccugaggacccucauacucgcgcccacccgcgucguggcagcagagauggaggaagcccugcggggucuccccauccgcuaccaaacccccgcuguuaaaagcgagcacacgggccgggagauaguagaucucaugugucaugcgacguucacuacccgcuuacucuccucaacgcgggugccgaacuacaaccugauugugauggaugaggcucacuucacggaccccagcuccguagccgcccggggguacaucucgacccggguagagaugggcgaggccgcugccaucuuuaugacagcaacacccccuggagcuaccgacccguucccccaguccaauagcccaaucgaggacaucgagagagagauccccgaacgcuccuggaacaccggguuugacuggaucacugacuaccagggcaagacggugugguucguuccgagcaucaaggccgggaaugacaucgcaaacugccugcggaaguccggcaagaaggugauccagcucagcagaaagaccuucgacaccgaauaccccaagaccaagcugacagacugggacuucgucgucaccaccgauaucucagaaaugggcgccaauuuccgggcgggucgcgugaucgacccgcggcgcugccugaagcccgucauacuaaccgacgggccggagcgggucauccuggccgggcccauccccgucacgcccgcgagugccgcucagcgucggggccgcaucgggcggaacccggcucaggaggacgaccaauacgucuucucgggagacccacucaagaacgaugaggaccacgcccauuggaccgaggcgaaaaugcuccucgacaacaucuacacccccgaggggaucaucccaacacuguucggcccugagcgugagaagacgcaggcgauugacggcgaguuccggcuccgcggcgagcagcggaaaaccuucguggaacugaugcgccggggugaccuucccgucuggcugaguuauaaggucgccuccgcgggaaucagcuauaaggaucgcgaguggugcuuuaccggcgaacggaauaaccaaauccuggaggaaaacauggagguggagaucuggacccgcgagggggagaagaagaaguugagacccaaauggcucgacgcccgcguguacgcugaccccauggcuuugaaggacuucaaggaguucgcauccggccgcaagagcauuacccuggacauccuaacugagaucgccucccugccaaccuaccugucuuccagagcgaaacuugcgcucgacaauauagugaugcugcauaccacggaaaggggcgggagggccuaccagcacgcccucaacgagcugccugagagccuggagacgcucaugcuuguggcccugcucggcgcgaugaccgccgggaucuuccuguucuuuaugcaggguaaggggauuggaaagcugaguaugggcuuaauaaccaucgccguagccagugggcuucucuggguggccgagauccagccccaguggaucgcggccagcaucauccucgaguucuuccugauggugcuguuaauuccggagcccgagaagcaacguacaccccaggauaaccagcugaucuacgucauccucacgauccucacaaucaucggccugaucgccgccaacgagauggggcugaucgagaagaccaagaccgacuuuggcuucuaccaggucaagacggagaccaccauccucgacguggaccuucggcccgccucggcuuggaccuuauacgccguggccacgaccauccucaccccgauguuacgucacacgaucgagaacaccucggcaaaccucucccucgccgcgauagccaaccaagccgccguccugaugggacuuggcaagggcuggccccuccaucggauggaucuggggguaccccuucucgcaaugggcugcuacagccagguuaaccccaccacgcuuaccgcguccuuagucaugcuccucgugcacuacgccauaauaggcccgggccugcaagcaaaggccacccgcgaagcgcagaagcggacggccgcuggcaucaugaagaaccccaccguggacgggaucaccgucaucgaccucgaacccaucucuuacgaccccaaauuugagaagcaacugggccaggugaugcugcucguacugugcgcugggcagcuguuacuuaugcgaacgacaugggccuucugcgaagucuugacccuugcgaccggaccgauccugacgcugugggaggguaaccccggccgguucuggaacacuacaaucgccguguccaccgccaacaucuuccgcggcagcuaccucgcuggggccggccuggcauucucccuuaucaagaacgcccagacgccccggagggggaccgguaccacuggggagacccucggcgagaaauggaaacgccaguuaaacagcuuagaccgcaaggaguucgaggaguacaagcgguccggcauccucgagguggaucgcacggaggcaaagagcgcgcuaaaggacggguccaaaauaaagcacgccgugagccgugguuccagcaagauccgcuggaucguugagcgugggauggugaagccgaagggaaaggucguggaccugggcugcggacggggagggugguccuauuacauggcgacuuugaagaacgugacagaggucaagggcuacaccaaaggaggcccggggcacgaggagcccaucccgauggcaacguacggguggaaccuggugaagcugcauucuggcguggacguauuuuacaagccuaccgagcaggucgacacacuccugugugacaucggggagagcagcucuaaccccacgaucgaggagggccgcacacugcgggugcucaagauggucgagcccuggcuguccaguaagcccgaguucugcaucaaggugcuuaaucccuacaugccgaccgugaucgaggagcuugaaaagcuccaacgcaagcacgggggcaaccugguccggugcccccugucccggaacagcacccacgagauguacugggugaguggggccucggggaacaucguaaguucugugaacacgacguccaagaugcuccugaaccgauucaccacccgacaccgcaagcccagcuacgaaaaggacguggaccugggcgcugggacccgcagugucagcacugagaccgagaaacccgacaugacaaucaucggccggcgccuacagcggcugcaggaggagcacaaggagaccuggcacuacgaccaggagaaccccuaccgcacuugggcguaccaugggagcuacgaggcccccuccaccggcucagcuagcuccauggugaacggcguggucaagcugcucacuaagcccugggaugugaucccuauggugacccaacuggccaugacggauacaacccccuucgggcagcagcggguuuucaaggagaaaguggacacccgcacgccccagcccaagccgggcacccggauggugaugaccaccacggccaacuggcugugggcgcucuuggggaagaagaagaauccccgccugugcacacgggaggaguucaucagcaaaguccggucaaacgccgccaucggcgcuguguuccaagaggagcagggguggaccucggcgagcgaggcugugaacgauucccgguucugggaguuagucgacaaggaacgcgcccuacaccaggaggguaagugcgaguccuguguguacaacaugaugggcaagcgcgagaagaagcugggagaguucggccgggccaaggggagccgggcuaucugguacauguggcuuggggcccgguuccuggaguucgaagcgcuaggcuuucucaacgaggaccauugguucggcagagagaauagcugguccggcguggagggggaaggucugcaccggcugggauacauucucgaggagauugacaagaaagacggcgaccugauguacgcggacgacaccgcaggcugggacacccgcauuacggaggacgaucuacagaacgaggagcucaucaccgagcagauggcaccccaccacaagaucuuagcgaaggccauuuucaagcugacuuaccagaacaaggucguaaaggugcuccggccgaccccgagaggggccgucauggacaucaucagccggaaggaccagcgcggaucggggcaggucggcacguacggucugaacacuuucacgaacauggaggugcagcugauccggcagauggaggccgagggggucaucacccaggacgauaugcagaacccaaagggccucaaagagcgcguggagaaguggcugcgggagugcgggguggaccgccugaagcggauggccauaagcggcgacgacugcgucgugaagccccucgacgagcgcuucgggaccucgcuguuguuccucaaugacaugggcaaaguuaggaaggacaucccacagugggagccgagcaaggguuggaaaaacuggcaggaggugcccuucugcucgcaccacuuccacaagauuuuuaugaaagacggccgcagccugguggugccgugucgcaaucaggacgagcugauuggccgcgcgcgcauaucacagggggcgggcuggagccuccgggagaccgcgugucugggaaaggccuaugcccagauguggucgcucauguacuuccaccgaagagaccuuagacuggcuagcauggcuaucugcagcgccgucccgacugagugguuuccgaccucccggacuaccuggagcauucacgcacaccaccaguggaugaccacggaggauaugcugaaaguguggaauagaguauggaucgaggacaaccccaacaugauagacaagacgcccguccacuccugggaggacauccccuaccucggcaagcgggaagaccuguggugugggagccuaauuggccucuccagccgcgccaccugggcgaaaaacauccacaccgccaucacccaggucaggaaccugaucggcaaggaggaguacgucgacuauaugccggucaugaagcgcuacuccgccccuagcgagucagaggggguguuauga

SEQ ID NO: 26341 - RNA, 9867 nt, Artificial Sequence
  derived and/or modified CDS sequence (opt11) from DENV-4__HQ332174__SS-prME
ucgacgaucacgcuacucugccugauucccaccgcgauggccuuccaucuguccacccgggacggcgagccccucaugaucguggcgaagcacgagcgggggcgcccccugcuguucaagacuaccgaaggaauuaacaagugcacccucaucgccauggaucugggggagaugugcgaggacacugugaccuauaagugcccccuguuagugaacaccgagcccgaggacaucgacugcuggugcaaccucacgagcaccugggugauguaugggaccugcacccaguccggggagcggcgccgggagaagcgcagcguggcccucacgccccacaguggcaugggcuuagagacccgggccgagaccuggaugagcuccgagggggccuggaagcacgcccagagaguggagucguggauccugcggaaccccggcuucgcacugcucgccggguucauggcuuauaugaucggccagaccgggauccagcgcacgguguucuucguucugaugaugcuaguggcgcccucauacggcaugcggugcguuggcgucgggaaccgcgauuucguggagggcgugagcgggggcgcgugggucgaccucgugcuggagcacggcgggugcgugaccaccauggcccagggcaagcccacgcuggauuucgagcucacgaaaaccaccgcuaaggagguggcccuccugcguacauacugcaucgaggcgcucaucaguaacauaacgacggccacccgcugcccaacccaaggggagcccuaccugaaagaggagcaggaccagcaguacaucugccggcgagacgugguggaccggggcugggggaacggcugcgggcuguucgggaaaggcggaguugugacgugcgcuaaauucagcugcuccggcaagaucaccgguaaccucgugcagaucgagaacuuggaguacaccguuguggugaccguccacaacggcgauacccacgccguaggcaacgacaccagcaaccacggggucacagccaccaucacgccccgcucaccgagcguggagguaaagcugccggauuacggggagcucacccuggacugcgagcccagauccggcaucgacuucaacgagaugauccuuaugaagaugaagaagaagaccuggcucguccacaagcagugguuccuggaucugccccuccccuggaccacgggcgcggacaccagcgaaguucauuggaacuacaaagaacgcauggugaccuucaaggucccgcacgcuaagcggcaggacgugaccguguuggggucccaggagggcgccaugcacagcgcccuagccggagcgaccgagguggacagcggagacggcaaccacauguucgcagggcaccucaagugcaaggugcgcauggagaagcugagaauaaagggcauguccuauaccaugugcagcggcaaguucagcaucgauaaagagauggcagagacccagcacgggacuacagugguaaagguuaaguacgagggcgccggggcgccgugcaaggugccaaucgagauccgggacgucaacaaagagaagguggugggccgcgucaucagcgcgacgccccuggccgagaauaccaacuccguaaccaacaucgagcucgagccgccuuuuggggacagcuacaucguaaucggcgucggcaauuccgcccugacacugcauugguucaggaaggggagcuccaucgguaagauguucgagaguacguaucgcggggccaagcggauggcgauccucggcgagaccgcaugggacuucgggucugugggcggccucuucaccagccuugggaaggcggugcaccagguuuucggguccguguauacaacgauguucggcggggugagcuggaugauccgaauccucaucggguuucugguccuguggaucgguaccaacucccggaacaccagcauggccaugacgugcaucgccgugggggggaucacacuauuucucggauucaccgugcaggcggacauggggugcgucguguccuggagugggagagagcugaagugcggguccggcaucuucguggucgauaacgugcacaccuggaccgaacaguacaaguuccaacccgagagccccgcgcggcuggccagcgccauuuugaacgcccacaaggauggcgugugcgggauccguagcacgacccggcuggagaacgucauguggaagcaaauuaccaacgaacugaacuacguacucugggaaggcggccacgaccugacgguugucgcaggcgacguaaagggcgugcugacgaaggggaagcgcgcucucacgccgcccgccagcgaccugaaguacucuuggaagaccuggggcaaggcaaagaucuucacucccgaggccaggaauucgacguuccugaucgacggacccgauaccuccgagugcccgaacgagcgccgcgcguggaacagcuucgaagucgaagacuacggcuucgggauguuuacgaccaacaucuggaugaaguuucgcgaaggcucgagcgaaguuugugaccaccggcucauguccgccgccauuaaagaccagaaagccgugcacgcggacauggguuacuggaucgaguccuccaagaaccagacguggcagaucgagcgcgcgagccugaucgaggugaagacaugccuguggccgaagacccacacccucugguccaacggugugcuggagucacaaauguuaauccccaaguccuaugccggcccguucucgcagcacaauuaccggcagggguaugccacccagacgaugggacccuggcaucucgggaaguuggaaaucgacuucggcgagugcccugggaccaccgugaccauccaagagaacugcgaccaccgggggcccucccugcgcacgaccacugccucaggcaaacucgucacccaguggugcugucggagcugcacgaugccgccccugcgcuucuugggggaggacggcugcugguaugguauggagauccgcccacucucagagaaggaggagaacauggucaagagccaggugacugcgggccagggcgccuccgaaaccuuuagcauggggcugcugugccucacgcuguucgucgaggagugccuucgucggcgagugacgcggaaacacaugauccucgccgucgugaucacccugugcgccaucauccuggguggccucaccuggauggaucugcuucgcgcccugaucaugcugggcgauacuauguccggucggaucgggggccagacgcaucuggcaauaauggccguguucaagaugagccccggguacgugcugggcguguuccugagaaagcugaccucccgggagaccgcccucauggugaucggcauggccaugaccacuacccugagcaucccacacgaccugauggagcucaucgauggcaucucucugggguuaauccuccugaagaucgucacccaguuugacaauacgcagguggggacgcuggcccucagcuuaaccuucaucagguccaccaugagccuggugauggcguggcggaccauuauggccguacuuuucguagugacguugaucccccugugccgcaccuccugccuccagaaacagagccacugggucgagaucaccgcccugauccugggcgcccaggcgcuccccguguaccuuaugaccuuaaugaagggggccucucggagaagcuggccccucaacgaaggcaucauggccgugggguuagucucccugcucgguucugcgcugcugaaaaaugacgucccgcucgccggccccaugguggcgggcggccuccugcuagccgccuaugucauguccgggucgagcgccgaccugucccuagagaaggccgcgaacguucagugggacgagauggccgacaucacagggagcuccccaaucaucgaggugaaacaagacgaggaugggagcuucuccauccgggacguagaggagaccaacaugaucacacuccuggugaagcuggcauuaauuaccgugucaggccuguacccccuggccaucccaaucaccaugacccuuugguacauguggcagguuaagacccagcgcucaggcgccuugugggacgugcccagccccgcggccacccagaaggcggcccugucggaggggguguacaggaucaugcagcgcgggcucuucgggaagacacaaguuggcguggggauucacauggaagggguauuccacaccauguggcacgucacccggggcagcgugaucugccacgagaccgggcgccuggaaccguccugggcggacgugcgcaacgacaugauaagcuacggaggcggguggcgguuaggagacaagugggacaaggaggaggacguccaggugcucgcgaucgagccggggaaaaaccccaagcacgugcaaaccaaacccggccuguucaagacgcugaccggggagaucggcgccgucacucucgauuuuaagcccggcacauccggcagccccauuaucaaucgcaaggggaaagugauaggacuguacggcaauggggucguuacgaaauccggagacuacgugucugcuaucacucaggccgagcggaucggggagcccgacuaugagguagacgaggauaucuucagaaagaagcggcugaccaucauggaucuccaccccggcgcgggcaagaccaaacgcauccugcccuccaucgugcgggaggcccugaaacgccggcugcgcacacuaauccuggcccccacccggguuguggccgccgagauggaggaggcucugagagggcuccccauccgguaccaaaccccagccguaaagagcgagcacaccggccgcgagaucguggaccugaugugccacgccacguucaccacccggcugcucucaagcacccgcgugccaaacuacaaccugaucgucauggaugaggcccacuucacggaccccagcuccguagccgcgcggggguacaucagcacccgcgucgagaugggugaggccgccgccaucuucaugaccgccacaccccccggggccacggacccguucccccaauccaacucccccaucgaagacaucgagcgggagauccccgagaggaguuggaacaccggcuucgauuggaucacggacuaucagggcaagaccgucugguucgugccaagcaucaaggccggcaaugacaucgccaacugucugcgcaaguccggcaagaaggugauccaguuaagccggaagaccuucgacaccgaguacccgaagaccaagcugaccgacugggauuucguggugacgacugacauuuccgagaugggggcuaacuuccgcgcgggccgcgucaucgacccccgccggugccugaaaccugugaucuugaccgacgggccggagcgcgugauucuggccggccccauuccggucacccccgccagcgccgcccagcggcgcggcagaaucgggcguaauccggcgcaggaggacgaccaguacgucuucuccggcgacccccugaagaacgacgaggaccacgcccacuggacggaggccaagauguuguuggacaacaucuacacccccgaggggaucauccccacguuguucggccccgagcgggagaagacccaggccauugacggggaguuccgccuccgcggugagcagcgcaaaacguucguggagcugaugcggcgcggcgaccugccagucuggcugagcuacaagguggccuccgccggcauuagcuacaaggaucgugaaugguguuucaccggcgaacgcaacaaucagauccuggaggagaacauggagguugagaucuggacccgggaaggggagaaaaaaaagcugcgucccaaguggcucgacgcucgggucuaugccgaccccauggcucugaaggacuucaaggaguucgccucaggccgcaagagcaucacccuggacauacucaccgagaucgcgucucugccgacguaccugagcagucgcgccaagcuggcacuggauaacaucguuaugcugcacaccacggaacggggcgggcgcgccuaccaacaugcguuaaacgaacuucccgagagccuggagacccucaugcugguggcccugcucggcgccaugaccgccgggauauuccuguucuucaugcagggcaaggggaucggcaagcugucaaugggucucaucacuaucgccgucgcauccggccuccuguggguugcugagauccagccgcaguggaucgcugccagcauuauccucgaguucuuccugauggugcugcucaucccggagcccgagaagcagcgcacgccacaggacaaccagcugaucuacgucauccugaccauccuaacgauaauaggccuuauagccgcgaacgaaauggguuuaaucgagaagaccaagaccgauuucggcuuuuaccaggcgaagacugaaacgaccauacucgacguggaccugcgacccgccuccgccuggaccuuguacgccguugcgaccacgauccucaccccgauguuacggcacacaaucgagaacaccagcgccaaccugucccucgccgcuaucgccaaccaggcggccguucugaugggacuggguaagggauggccacuccaucgcauggaccugggggugccucugcucgccaugggcugcuauucucaggugaaucccacgaccuugaccgccucauuagucaugcuccuggugcacuacgcaauaaucgggccgggccugcaagccaaagccacccgggaagcccaaaagcgcacggccgcgggcaucaugaagaaccccaccguugacgggaucaccgucauugaccucgaaccuaucagcuacgaccccaaauuugaaaagcagcugggccaggugaugcuguuagugcucugcgccgggcagcugcuuuugaugcggacuacuugggccuucugcgagguccugacacucgcgaccggcccgauccuaacucugugggaggggaacccgggccgcuucuggaacacuaccaucgccguguccaccgcgaacaucuuccggggcuccuacuuggccggugccggccuggccuucucccugauuaagaacgcccaaaccccccggcgggguacgggcacaacaggggagacgcucggugagaaguggaagcgccaacugaacagcuuagacagaaaggaguucgaggaguacaagcgcucaggcauccucgaggucgaccggaccgaagccaagagcgcccugaaggacgggaguaagauaaagcaugccgucagccgcggcucaucuaagauccgcuggaucguagagcgcggcauggugaagcccaagggaaaggucguggaucuggggugcggccgcggcggguggucguacuacauggccacguugaaaaacgugacagaggucaagggcuacaccaaaggaggcccggggcacgaggagcccaucccaauggcgaccuacggcuggaaccuggugaagcugcacaguggcguggacgucuuuuacaagcccacugagcaggucgacacccuccugugcgauaucggggagaguuccagcaacccgaccauagaggagggccgaacccugcgcgugcucaagauggucgaacccugguuauccagcaagcccgaguucugcaucaagguucugaaccccuacaugccgacggucauagaagagcucgagaagcuccagcggaagcaugggggcaacuugguccgcugcccccugucccggaauagcacccacgagauguacuggguguccggagcgagcggcaacaucgugucgagcguaaacaccacuuccaagaugcuccugaacagauucacgacccggcaccgcaagcccaccuaugagaaggacguggaccugggugccgggacgcggagcguuagcacggaaacggagaaacccgacaugaccaucaucggcaggcggcuccagcgccugcaggaggagcacaaggagaccuggcacuaugaccaggagaacccguaccggacgugggcguaccauggaucauacgaggcacccuccaccggcuccgcguccaguauggugaacgggguggucaagcugcucacgaagcccugggacgugaucccuauggugacccagcuagcgaugacagacaccacccccuucggucagcagagggucuucaaggagaagguggauaccagaacgccgcagccaaagccgggcacccgcaccgugaugacgacgaccgcgaacuggcugugggcccuccuggggaagaagaaaaacccccggcugugcacccgcgaggaguucaucucuaaggugcggagcaacgcugcgaucggggccguguuccaggaagagcagggguggacgagcgccucagaagcagugaacgacagccguuucugggagcucgucgauaaggagagggcccuacaccaggagggcaagugcgaauccugcgucuacaacaugauggguaaaagggagaagaaguuaggugaguucggccgggccaaggguagccgcgcgaucugguauauguggcucggcgcccgcuuccucgaguucgaggcccugggauuccuaaacgaagaccacugguucggacgggagaacuccuggagcggcguggagggggagggccugcaccggcugggguauauauuagaagagaucgacaagaaggacggcgaccugauguacgcagaugacacugccggaugggauacucggaucacugaggacgaccugcagaaugaagagcucaucaccgagcaaauggcgccacaccacaagauccuggccaaggccaucuucaaguugaccuaccagaacaaggucgugaaggugcuccgccccacgccgcgcggugcugucauggacaucauaucccgcaaggaccagcggggcagcggccaggugggcaccuauggccugaacacguucaccaauauggaggugcagcucauccgccaaauggaggccgagggugucauaacgcaggacgacaugcagaaccccaaaggccucaaggagcggguggagaaguggcuucgcgagugcgggguggaccggcugaagcgcauggcuauauccggcgacgauugugucgugaagccccucgacgagcgguucgguacaagccugcuauuccucaacgacaugggcaaaguacgaaaagacaucccccagugggagccgucaaagggguggaagaacuggcaagaagucccguucugcagccaccacuuccacaaaauuuucaugaaggacggccgcucccugguggugcccugccgcaaucaagacgaacugaucggccgggcgcgcaucagccagggggccggcuggagcuugcgagagaccgcaugccuggggaaggcuuacgcacagauguggagccugauguacuuucaccggcgagaccuccggcuggccuccauggcaaucugcagcgcgguccccacugagugguucccgacgagccgcaccaccugguccauccaugcccaccaccaauggaugaccacggaggacaugcugaagguguggaacaggguuuggaucgaggacaaccccaacaugaucgacaagaccccgguucacucuugggaggacauucccuaccucgggaaacgagaggaccuguggugcgguucccugauaggccucagcucccgagcuaccugggccaagaacauccacaccgcuaucacacaggugcgcaaccuaauuggcaaggaggaguacguggacuacaugccggucaugaagagguacagcgcgcccuccgagagcgaaggggugcuguga

SEQ ID NO: 26342 - RNA, 9867 nt, Artificial Sequence
  derived and/or modified CDS sequence (opt11) from DENV-4__KT026308__SS-prME
uccacuaucaccuuacucugcuuaauccccacuguuauggccuuccaccuguccacccgugacggcgaaccgcucaugaucgucgccaagcacgaacgggggcgcccucugcuguucaagacgaccgagggcaucaacaagugcacucuuaucgcgauggaccugggggagaugugcgaggacacggugaccuauaagugcccccuauuagugaacaccgaacccgaggacauugacugcugguguaaucucacgucgacaugggucauguacggcaccuguacccagagcggggagcggcgccgggagaagaggagcgucgcccugacgccgcacuccggcaugggccucgagacccgggccgagaccuggauguccuccgagggggccuggaagcacgcccagcgcguggagucguggauccugcggaaccccggcuucgcgcugcucgccggauucauggccuacaugaucggccaaaccgggauccagcgcacggucuucuucauccugaugaugcugguggcccccucuuacggcaugcggugcgugggcgucgggaaccgcgacuuugucgaaggcgugagcgggggagcgugggucgaccuaguuuuggaacacggcgguugcgugacuaccauggcccagggcaagccuacccuagacuucgaguuaaucaagacgacggccaaggaggucgcauuacugcggaccuacuguauugaggccuccauaagcaacauaaccacggcgacccgcugcccgacucagggggaaccguaccucaaggaggagcaggaucagcaguacaucugccggcgcgacaugguggaccggggcugggggaacggauguggccucuucgggaaaggcgggguaguaaccugcgccaaguuuuccugccugggcaagaucacggggaaucuaguccaaaucgagaaucuggaguacaccgugguagucacgguucauaacggcgacacccacgccguuggcaacgacacgagcaaccacgggguuacggccaccauuacuccccgguccccaagcgucgaggugcagcugccggauuacggcgagcuaacccuggauugcgagccgcgguccgggaucgauuucaaugagaugauacuuaugaagaugaagaccaaaaccuggcuugugcacaagcagugguuccuggaccugccccucccguggaccaccggcgccgacacgcuggaggugcacuggaaucacaaggagcggauggugaccuucaaggugccacaugcuaagcggcaggacgucaccguuuuggggagccaagagggcgccaugcacuccgcccucgccggcgcaaccgaaguagacuccggggacgggaaccacauguuugcgggacaucugaaauguaaaguccgcauggagaaguuacgaaucaagggcaugagcuacacgaugugcuccggcaaguucagcauugacaaggagauggcagagacccaacacggaacaacagugguaaaagucaaauaugagggcacgggggcccccugcaagguaccgaucgaaauucgggaugugaacaaggaaaaaguugugggccgcaucauauccagcacucccuuugcugagaacaccaacuccgugacuaacaucgagcucgagccgcccuucggggacucuuacaucgucauuggcgugggcgacuccgcccugacguuacacugguuucggaagggauccucuaucggaaaaauguuugagagcacauaccgcggggcgaagcggauggcaauccucggcgagaccgccugggacuucgggucugucggcgggcugcucaccagccucgggaaggcuguccaccaggucuucggcuccgucuauacgacgauguucgggggcgucagcuggauggugcgcauccugaucgggcugcuggugcucuggaucgguaccaacagcagaaacaccagcauggcgaugucuugcaucgccgucggugggaucacacucuuccugggguucacugugcacgcggacauggggugcguggucagcugguccggcaaggagcucaagugcgggagcggcaucuucgugaucgacaaugugcacaccuggaccgagcaguacaaguuccagccagagagccccgcccgccuggccuccgcaauccucaacgcgcacaaggagggagucugcgggauacggagcacuacccgccuugagaacgugauguggaagcagaucaccaacgagcuuaacuacgugcugugggagggcgggcacgaccucaccguuguggccggcgacgugaagggcguccuguccaaggggaagcgggcgcuggcuccacccguaaacgaccucaaguacaguuggaaaacguggggcaaggcgaagauauuuacccccgaaacccguaacucuaccuuccugguggacgggccggacacaucagagugcccgaacgaacgccgcgcauggaacuuccuggagguagaggacuacggcuucgguauguucaccacgaauaucuggaugaaguuccgggagggaaguagcgaagugugcgaccaccgccucauguccgccgccaucaaggaccagaaggcggugcacgcggacaugggcuacuggaucgagagcucgaaaaaccagaccuggcagaucgagaaggccucucugauagaggucaagacaugcuuauggccgaagacccacacccucugguccaauggggugcuggagagccagaugcugauaccuaaggccuacgccggccccaucucccaacacaacuaccggcaaggguaugcgacgcaaaccgccggcccuuggcaccucgggaaacuugaaaucgacuucggcgaaugccccgguacgacugugacaguccaggaggauugugaucaccgcgggcccagccugagaaccacgaccgccucgggcaaguugguaacccaauggugcugcagaagcugcacaaugccgccccugcgcuuccugggggaggauggcuguugguacgggauggagaucaggccgcugaacgagaaggaagagaacaugguaaagagccaggucucugccggccacggcacuucugaaaccuucucaaugggucugcugugccucacucuguucguggaggagugcuugcgucggagagucacccgaaagcacaugauccucgugguggugacgacccugugcgccauuauccugggcgggcucaccuggauggaccuccugcgggccuugauuaugcuuggcgacaccaugagcgggaggaugggagggcaaauucacuuggccaucauggcuguguucaaaauguccccaggauacgugcucggcauuuucuuacgcaaguugacgagccgugaaaccgcccugauggucaucgggauggcuaugaccaccguguugucaaucccgcacgaccugauggaguucaucgacggcaucucacucggucugauccugcuuaagauggugacgcauuucgacaacacccaagucgggacccuggcgcuggcacucacguucaucaaguccaccaugccgcuggugauggcauggcgcaccaucauggcggugcuuuucgucgugacgcucaucccccugugccggacgagcugucuacagaagcagucccacugggucgagaucaccgcccucauccuuggagcgcaggcccuccccguguaccucaugacccugaugaagggggcauccaagcggucguggccacuaaaugaaggaaucauggccgugggucuggugucgcugcugggcuccgcgcuucugaaaaacgacgucccccuggccggaccgaugguggcuggaggccuccugcuggccgccuacgugaugagcggguccagcgcugaccucucacuggagaaggccgccaacguccaaugggacgagauggccgacaucaccggcuccagcccgaucaucgaagugaagcaggacgaggacgggucguucagcauccgggauguggaggagaccaacaugaucacgcugcugguuaagcucgcccugaucacaguguccggccucuacccacuggcgauacccgugaccaugacccugugguacauguggcaaguaaagacgcagcgcagcggcgcacucugggacgugcccucccccgccgcagcccagaaggcaacccugacggaagguguuuaccggaucaugcagcgcggccuauuuggcaagacucaggucggcguggggauccacaccgaggggguguuccauaccauguggcacgucacccggggcagcgucauuugccacgaauccggacggcucgagccgucaugggccgacguacggaacgacaugauuagcuacggcggcggcuggcgucugggcgacaagugggacaaagaggaggacguccaggugcuggccauagagcccgggaagaaccccaagcaugugcagacaaagccaggccucuucaaaacacugacgggggagauaggcgcggucacccuggacuucaagccggggaccagcggcuccccuauaaucaacaggaagggcaaggugaucgggcucuauggaaacgggguggucacuaaaagcggcgacuacguguccgcgaucacucaagcggagcggaucggcgaacccgacuaugagguagacgaggacaucuuucgcaaaaagcggcugacaaucauggaccugcauccgggcgcgggcaagaccaagcguauccugccaucgaucguccgugaggcccucaaacgucggcugcgcacacugauccuagccccaacgcgugugguggcggccgagauggaggaagcccugagggggcuaccuauccgguaccagacuccggccgucaaguccgagcauacgggcagggagauaguggaucucaugugccacgccaccuucacgacacgguuacugagcucaacccgagugccgaacuauaacuuaauugucauggacgaagcccacuucacggaccccagcuccguggccgcccgaggauacaucagcacgcgcgucgaaaugggcgaggccgcagcgguuuuuaugaccgccaccccaccggggacgaccgaucccuucccccaaucaaauucccccaucgaggacauagagcgggagauuccugagcgcagcuggaacacuggcuucgacuggaucaccgacuaucaggguaagaccgucugguucguccccuccauuaaggccgggaacgauaucgcuaacugcuuaagaaagagcggcaagaaggugauccaacuaucccggaagacguucgauacugaauaccccaagaccaagcucaccgacugggacuucgugaucacgaccgauaucagcgagaugggggccaacuucagggcaggccgugugaucgacccccgccggugccugaaacccgugauccugaccgaugggcccgagcgcgugauacucgcaggaccgauacccgucacuccggcauccgccgcgcagcggcgcggccggaucggucgcaaccccgcccaagaggacgaccaguaugucuucagcggagacccccuucggaacgacgaggaccacgcccacuggacggaggccaaaaugcuguuagacaacaucuacaccccagaaggaaucaucccgaccuuguucggccccgagcgcgagaaaacccaggccaucgacggcgaauuucgacugcgcggggaacagcggaaaaccuuuguggagcuuaugcgccggggcgaccuuccggucugguugucccacaagguagcguccgccgggauauccuacaaagaccgcgaguggugcuucacaggugagcggaacaaccagauacucgaggagaacauggagguggagauuuggaccagagagggcgagaagaagaagcugcggcccaaguggcucgacgcccgagucuaugccgauccaauggcgcucaaggauuuuaaggaguuugcgagcggccgaaagagcauuacccuugacauccugacugagaucgccagccucccaacuuaccuguccagccgcgcaaaacuagcccucgacaacaucgugaugcugcacacuacagagcguggugggaaggcuuaccagcacgcucuuaaugagcuccccgaguccuuagagacgcugaugcuaguggcccugcugggcgccaugacggcggguaucuuucucuucuucaugcagggaaaggggaugggcaaacugagcaugggccugaucgcuauugccguugccuccgggcucuuauggguggcugaaauucaaccucaguggauugcugcgucgaucauucuggaguucuuccucaugguacugcuaguccccgagcccgagaagcagcgcacuccucaggacaaccagcucauauacgugauccugacuauccugacuaucaucgcccucguggccgcuaacgagaugggcuugaucgagaagacaaagaccgacuucggguucuaccaaguaaaagcagagaccacaauccuggacguggaccuccgcccagcgucagccuggacgcuguaugccgucgccaccacgauccugaccccuaugcuucggcacacgaucgagaacaccuccgcaaaccugucucuggcggccauugccaaccaggcagccguucucaugggccuggggaagggcuggccccugcaccgcauggaccugggcgugcccuuacucgcgaugggaugcuacucucaggugaacccaaccacccucacggccucuuuaguaauguugcucguucauuacgccaucauuggacccgggcugcaagccaaggcgacccgggaggcccaaaagcgcacugccgccggcaucaugaagaacccuacgguggauggcaucacggucaucgaucuggagcccaucucguaugacccgaaauucgagaagcagcuaggacaggugaugcugcugguguugugcgucggacaguuacugcucaugcggaccacgugggccuuuugcgaagugcugacccuggcgacggggcccauucucacccugugggagggcaacccagggcgcuucuggaacaccaccauagccguaucaaccgccaauaucuuccggggcuccuaccucgccggggccgggcuagcguucagccugaucaaaaacgcgcagacaccccgccgggguaccggaaccaugggcgagacucugggggagaaguggaagcgucagcucaacucgcucgaccguaaggaauuugaggaguacaagcgcagcggcauccuggaagucgaccggaccgaggcccgcuccgcuuugaaggacggcagcaagaucaaguacgccgugucgagggggacgaguaagauacgcuggauaguggagcggggcaugguaaaaccgaaggggaaagugguagaccugggcugcggccgcggcgggugguccuacuauauggcgacccugaaaaacgucaccgagguuaaaggauacacgaagggcgggcccggccacgaggagcccauccccauggcaaccuacgguuggaaccuugugaaacuucacagcggcguugauguguucuacaaaccgaccgagcaaguggacacgcugcucugcgacauuggugaguccagcuccaauccaacgaucgaggaggggcggacccugcgcguccugaagauggucgagccauggcuaucguccaagcccgaguuuugcaucaagguccucaauccguacaugccuaccgugaucgaggaauuggagaagcugcagagacggcauggcgggucccucgugagaugcccccugucuaggaacucuacacacgaaauguacugggucagcgggguguccggcaacaucgugagcuccgucaauacgaccagcaagauguugcucaaccgcuuuaccacccggcaccguaagcccacguacgagaaagaugccgaccugggugcgggcacucgguccgugagcaccgagacagaaaagccggacaugacgaucaucgggagacggcuccaacgccuccaggaggagcacaaggagaccuggcauuaugaucacgagaacccauaccggacaugggccuaccauggcuccuaugaggcccccagcacggggagcgccagcuccauggugaacggcgucguuaaacugcugaccaagccgugggacguuguccccauggugacccagcucgccaugaccgacaccacgccuuucggccagcagcgcguuuuuaaggagaaagucgacaccagaaccccucaaccgaaacccgggacccaaguggugaugacgaccacagccaacugguuguggacccugcucggccgcaagaagaacccccggcugugcacgcgcgaggaguucaucucuaagguccgguccaacgccgccauaggggccguguuccaggaggaacagggcuggaccuccgccagugaagccguuaacgacagccgcuucugggaguuagucgauaaggaacgggcgcuccaccaggaggggaagugcgagagcugcguguacaacaugaugggcaagcgggagaagaagcuaggcgaguucgggcgggcuaagggcucccgcgccaucugguacaugugguuaggggcucgcuuucucgaguucgaggcucugggcuuccugaacgaggaccacugguucgggcgggaaaacagcuggucugggguggagggcgaagggcuccaccgccugggcuauauccuggaggacaucgacaagaaggacggggaccucaucuacgcggacgacacggcggggugggacacccggauaacggaggacgaccugcucaaugaggaacuuaucaccgagcagaugacaccccaccauaagauacuggccaaggccauuuucaagcugacuuaccaaaacaaggucgugaaggugcucaggccuacccccaagggggcgguuauggacaucaucucgcggaaagaccagcgcggguccggucaggucgggacguacggucugaauacguucacgaacauggaggugcaacugauccgacagauggaggcggaggggguaauaacccgcgaugauaugcacaaccccaagggccucaaggagcgagucgagaaguggcugaaagagugcggcgucgaccggcugaagcggauggccaucaguggggacgacugcgucgugaagcccuuggacgagcgcuuuucaacgagcuuacuguuccucaacgacauggggaaagugcggaaggacaucccgcagugggagcccuccaagggcuggaagaacuggcaggaaguaccguucugcucucaccacuuccacaagauauuuaugaaggacgggcgcagucuuguggugcccugccguaaccaagacgagcugaucgggcgcgcgaggaucagccagggcgcggguuggucgcuccgugaaaccgcgugcuuagguaaggcguacgcccaaauguggagccugauguacuuccacaggcgcgaucuccgccuggccucaauggcuaucugcucagcgguucccaccgagugguucccgaccagccggacaacguggagcauccacgcccaccaccaauggaugacaaccgaggacaugcugaaaguguggaaccgcgucuggaucgaggacaaccccaacaugauugacaagacgcccguacacuccugggaggacaucccguaccucggaaaacgugaggaccuguggugugggucccuaaucggccucucaucccgcgcgaccugggccaagaacauccacaccgcuaucacgcaagugcggaaccugaucgggaaggaggaguacguagauuacaugccggcaaugcgccgguacagcgcccacuucgaauccgagggcguccuguga

SEQ ID NO: 26343 - RNA, 9867 nt, Artificial Sequence
  derived and/or modified CDS sequence (opt11) from DENV-4__KT026309__SS-prME
uccaccaucacccugcucugucugaucccaacugugauggccuuccaccucuccacucgcgauggggaaccguuaaugauagucgcuaagcacgaaagagggagacccuuguuguucaagaccaccgaaggcaucaacaagugcacucucaucgcgauggaccugggggaaaugugcgaagacaccgugaccuauaagugcccccugcucguuaacaccgagcccgaggauaucgauuguuggugcaauuuaacgaguaccugggugauguacggaaccugcacccaauccggugagcggcgccgggagaagaggagcguggcccugacgccccacuccggcaugggccucgagacccgcgccgaaacguggaugagcuccgagggcgccuggaagcacgcccagcgcguggagagcuggauccuccggaaccccggguucgcauuacuugccggguucauggccuacaugaucggccagacggggauccagcgaaccgucuucuucauccucaugaugcugguggcccccuccuacgggaugcggugcgucggcgucgggaaucgcgacuucgucgagggcguaagcgggggcgcgugggucgaccucguacuugagcauggcgggugcgugaccacgauggcccagggcaagccuacccuggacuucgagcucauuaagaccacugcgaaggagguagcccugcugcggaccuacugcaucgaagcaucgaucagcaacaucacgacggcgacccgcugcccgacgcagggggagcccuaccucaaggaggagcaggaccagcaguauaucugccgucgcgauaugguggaccggggcugggggaacggcugcggccuguucgggaagggcggggugguaaccugcgccaaguuuuccugccuuggcaaaaucacggggaaccucgugcagauugagaaccuggaauacaccguagucgugacugugcacaacggcgacacccacgccgucggaaacgacacgucaaaccacggggugaccgccaccaucaccccgcgaucccccagcgucgaggugcagcugccggauuacggcgaacucacuuuggacugcgagccgcggucggggauagacuucaacgagaugauccugaugaagaugaaaaccaagaccuggcucgugcacaagcagugguuccuggaccugccccuccccuggaccaccggcgccgacacccuugaaguccacuggaaccacaaggagcgcauggugacuuucaagguuccgcaugcgaagcggcaggacgugaccguucuggggagccaagaaggcgccaugcacuccgcccucgccggcgccacggagguagacagcggggacgggaaccacauguucgcggggcaucuuaaaugcaagguccgaauggagaaguugcgcaucaagggcaugagcuacacgaugugcaguggcaaguucuccaucgauaaggagauggccgagacccaacacggcaccaccguggugaaggucaaguacgagggcacgggugcgcccugcaaggugcccaucgagauccgggaugucaacaaggagaagguaguggggcgcaucaucuccucaacgccuuucgccgagaauacuaacuccgugaccaacaucgagcuugagccgcccuucggggauagcuacaucgucaucggcguuggcgacuccgcucugacucugcacugguuccggaaggggagcuccaucggaaagauguucgaguccaccuaccguggggcaaagcggauggcgauccucggcgaaacagccugggacuucggguccgugggcggccugcugaccagccucggaaaggccgugcaccaaguguucggcucgguauacaccaccauguuugggggagucagcuggauggugcgcauacugauuggacugcuggugcucuggaucgguaccaacucgcggaacacgagcauggcgaugagcugcauagcaguaggcgggaucacgcuauuccugggcuucaccgugcacgcugauaugggcugcgugguuagcugguccggcaaggaacucaaauguggauccgggaucuucgugauugacaacgugcacaccuggacugagcaguauaaguuccaaccugaaagccccgcccgccuagccucggcgauucugaacgcccauaaggagggugucugugguauccggagcacgacacgccucgagaacguaauguggaagcagaucaccaacgagcugaacuacgugcugugggagggcgggcaugaccucacugucguggccggcgacguaaagggaguccuguccaaggggaaacgcgcccuagccccgcccgugaacgaccucaaauacuccuggaagacuuggggcaaagcgaagaucuucaccccugagacccguaacuccacuuuucucguagacgguccggacacaagugaaugcccaaacgagcggcgcgccuggaacuuccuggaggucgaggacuauggcuucgggauguucacaaccaacauuuggaugaaguuccgggaaggcuccagcgaggugugugaccaccgccucauguccgccgcaaucaaagaucagaaggccgugcacgccgacaugggguacuggauagagagcuccaagaaccagaccuggcaaaucgagaaagccagccuaaucgaggugaagacgugucuauggcccaagacccacacccucugguccaacggggugcuggagagccagauguuaaucccuaaggccuacgccggcccgaucucccagcauaacuaccggcagggguacgcgacgcagaccgccggcccuuggcaccucgggaaacuggagauugacuucggcgagugcccagggacgacuguuaccguucaggaagacugcgaccaccgggggcccagccugcggaccacgaccgccuccggcaagcuagugacccaauggugcugccgcucuugcacaaugccgccccuccgauuccugggggaggacggcugcugguaugggauggagauucggccacucaacgagaaagaggagaacauggugaagucgcaggucuccgccggucacggcacgagcgagacauucuccauggggcugcugugcuuaacacucuucguggaggagugccugcgccggcgagucacacggaagcacaugauccucgugguaguaacgaccuuaugcgccaucauccuuggagggcucacguggauggaccugcugcgcgcguugaucaugcugggcgacaccaugucgggccggaugggagggcaaauccauuuagccaucauggccgucuucaagaugagccccggguacgugcucgggaucuuccugcgcaaguugacgagccgcgaaaccgcccucaugguuaucgggauggcaaugaccacagugcucuccaucccgcaugaucucauggaguucauagacggcaucagccucggacuaauccugcuaaagauggugacgcacuucgacaacacccaggucgggaccuuagcgcuggcucuaaccuucaucaaguccacgaugccucugguuauggccuggcgaaccaucauggccgugcuguucgucguaacccuuaucccacugugucggaccuccugccuucagaaacagucccacuggguggagaucacagcccugauccugggcgcgcaggccuuacccgucuaccuuaugacccugaugaagggggcuagcaagcgcaguuggccgcugaacgagggcaucauggccgugggccucgugucacugcugggauccgcccuccugaaaaacgacgucccccuggccggccccaugguggccgggggccuccugcuggccgccuacgugaugucaggguccagcgccgaccugucacuggaaaaagccgcuaacguccagugggacgagauggcugauaucaccgguagcagccccauuauagagguuaaacaggacgaggacgggaguuuuagcauucgggacguugaggagacaaacaugaucacccuguuaguuaaacuagcacuaaucaccguauccggccucuacccgcuggcgaucccaguaaccaugacccugugguauauguggcaggucaaaacacagaggucgggcgcucucugggacgugcccucccccgccgccgcccagaaggcgacccugacugaggggguauaccggaucaugcagaggggacuguuugggaagacccaagucgggguggggauacacaccgagggcgucuuccacacgauguggcacgucacccggggcagcgugaucugccacgaauccgguagguuagagccuagcugggccgaugugcggaaugacaugaucucguauggaggaggguggcgccugggcgacaagugggacaaggaggaggacguccaggugcuggcgaucgagccagggaagaacccaaagcacguacaaacaaagccuggccuuuucaagacccugacgggggagaucggcgccgucacucuggauuucaagccggggacuagcggguccccuaucauaaaccggaagggcaaggugaucgggcucuacggcaacgggguggucaccaagagcggcgacuacguguccgccaucacccaggcugagcgaauaggugagcccgacuaugagguggacgaagacaucuuucgcaagaagcggcugacuaucauggaccugcacccaggugccggaaaaacaaagcgcaucuugcccagcaucguccgggaggcucugaagcgccgguugcgcacccuuauccucgccccuacgcguguaguagcggccgagauggaggaggcauugagagggcuacccauacgauaccaaaccccggccgucaaaagugagcacacugggcgcgagaucguggacuuaaugugccaugccaccuuuaccacccgguuacuauccuccacccgcguccccaacuacaaccucauuguaauggacgaggcgcacuucaccgaucccagcagcguagccgcccggggguacaucagcacucgcgucgaaaugggcgaggccgcugcuguguuuaugacugccacacccccggggaccacggaccccuucccacagagcaacucccccaucgaagacauugaacgggagaucccggagcgaagcuggaacaccggcuucgacuggaucaccgauuaccaaggcaagaccgugugguucgucccuuccaucaaggccgggaacgacaucgccaacugccugcggaaguccggcaagaaggugauccagcugagccggaagacguucgauaccgaguacccaaagaccaagcucacugacugggacuucgugaucacaaccgacauuagcgaaaugggcgccaauuuccgggcgggccgcgucaucgacccccgccggugucugaagccugugauccugaccgacgggccggaacgcgugauucuugcuggccccaucccggucaccccggccagugccgcccagcggcgcggccggaucgggaggaaccccgcucaagaggacgaccaauacguauucuccggcgacccccugcggaacgaugaggaccacgcgcauuggacggaggccaagauguugcucgauaacaucuacacccccgaggggaucauaccgacccuauucgguccugagcgcgagaagacucaagccaucgacggcgaguuccggcugaggggcgaacagcggaagacguucguagagcucaugcgucgaggggaucucccgguauggcucucccacaagguggcgagcgccgggaucucguacaaggaccgcgaguggugcuuuacaggcgaacggaacaaccaaauccucgaggagaacauugagguggagaucuggacccgcgagggggagaagaagaaauugcggcccaaguggcuagacgcgcgcguuuacgccgacccgauggcucucaaggacuucaaggaguuugcgagcgguagaaaguccaucacauuggacauacugaccgagaucgccucgcucccgacguaccuauccagccgcgccaagcuggcccuggacaacaucgugaugcuacacacuaccgagaggggagggaaggccuaccagcacgcgcugaacgaguugcccgagucccuggagacccugaugcucguggcccugcugggcgccaugacggccgggaucuucuuauucuuuaugcagggcaaaggaaugggcaagcuguccaugggccugaucgcgaucgccgucgccagcggucuccuguggguggccgagauucagccgcaguggauagcggccaguaucauccuggaguucuuccucauggugcugcuggugcccgaaccugagaagcaacgcaccccucaggacaaccagcucaucuacguuauccucacgauccuuaccaucaucgcacucguagccgccaacgagaugggccugauagagaagacgaagaccgacuucggcuuuuaccaggucaaggccgagaccacgauccuggauguagaccuccgcccggcgagcgccuggacguuguacgcgguggccaccacuauucugacccccaugcuccggcacacgaucgagaauacguccgccaaccugucucuggcggcgaucgccaaccaggcugccguacuuaugggccuagggaaaggcuggccccugcaucgcauggacuuaggagugccccugcuggcgauggggugcuacucccaggucaacccgaccacucucacagccucacugguaaugcuacuggugcacuacgccaucaucggcccggggcugcaggccaaggccacccgggaggcccagaagcggacagcagccggcauaaugaagaacccuaccguggacgggaucacggucaucgaccuggaaccuaucuccuacgacccgaaguucgaaaaacaacuaggacaggugauguuacucgugcucuguguaggucaacuacugcuaaugcggacgaccugggccuucugugaggugcugacccuggcuacggggccuauacuaacacugugggagggcaaccccgggcguuucuggaacaccaccaucgccgugagcacggccaacaucuucaggggauccuaccuggccggagccgggcucgcguucagccugaucaagaacgcucaaaccccgcgacggggcacuggaacgaugggagaaacucugggggagaaguggaagcgacaguuaaacucccuggacagaaaggaguucgaggaguacaaaagaagcggcauucuggagguggaccggaccgaagcacguuccgcccugaaggauggcagcaaaaucaaguacgccguaucgaggggaacgagcaagauuagauggaucguggagcggggcaugguaaagccgaagggcaaagugguagaccugggaugcggccggggcgguugguccuacuacauggcgacccucaagaacgucaccgagguaaagggguauacgaagggugggcccgggcacgaggagcccauucccauggccaccuacggauggaaucugguuaagcuacauagcggcgucgacgucuucuacaagccgaccgaacagguugacacccugcuaugcgacauaggcgagucaucauccaacccuacaaucgaggaggggagaacccucaggguccugaagaugguggagccuuggcuguccucgaagcccgaguucuguaucaaggugcucaacccguacaugcccaccgugaucgaggagcucgagaaguugcagaggcggcacggcgggucccucguccgcugcccuuugagccggaacagcacccacgagauguacuggguaagcggggugucggguaauaucgugucaagcguuaacacgacgagcaaaaugcuguugaacagguucacgacgcggcaccgcaagcccacguacgagaaagacgccgacuuaggggccggcacccgguccguaagcaccgaaaccgagaagccggacaugaccaucauugggcgcaggcugcagcgccuccaggaggagcauaaagagaccuggcacuacgaccacgagaaccccuaccggaccugggcguaccauggcuccuacgaggcccccagcaccggguccgccuccuccaugguaaauggcguuguuaaguuacuuacgaagccgugggacguggucccgaugguaacccagcucgccaugaccgauaccacgcccuucggccagcaacgcgucuuuaaggagaaggucgacacgcggacgccucagccgaagccugggacucaggugguuaugacgaccacugccaacuggcuguggacccugcucggccgcaagaaaaacccccggcugugcacgcgcgaggaguucaucucgaaggucagaagcaaugcggcgaucggggccguguuccaagaggagcagggguggacgagcgccagugaggccguuaacgacagccgcuucugggagcuggucgacaaggaacgggcgcugcaccaggagggaaaaugcgaauccuguguguacaacaugaugggaaagagggagaagaaacuuggcgaguucgggcgggccaagggcagccgcgcuauaugguacauguggcugggggcccgcuuccucgaguucgaggcccugggcuuccugaacgaggaccauugguucggcagagagaacagcugguccggcguggagggcgaggggcuccaccgccugggcuacauccuugaggacaucgacaagaaggacggggaccucauuuacgcggacgacaccgccggaugggacacccggaucacagaggacgaccugcuuaacgaggaguugaucaccgagcaaaugacaccccaccacaagauccuggccaaggcuauuuucaagcugacuuaucagaacaaggucgugaagguucuccgcccgacccccaagggcgcgguaauggacaucauuagccguaaggaccaacgugggagcggccaaguggggacguacggccugaacaccuuuacuaacauggaggugcagcugauccggcagauggaggccgaaggagucaucaccagggacgacaugcacaaccccaaaggccugaaagagcggguggagaaauggcugaaagaaugcggcguggaccgccugaagcggauggccaucucaggagacgacuguguagugaagccccucgacgagcgcuucuccacgagccugcuauuccucaacgauaugggcaagguacgcaaggauauuccgcaaugggagcccuccaagggguggaagaacuggcaggagguacccuucugcagccaccacuuccacaaaaucuucaugaaggacggcagaucccuggucguucccugccgaaaccaggacgagcugaucggucgcgcccggaucagccagggggccggcugguccuugagagagaccgcgugccuggggaaggcguacgcucagauguggagccugauguacuuucaccggagagaucuccgccuggccuccauggccaucugcucggccgucccgaccgagugguuucccacuucccggaccaccuggagcauucacgcacaccaccaauggaugaccacggaagauaugcuuaaggucuggaaucgcguguggaucgaggacaaccccaacaugauagacaaaacgcccguccacuccugggaggacaucccguacuuggggaagcgggaggacuuauggugcgggucacugaucggccucucgucccgggcaacgugggcaaagaacauccauacggccaucacacaggugcgcaaccugaucgggaaagaggaguacgucgacuacaugcccgcgaugcgccgcuacucagcccacuucgaguccgagggcguccuauga

SEQ ID NO: 26344 - RNA, 9867 nt, Artificial Sequence
  derived and/or modified CDS sequence (opt11) from DENV-4__KF907503__SS-prME
agcaccaucacccuuuugugccugauccccacuguuauggccuuccaccugagcacccgcgauggcgaaccguuaaugaucguagccaagcaugagcggggccgcccgcugcuguucaagacuaccgagggcaucaacaagugcacccucauagcgauggacuugggggaaaugugcgaagacaccgugaccuacaagugcccgcugcucgugaacacagagcccgaggacaucgacugcuggugcaaccugacauccaccuggguaauguacgggaccugcacccagaguggcgagagacgacgggagaaacgcagcguggcgcuuacuccgcacuccggcauggguuuggagacccgggccgagaccuggaugagcucugagggggcauggaagcacgcccagagaguagagucauggaucuuacggaaccccggcuuugcacugcucgccggguuuauggccuacaugaucggccagaccgggauccagcgcaccguauucuucguguugaugaugcugguggcgccgagcuaugggaugagaugcgucgggguggggaaccgcgacuucguggagggcguuagcgggggcgcauggguagaccuugugcucgaacacggcgggugcguaaccaccauggcccagggcaagcccacccuggacuucgaguuaacaaagacgacugcuaaggagguggcccugcuacggaccuacuguaucgaagccaguaucucuaacaucaccacugccacccgcugcccgacccagggggagccguaccuaaaggaggagcaagaccagcaguacaucugccgacgcgacguggucgaccgcggaugggggaacggcugcggccuguucggaaagggcggggucgugacgugcgccaaauucuccugcagcggcaaaaucaccgggaaccugguccagaucgagaaccucgaauacacugugguggugacggugcacaauggcgacacgcacgccgucggcaacgacaccuccaaccauggggugacagcuaugaucacgccgcggucuccuuccgucgaggucaagcuacccgacuacggcgagcuaacccucgacugcgagccccggagcgguaucgacuuuaacgagaugauucugaugaaaaugaagaagaagacuuggcuggugcacaagcaaugguuuuuggaucugcccuuacccuggaccgcuggagcggacaccuccgaggugcacuggaacuacaaggagcggaugguaaccuucaaggugccgcacgccaagcggcaggacgugacgguccucgggagccaggagggcgccaugcacagcgcccuggcaggugcgacggagguggacuccggggacgggaaccacauguucgccgggcaucugaaaugcaaaguucgcauggagaagcuuaggauaaagggcaugagcuacaccauguguuccggcaaauucagcaucgacaaagagauggccgagacccaacacgggacgaccgucgugaagguuaaauaugagggcgccggggcccccugcaagguacccaucgagauccgggacgugaacaaggagaagguggucggacgcaucauuucgagcacgccccuggcugagaacaccaacuccgugacaaacaucgaacuggagccgccguuuggggauagcuacaucgugaucggugucggaaacucggcccucacccuucacugguuccggaaagggucauccaucggaaagauguucgaguccaccuaucgcggggccaagcguauggccaucuuaggggagaccgcgugggacuucgggucagugggcggcuuauucacgagccugggaaaggccgugcaccaggucuucggcucaguguauaccaccauguucgguggcgugaguuggaugauccgcauacugauuggguuccucguccuguggauuggcacgaauucgagaaacacgucaauggcuaugacuugcaucgccguaggcgggaucacccuguuccugggcuucaccgugcaggccgauauggggugcguugugucauggagcggcaaggagcucaagugcgggagcggcaucuucguggucgacaacgugcacacguggaccgagcaauauaaauuccagcccgaaucccccgcgcgccuggccagcgccauacugaacgcccauaaagacggugugugcgggauccggucuacuacacgacuggagaacgucauguggaagcaaaucacgaacgagcugaacuacguacugugggagggcgggcacgaccucaccguggucgccggcgacgugaagggaguucugaccaaggggaagcgggcacugaccccgccagucucggaccucaaguacuccuggaaaacgugggggaaggccaagauauucaccccugaggcucgaaacagcaccuuucugaucgacgguccagauaccagcgaaugcccgaacgagcggcgcgccuggaacagccuggagguggaagacuacggcuucgggauguucacgaccaauaucuggaugaaguuccgggagggguccucugaggugugcgaccaccgccucaugucggccgcgaucaaggaccagaaggccguccacgccgauaugggcuacuggaucgagucguccaagaaccagaccuggcagaucgagaaggcuagcuugaucgaggugaagaccugcuuauggcccaaaacucauacgcucugguccaacgggguucuggagagucagauguugauccccaaguccuacgcuggcccguuuagccagcacaauuaccggcaaggguacgcaacacagaccgugggccccuggcaccucgggaaacuggagauugacuucggcgaaugcccuggaaccaccgugaccauccaggaggacugcgaccacagggggcccucccucagaaccucuacugccuccggcaagcucguaacgcaguggugcugccgcuccugcacuaugccgccccugcgcuuccuaggggaggacgggugcugguacgggauggagauccggccccuuagcgagaaggaggagaacauggucaagucucaggugaccgccggccagggcaccagcgagaccuucucuauggggcugcugugucucacccuguucguugaggagugucugcgccggcgcgugacucggaagcacaugaucuuaguggucgugaucacccugugcgccaucauccugggcggcuugacguggauggaccugcugcgcgcgcucaucaugcugggagacaccaugagcggccggauugggggccagauccaccuggccaucauggccguguucaagaugucucccggguacguccucggcguguuucugagaaagcugaccagcagagagaccgcccucauggugauagggauggcgaugacgaccguccugaguaucccccacgaccuuauggagcucaucgaugggauuagccugggacugauccuccugaagaucguaacccaauucgacaacacucagguuggcacgcuggcgcucucacugaccuucaucaggucaacaaugccccugaucauggccuggcggacuaucauggcaguguuguucgucgugacgcugauuccccuaugccgcaccuccugccuucagaagcagagucacugggucgaaaucacggcccugauccugggugcacaggcgcuccccgucuaccugaugacccugaugaagggcgccucccggcggucauggccucucaaugagggcaucauggcggugggucuggucaguuugcucggcagcgcccuguugaagaaugaugugccccucgcuggcccgaugguugcaggcggccuucugcucgccgccuacgucaugagcggguccuccgccgaccugucccuggagaaggcggcgaacgugcagugggacgagauggcagacaucacaggcagcuccccuaucaucgaggucaaacaggacgaggacgggagcuucucaaucagagaugucgaggagaccaacaugaucacccucuuggugaagcuggcccuaauuacugugagcggcuuguacccgcuggcgauccccgucacgaugacacugugguacauguggcaggucaagacacagcgcucaggcgcgcucugggacgugcccagccccgccgcuacccaaaaggccgcccuguccgagggggucuacagaaucaugcagcgcggccucuucgggaagacccaagucggcguaggaauccauauggagggcgucuuccacacaauguggcacgugacgcgggguagcgugaucugccaugagaccggacgccuggagccgucgugggcggacguccggaacgacaugaucagcuacgguggcggcuggcgccugggagacaagugggacaaggaggaagauguucaggugcucgcuauagagcccgggaagaaccccaagcauguccagaccaagcccggccuguucaagacacugaccggggagaucggugcggugaccuuggacuucaagccgggaaccucggguagccccaucaucaaucgcaagggcaaggugaucgggcuguaugggaacggggucgugaccaaguccggggauuacgugagcgcuauuacccaggccgagcggaucggagagcccgacuacgagguugacgaggacauuuuccgcaagaagcggcugaccaucauggaccuccacccgggcgcugggaagaccaagcguauccuacccuccaucgugcgggaggcccugaagcgucggcugaggacgcucauccuggcacccacccggguggucgccgcugagauggaggaagcucugaggggguuaccaaucagguaccaaacgccggcgguuaagagcgaacauaccggccgcgagaucgucgaucugaugugccacgccacgagcacaacccggcugcucuccagcacccgcguccccaacuacaaccugaucguaauggaugaggcucacuucacugaccccuccagugucgcggcccgaggguacauauccacgcgcguagagaugggcgaggccgccgcaaucuucaugaccgccacgccuccgggggcgacugauccuuuuccucagagcaacuccccaauugaggacaucgagcgugagaucccggagcgcagcuggaacaccgguuucgacuggaucaccgauuaucagggcaagaccgugugguucguucccaguauaaaggccgguaacgacaucgccaacugcuuacgcaagagcggcaagaaggugauccaguugucgcgcaagaccuucgacacggaguaccccaagacuaagcuuaccgacugggacuucguugucacgaccgacaucucagagaugggggccaauuuccgagcgggccgggugaucgacccccgcaggugucugaagccggucauauuaacagacgggccugaacggguaauccuagccggccccauuccuguaaccccggccucugcagcccagcggcgcggccggauugggaggaacccggcacaagaagacgaucaauacguguuuucaggugacccccugaagaaugacgaagaccacgcccacuggacggaagcgaagaugcuccuggacaacaucuacacccccgagggcaucaucccgacccuguucggucccgagagagagaagacacaagccauagacggggaguuccgcuuacgaggugagcagcgcaagacuuucgucgagcugaugcggcguggagacuuaccaguguggcucucguacaagguggcuagcgccgggauuuccuacaaggacagggagugguguuucaccggcgagagaaacaaucagauccuggaggagaacauggaggucgagaucuggacccgggagggggagaagaagaagcugcgcccccgguggcucgacgcccgcguauacgcagacccgauggcauuaaaggacuucaaggaguucgcgagcggccggaaguccaucacccuugacauucucacugagaucgccagccugcccaccuaucugagcucaagggccaagcucgcgcucgacaauauagugaugcugcacaccaccgaacgcggcgggcgggccuaucagcacgcgcucaacgagcugcccgagagccuggagacccucaugcuggucgcucugcucggcgcuaugacggcuggcaucuuccuguuuuuuaugcagggcaaaggaaucggaaagcugucaaugggucucauuaucaucgccgucgcaucggggcuguuguggguggcggagauccaaccgcaauggaucgccgccuccaucauucucgaguuuuucuugaugguccuccucauacccgagcccgagaagcaacgcaccccccaagauaaccaacugaucuacgugaucuugacuaucuugaccauaaucgggcugaucgcggccaacgagauggggcucauagaaaagacgaagaccgacuucggcuuuuaccaggugaaaaccgagaccacgauccucgaugucgaucugcgacccgccagcgccuggacccuguacgccguagcgaccaccauccucacgcccaugcugcgccauaccaucgaaaacaccucggccaacuugagccucgcagcgaucgccaaccaggcagccguucuuauggggcugggcaaggguuggccccuacaccggauggaccugggggugccacugcucgccauggggugcuacagucaggugaacccgacuacacugaccgccagccuggugaugcucucgguacacuaugcgaucaucgggccaggcuugcaggcgaaggccacacgcgaggcccagaagcgcaccgccgcgggcaucaugaaaaaccccacgguggacggcaucaccgugaucgaccuggaacccaucagcuacgacccuaaguucgagaagcagcugggccaggugaugcugcuugugcugugugccgggcagcugcugcucaugcggaccaccugggccuucugcgagguguugacguuagccaccggccccauucucacccucugggagggcaaccccggccgguuuuggaauaccacaaucgccgucuccaccgcgaacaucuuccgugggagcuaccucgccggggccggcuuagccuuuucccugaucaagaaugcccagacgcccaggcgcgggaccggcacgaccggcgagacuuuaggagagaaauggaaacggcagcucaacucacuggacagaaaggaguucgaggaauacaagcggaguggcauacuggaaguggaccgcaccgaagccaagagcgcgcucaaggacggauccaagauaaagcacgccgucagcaggggcagcuccaagauucgcuggaucgucgaacgcgggauggucaagccaaagggcaagguggucgaccugggaugcggccgcggaggguggaguuacuacauggccacgcugaagaaugucaccgaggugaagggauacaccaagggaggccccgggcacgaagaacccauccccauggcgaccuacggcuggaaucucgugaagcuccauuccggcguagacgucuucuacaaaccgacugaacaggucgauacguuacucugcgacaucggagaaaguucaagcaaccccaccaucgaggagggcaggacacugcgggugcuuaagaugguggagccauggcuaucaagcaagcccgaguucugcaucaagguccuuaaccccuauaugcccacggugauagaggagcuggagaagcugcaacgcaagcacgggggcaaccuaguucggugcccccugucccgcaacucaacccacgaaauguacugggugucgggcgcgucugggaacaucguguccuccgucaacacgaccuccaaaaugcuucucaaccgguucacgacgcgccauaggaagcccaccuacgaaaaggacguggaccugggggccggcaccaggagcguguccaccgagacggagaaaccggacaugaccaucaucgguaggcgccugcagcgucuacaggaggagcacaaggagaccuggcacuaugaccaggaaaaccccuaccgcaccugggccuaucacggaucguacgaggcccccuccacgggcagcgcgagcaguauggucaacggcguggugaagcugcugaccaaaccgugggauguuauccccauggugacccagcucgccaugacggacacgaccccauucggucaacagcggguguuuaaggaaaaggucgauacucgcacgccgcagccgaagcccggcacucggauggugaugacuaccaccgccaacuggcugugggcccugcuugggaagaaaaagaacccacgauuaugcacgcgggaggaguucaucagcaaagugcgcaguaacgcagcgauaggcgcugucuuccaggaggagcagggguggacgagcgccucggaggccguuaacgacagucgguuuugggagcugguggauaaagagcgcgcgcuccaccaggaaggcaaaugugaguccugcgucuacaacaugauggggaagcgggaaaaaaaacugggggaguucggccgcgcgaaggggagccgcgccaucugguauauguggcugggcgcccgguuccucgaguucgaggcccugggguuccucaacgaggaccacugguucggccgcgagaacuccuggucgggcguggagggggagggccugcaucgccugggguacauccuggaggagaucgacaagaaggacggagaccugauguacgccgacgauaccgccggcugggauacccgaaucacggaggacgaccugcagaaugaggagcugaucaccgaacaaauggccccccaucacaagaucuuggccaaagccauuuucaaauugaccuaccagaacaagguggucaaggugcugcggccuacgccucgcggggcggugauggauaucauaucccggaaggaucagagaggaagcggccaggugggaacguacgggcucaacacuuucacaaauauggaaguccagcugauccgacagauggaggccgagggcgugaucacgcaagacgacaugcaaaauccgaagggccugaaagagcgcgucgagaaguggcucaaggagugcgggguagaucggcugaagcgcauggccaucuccggcgacgacugcguaguaaagccccuggacgagcgauucgggacuucucuacuauuuuugaaugauaugggcaaggugagaaaggacaucccgcaaugggagcccagcaagggcuggaaaaacuggcaggaaguacccuucugcagccaucacuuucacaagaucuucaugaaggacggccggagccuagucgugcccugucgcaaccaggaugagcugaucggcagagcgcgcaucagccaaggggcuggguggagccugcgggagacggcuugccucggcaaggcguaugcccagauguggucccugauguacuuccaccgccgcgaccugcgacucgcuagcauggccaucugcuccgcagugccgaccgagugguuccccacaagccgcaccacguggaguauccacgcgcaccaccaguggaugacaaccgaagacaugcugaagguuuggaaccgggucuggaucgaggacaacccaaauaugacugacaagacucccguacacagcugggaggauaucccguaccugggcaagcgcgaggaccucuggugugggucccugaucggccugagcucccgggccaccugggccaagaacauccacacugccaucacccagguccgcaaccucaucggcaaggaggaauacgucgacuacaugcccguaaugaaacgguacagcgcgcccuccgaaagcgaggggguccuguag

SEQ ID NO: 26345 - RNA, 9867 nt, Artificial Sequence
  derived and/or modified CDS sequence (opt11) from DENV-4__AY947539__SS-prME
ucaacuaugaccuuauuaugccuuaucccuaccgccauggccuuccaccucuccacccgcgacggggagccccucaugaucgucgccaggcacgaacgcgggcggccccuguuauucaagacuaccgagggcauuaacaaaugcacgcucaucgccauggaccuuggcgagaugugugaggacaccgucaccuacgagugcccucugcuggugaauacugagcccgaagacauagauuguuggugcaaccugaccagcgccuggguaauguacgggaccugcacucaguccggggagcgccggagggagaagcggagcgucgcucugacgccccacuccggcaugggccucgagacccgcgccgaaaccuggaugucguccgaaggggcguggaagcacgcccagcggguggagaguuggauccugcgcaaccccggauuugcgcugcucgccggguuuauggcguacaugaucggccagaccggaauacagcggaccguguucuucguucugaugaugcucguggccccuuccuacggcaugcgcugcgugggcgucggcaacagagacuuuguggaaggcgugagcggaggcgccuggguugaccucguucuggagcacggcgggugcgucacgaccauggcgcagggcaagccaacucuggauuucgaguuaauaaaaacaacggcaaaggaggucgcguuacugcgcaccuauugcaucgaggcaaguaucagcaacaucaccaccgccacgcggugccccacccagggggagcccuaccucaaggaggagcaggaccagcaguauaucugccgucgggacgugguagaccggggcugggggaacggcugcggccuguuugggaaggguggcguuguaacaugcgccaaguuuuccuguucggggaagaucaccgggaaccugguacagauagaaaaccucgaguacacgguugucgugacaguccacaacggcgacacccaugccgugggcaaugauauccccaaccacggggucaccgcgaccauuacgccccggagcccaagcguugaggugaagcugcccgacuacggugagcugacccucgacugcgaaccucgcuccgggauugacuucaacgagaugauccucaugaagaugaagaagaaaacuuggcugguccacaagcaaugguucuuggaccucccccugccaugggccgccggagccgacacgucggaagugcacuggaacuacaaggagcgcaugguuacuuucaaggucccccaugccaaacgccaggacgugacggugcucggaagccaagagggcgcgaugcacagcgcucuaaccggcgccaccgagguggacagcggggauggcaaccacauguuugccggccaccucaagugcaaggugaggauggagaagcuccggaucaagggcauguccuauacgaugugcucagguaaauucuccaucgacaaggagauggcugaaacccagcacggcacgaccguugucaagguuaaauacgagggggcuggagcgcccugcaagguaccgaucgagauacgcgacgucaauaaggagaaggugguuggccggaucauuagcuccacuccguucgccgaguacaccaauagcgucaccaacaucgaauuagagccgccauuuggggauuccuacauaguuaucggcgugggggacagcgcccugacgcugcacugguuccggaagggguccucgaucggcaaaauguuagaauccacguaucgcggggccaagcggauggcuauccugggcgagaccgccugggauuuugggagcgucgguggccuccugacuucccuggggaaggcugugcaccagguguucgggagcgucuacacuacgauguucgggggcguuuccuggauggugcggauccucaucggguuccuggucuuauggaucggaacgaacagccgcaacaccuccauggccaugaccugcaucgcagugggcgguaucacacucuuccucggcuucaccgugcacgccgacaccgggugugcggucagcugguccgguaaggagcuaaagugcgggagcggaauuuucgugauagacaacgugcacacuuggacggaacaguacaaguuccagcccgagucuccggcgcgccuggccagugcaauccuuaaugcucacgaggacggcguuugcgggauucgcagcaccacccggcuugagaacaucauguggaagcaaaucaccaacgaacugaacuacguucucugggagggcgggcacgauuugacggugguggccggcgacguuaagggcgugcugucaaaggggaaacgcgcccuggcgccgcccgugaacgacuugaaguacuccuggaagaccugggguaaagcgaagaucuucacccccgaggcgaagaacagcaccuuuuugaucgacgggccggauacgagcgagugucccaacgagagacgcgcauggaacuucuuggaaguggaggauuacggcuucgggauguucacaaccaacauauggaugaaguuccgcgagggcucgagcgaggucugcgaucaccggcugauguccgcggcgaucaaggaccagaaggccguacacgcggauaugggcuacuggaucgagagcuccaaaaaccagaccuggcagaucgagaaggccagcuugaucgaggucaagacgugccucuggcccaagacacauacccuaugguccaacgggguacucgagagccagaugcucauuccgaaggcguacgcgggccccuucucccagcacaacuaccggcagggguacgcuacgcaaacggucgggcccuggcaccucgggaaacuggagaucgacuucggagagugucccggcacuaccgugaccauccaggaagacugcgaucaccgagguccaagccuccggaccacgacggcuuccggcaagcuggugacucagugguguugucgcucuugcaccaugccgcccuugcgcuucuugggcgaggauggcugcugguacgggauggaaauccggccccugagcgagaaggaggagaacaugguuaagucccaggucagcgccggacaggguacgucugagacguucuccauggggcuucucugccugacccuguucguggaggaaugccuccgccgccgcgucacccggaagcacaugauccugguuguugugacgacucuuugcgcaauuauccucggcggccuuaccuggauggaccuacuccgcgcucugauuaugcugggcgacaccauguccggacggaugggagggcagauccacuuggccauaauggccguguucaagaugagcccagguuacguccuaggcauauuccugcguaaacuuacgucccgggagaccgcccuaaugguuaucgguauggccaugaccaccguucucagcaucccccacgaccucauggaguucaucgacggcaucucccugggccuaaucuuacugaagauggucacucacuucgacaacacucaggugggaaccuuagcgcuaucgcugacuuuuauccgcucaaccaugcccuugguaauggcuuggcguaccaucauggccguccuuuuuguggugacccuuaucccccugugccgcaccagcugccuacagaagcagucccacugggucgagauaacggcauugaucuuaggggcgcaggcccucccgguguaccuuaugaccuuaaugaaaggggccagcaagcguucguggcccuuaaacgagggcaucauggccguggggcuggucucuuugcucggcuccgccuugcugaaaaacgacguucccuuagcgggccccauggucgcagggggccugcugcuugccgccuaugucaugagcggguccagcgccgaccucagccucgagaaggccgcaaacguccagugggaugagauggccgauaucacaggcuccagcccgaucaucgaggugaagcaggacgaagaugggaguuucagcauccgcgacaucgaagagacgaacaugauaacucuccuggucaagcuggcucuaauaacuguguccggccucuacccacuagccauccccgucaccaugacucucugguacauguggcaggucaagacgcagcggagcggcgcccugugggacgugcccucaccggccgcggcccagaaggcgacccugaccgagggaguguaccgcaucaugcagagaggcuuauucgggaaaacccaggucggcguagguauccacauggaagguguguuccacacgauguggcaugucacgagaggcuccgugaucugccacgagaccggaaggcuggagcccaguugggcggacgugcgcaacgauaugauaucuuauggcgggggcuggcggcugggcgauaaaugggacaaggaagaagacguccaggugcuagccaucgagccggggaagaaccccaagcacgugcaaacgaagccgggccuuuucaagacccucacgggggaaaucggcgcugucacgcucgacuuuaagcccgggaccagcgggagcccuaucaucaaccggaaggggaaggugauaggccuguacggaaacgggguugucacuaaguccggggacuacgugucggccaucacccaggcggagcgcaccggggagccugacuacgagguggacgaagacaucuuccgcaagaagcgccugaccaucauggaccuccacccaggcgcaggcaagaccaaaagaauccuccccucuauuguccgugaagcccucaagcgccggcuccggacucucauacuggcacccacccgcgugguggcggcggaaauggaggaggcccugcgggggcugccgauacgcuaccagacuccagcggucaagagcgagcauaccgguagggagaucguggaccugaugugccacgccacguucaccacacgccuucucuccagcacccggguacccaacuacaaucugaucgucauggacgaggcccacuucacugaccccucaaguguggccgcucgcggguacaucucuacucggguggagaugggggaagccgccgccauauuuaugaccgcuacacccccaggcgccacggauccauucccccagucaaacagccccauugaagacauugagcgcgaaaucccugagagguccuggaacaccgguuucgacuggaucaccgacuaccagggcaagacugucugguuugucccauccaucaaggcugggaaugacaucgccaacuguuugcgcaaguccgguaagaaagucauccagcucagccggaagacauucgauaccgaguacccaaagacgaagcucaccgacugggauuucgucgucacgaccgacaucuccgagaugggggcgaacuucagggcgggccgugucauugacccgcggcgcugucugaagcccguuaucagcaccgacgggccagagcgggugaucuuggccggccccaucccugucacccccgccuccgccgcccagcgacggggccgcaucgggcgaaaccccgcgcaggaagacgaccaguacgucuuuagcggggacccccuaaagaacgacgaggaucacgcccacuggacggaagccaagauguugcuugacaacaucuacacuccggaggggaucaucccuaccuuauucggaccugagcgcgaaaagaaccaggcgaucgacggugaguuccggcugagaggugagcagcggaaaacauucguggagcugaugcgccggggcgaccugcccgucuggcuauccuauaagguggccucggccgguaucucguauaaggaccgcgaguggugcuucacgggcgagcggaacaaccagauccucgaagagaacauggagguggagauauggacgcgcgagggggaaaagaagaagcugcgaccgaaguggcuggacgcccgcgucuaugccgaccccauggcccucaaagacuucaaggaguucgcuuccggccgcaagagcaucacccuugauauccuuaccgagauagccagucucccuacauaccugucuucucgggcuaagcuggcccucgauaauauagucaugcugcauacuaccgaaagaggagggaaggcguaccagcacgcccugaacgagcucccugaaucccuugaaacgcugaugcuuguagcccuguugggcgccaugaccgccgggaucuucuuguucuucaugcagggcaaggggauaggcaaguugagcaugggcuuaaucgcuaucgccguggccucaggguugcuuuggguggcggagauucagccacaguggaucgccgcuuccaucauacuggaguucuuccucauggugcuguuaauccccgagcccgagaaacagaggaccccgcaggacaaucaauuaaucuacgucaucuuaaccauccugaccaucaucggauuaaucgccgccaacgagauggggcugaucgagaagaccaagaccgacuucggcuuuuaccaagugaaaacagaaacgacaauccuggacguggacuuacgcccugccuccgccuggacgcuguacgcuguggcuaccacgauccuuacacccaugcuccggcacacgauagagaacaccagugccaaccuaagccucgccgcgaucgcgaaccaggccgccgugcucauggggcugggcaagggcuggccgcugcaucgcauggacuuagggguaccgcuguuagccaugggcugcuacucccaggucaaucccaccacccucaucgccucucuggugaugcuguuaguucacuacgccaucaucggacccgguuuacaagccaaggccacgcgggaggcacaaaagcgcaccgcggccggcaucaugaaaaacccgacugucgacgggaucaccgugaucgaccucgagccgaucagcuacgaccccaaauucgagaagcagcucggccaggugaugcugcugguccuuugcgcggggcagcugcugcucaugcggacuacaugggccuucugcgaagugcucacccuagccaccggacccguccucacgcugugggaggggaaccccggccgcuucuggaacaccaccauugcggucucgacggccaacauuuuccggggaaguuaucuggccggcgccggccucgccuucagccugaucaagaacgcucagacgccgcgccgagggaccggcacuaccggggagacgcuuggggaaaaguggaagaggcagcucaacucucuggaccggaaggaguucgaagaguacaaacgcucuggcauccucgagguggaucggaccgaggcgaaguccgcucucaaggauggcucaaagauuaagcacgccgugucccgcgguagcucaaagauccgguggauugucgagcgcgggauggugaagcccaaggggaaggugguagacuuaggguguggccggggcggguggagcuacuacauggcuacccugaagaacgugacugaagugaagggcuacacuaaaggagggcccgggcacgaagaacccaucccuauggccaccuacggcuggaaccucgugaagcugcacucgggggucgauguguucuacaaacccacggagcaggucgacaccuuacucugugacaucggggaaagcagcuccaacccaaccaucgaggagggccgcacacugcgggugcuaaagaugguggaacccuggcuaagcaguaagccggaguucugcauuaaggugcugaaccccuacaugcccaccgugaucgaagaguuagagaagcuccagcgcaaacacggcggcagccuugugagaugcccucugucccggaacaguacccacgagauguauugggugucuggcgugagcgggaacauagucucgagcgugaacaccacgucuaaaaugcuccucaauagauucaccacccggcaucgcaagcccaccuacgaaaaggaugucgaccugggcgccggaacgcggucgguauccaccgagaccgagaagccggacaugacaauaaucggccgccggcugcagcgccuccaggaggagcacaaggagacguggcacuacgaccaggaaaauccguaccggacgugggccuaccacgggagcuacgaagcgccguccaccggcagcgcgagcucuauggugaacggcguggucaagcuccuuaccaagcccugggacgucauucccauggugacgcagcucgccaugaccgauaccacccccuuugggcaacagagaguguuuaaggagaagguggacacccgcacaccccagccgaagccaggcacccgaauggugaugacgacgaccgccaacuggcugugggcccugcucggaaagaaaaagaaccccagacugugcacacgcgaggaguucauuuccaaggucaggagcaacgccgcgaucggcgcgguguuccaggaggaacaaggguggacuagcgccucugaggccgucaacgacagccgcuucugggaacuggucgacaaggagcgggcacuccaucaggagggcaagugcgagucuugcguguauaauaugaugggcaagcgcgagaaaaagcuaggggaguucggccgggcaaaggggucuagggcuaucugguacaugugguuaggagcgagauuccucgaguucgaggccuuaggcuuccugaaugaagaccauugguucggccgcgagaacuccuggagcggcguggagggugagggcuugcacagacugggguacauauuggaggacauugauaagaaagacggcgaccucaucuaugcggacgacaccgccggcugggacacucggauaacggaagaugacuuacugaaugaggagcucaucacugagcaaauggcaccccaccauaagauacuggccaaagcuaucuucaagcugacguaccagaacaaggucgucaagguccuccgcccgacccccaagggagccguaauggacaucauauccagaaaggaccagcgggguaguggccaagugggcaccuacgggcugaauacauuuacgaacauggaaguacaacugauccggcaaauggaagcagaaggggucaucacccaggaugacaugcacaaccccaaagggcucaaggaacgcguagagaaauggcugaaggagugcggcguugaucggcugaagcgcauggcuaucuccggcgacgauugcgucgugaagccucucgacgagcgguucagcaccucccuucuguucuuaaacgacauggggaaggugcgcaaggauauaccccagugggagccauccaaaggauggaagaacuggcaggaggugcccuucugcagccaccacuuccacaagaucuuuaugaaggacgggaggagccugguggugccgugucgcaaccaggacgaguuaaucggccgggcgagaauaagucaaggcgccggguggucacuacgagaaacggcgugccucggcaaggcuuacgcccagauguggucccugauguacuuccacagacgagaccuccgccuggccagcauggccaucugcagugcgguucccacagaaugguucccgaccucacgcacgaccuggagcauccacgcacaccaccaauggaugaccaccgaggacauguugaagguguggaaccgcguguggauugaggacaaucccaacaugaccgacaagaccccgguacacuccugggaggauauccccuaccucgggaagagagaggaucuaugguguggcagccugaucgggcuuuccagucgggccaccugggccaagaacauucacacggcuauaacacaggugcgcaaucugaucgggaaggaggaguacguugacuacaugcccguaaugaaacgguacuccgccccauuugagagcgagggcguguuauga

SEQ ID NO: 26346 - protein, 443 aa, Artificial Sequence
  derived and/or modified protein sequence (wt) from DENV-1 CYD23__SSm-EdelTM
MTQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGS

SEQ ID NO: 26347 - RNA, 1332 nt, Artificial Sequence
  derived and/or modified CDS sequence (wt) from DENV-1 CYD23__SSm-EdelTM
augacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuacuauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagauuaaagauggacaaacugacucuaaaagggaugucauaugugauguguacaggcucauucaagcuagagaaagaaguggcugagacccagcauggaaccguucuagugcagauuaaauacgaaggaacagaugcaccaugcaagaucccuuuuucgacccaagaugaaaaaggaguaacccaaaaugggagauugauaacagccaacccuauagucacugacaaagaaaaaccagucaacauugaggcagaaccgccuuuuggugagaguuacaucgugauaggagcaggugaaaaagcuuuaaaacuaagcugguucaagaaagggagcagcauagggaaaauguuugaggcaacugccagaggagcacgaaggauggccauacugggagacacugcaugggacuuugguucuuga

SEQ ID NO: 26348 - RNA, 1332 nt, Artificial Sequence
  derived and/or modified CDS sequence (opt1) from DENV-1 CYD23__SSm-EdelTM
augacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccuga

SEQ ID NO: 26349 - RNA, 1332 nt, Artificial Sequence
  derived and/or modified CDS sequence (opt1) from DENV-1 CYD23__SSm-EdelTM
augacccagaagggcaucaucuucauccugcucaugcuggugacccccagcauggccaugcgcugcgucgggaucggcucccgggacuucguggaggggcugagcggcgccacguggguggacgucgugcucgagcacggguccugcgugaccaccauggcgaaggacaagccgacccuggacaucgagcugcucaagacggaggucaccaaccccgccgugcugcgcaagcugugcaucgaggccaagaucagcaacaccaccacggacucccggugccccacccagggcgaggccacccucguggaggagcaggacgccaacuucgucugccgccggaccuucguggaccgcggcugggggaacggcugcgggcuguucggcaaggggagccugaucacgugcgcgaaguucaagugcgugaccaagcucgagggcaagaucguccaguacgagaaccugaaguacuccgugaucgugaccguccacaccggcgaccagcaccagguggggaacgagagcacggagcacggcaccaccgccaccaucacgccccaggccccgaccaccgagauccagcugaccgacuacggggcccucacgcuggacugcagcccccggaccggccuggacuucaacgagauggugcuccugaccaugaaggagaaguccuggcugguccacaagcagugguuccucgaccugccccugcccuggaccuccggcgcgagcacgucccaggagaccuggaaccgccaggaccuccuggugaccuucaagaccgcccacgccaagaagcaggagguggucgugcuggggagccaggagggcgccaugcacacggcccucaccggggcgaccgagauccagaccuccggcacgaccaccaucuucgccgggcaccugaagugccggcugaagauggacaagcucacccugaagggcaugagcuacgugaugugcaccggcuccuucaagcuggagaaggaggucgccgagacgcagcacgggaccgugcucguccagaucaaguacgagggcaccgacgccccgugcaagauccccuucagcacccaggacgagaagggggugacgcagaacggccgccugaucaccgccaaccccaucgugaccgacaaggagaagcccgucaacaucgaggcggagccgcccuucggggaguccuacaucgugaucggcgccggcgagaaggcccugaagcucagcugguucaagaaggggagcuccaucggcaagauguucgaggccaccgcccgcggggcgcggcggauggccauccugggcgacacggccugggacuucgggagcuga

SEQ ID NO: 26350 - RNA, 1332 nt, Artificial Sequence
  derived and/or modified CDS sequence (opt2) from DENV-1 CYD23__SSm-EdelTM
augacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccuga

SEQ ID NO: 26351 - RNA, 1332 nt, Artificial Sequence
  derived and/or modified CDS sequence (opt3) from DENV-1 CYD23__SSm-EdelTM
augacccagaagggcaucauuuucauacugcucaugcuugugacacccagcauggccaugagaugcgucgggaucggauccagggacuuuguugagggucugucuggcgcuacuuggguggauguaguguuggaacacgggucaugugucacgaccauggcaaaagacaagccuacauuagauauugagcugcuaaaaacugaagugaccaacccagccguucuccggaagcugugcaucgaggcgaaaauuaguaauacaaccacugacagccgcuguccgacacaaggagaagcuacccuuguggaggagcaggaugccaacuucgucugccgacguacguuuguggacagaggcugggguaauggguguggacuguucggcaagggcuccuugaucacuugcgcaaaguuuaaauguguaaccaagcucgaagggaaaauaguucaguacgagaaccugaaguauucugugaucgucacagugcauacuggagaucagcaccaaguggguaaugaaucgaccgagcauggcacaaccgccacgauuacuccccaggcuccuacaaccgagauccagcugacugacuacggggcacucacauuagauugcucaccaaggaccggacuggacuucaacgaaaugguccuuuugacgaugaaagaaaagagcuggcugguucacaagcagugguuucuagaucucccccugccuuggaccaguggcgccuccacaucucaagagacuuggaaucggcaggaccuucuggugaccuucaaaacagcucaugccaagaaacaggagguaguggucuuggguagccaggaaggggcgaugcacacugcacucaccggagccacagagauucaaaccuccggcacuacgacaaucuuugcuggccaccugaagugucgcuuaaaaauggauaagcugacccucaaagggaugucauaugugaugugcacuggaaguuucaaacuugagaaggaaguugccgagacccagcaugguacagugcugguccagauaaaguacgaaggcaccgacgcaccauguaagauucccuuuagcacucaagacgagaaaggggugacacagaacggaagauugaucacggcuaauccuauuguaaccgauaaggaaaaaccaguuaacaucgaggccgagccgcccuucggcgaaucuuauaucgugauuggugcgggggagaaggcccuaaagcuguccugguuuaaaaagggcucaagcauaggaaaaauguucgaagcaacugcuaggggcgcccggcgcauggcuauccucggggacacagccugggauuucggaaguuga

SEQ ID NO: 26352 - RNA, 1332 nt, Artificial Sequence
  derived and/or modified CDS sequence (opt4) from DENV-1 CYD23__SSm-EdelTM
augacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcuga

SEQ ID NO: 26353 - RNA, 1332 nt, Artificial Sequence
  derived and/or modified CDS sequence (opt5) from DENV-1 CYD23__SSm-EdelTM
augacccagaagggcaucauuuucauccugcucaugcuggugacacccagcauggccaugagaugcgucgggauuggaucccgggacuuuguugagggccuuucuggggcuacguggguggaugugguccuggaacacggaagcugugugaccacaauggccaaagacaagccuacccucgauaucgagcugcuuaaaacagaaguuaccaacccggcggugcugcgcaagcucugcauugaggcuaaaaucuccaauacaaccacggacucuagaugucccacccaaggcgaagccacacuggucgaggagcaggaugccaacuucgugugccggcgcaccuuuguugacagaggguggggaaauggcuguggccuguucgggaagggaagccucaucacaugcgcuaaguuuaaaugugugaccaagcuggaaggcaaaauuguccaguacgagaaccuuaaguauuccgugaucgugacgguccauacaggggaucagcaccaaguuggaaaugaaucuaccgagcauggcacaaccgccaccauuacaccucaggcucccacgaccgagauccagcugacagacuacggggcccucacccuggauugcagcccucggacaggacuugacuucaacgaaauggugcugcucaccaugaaagagaaguccuggcuggugcacaagcagugguuucuggaucucccccugccuuggacgagcggcgcgucuacaucccaagaaaccuggaaucgccaggaccuucuggucaccuucaaaacagcccaugcuaagaaacaggaggugguugugcucggcagccaggaaggggccaugcacaccgcucugacaggagccacggagauucaaaccucuggcacaaccacaaucuuugcggggcaccuuaaguguagacugaaaauggauaagcucacccugaaaggaauguccuaugucaugugcacgggcagcuucaagcuggagaaggaaguggccgagacccagcaugggacaguucucgugcagauuaaauacgaaggaaccgacgcuccguguaagauccccuuuucuacacaagacgagaaaggcgucacccagaacggccggcugaucacggccaauccuauugugacagauaaggaaaaacccgucaacaucgaggcugagccucccuucggggaauccuauauugugaucggagccggcgagaaggcccuuaagcugagcugguuuaaaaagggguccucuauuggaaaaauguucgaagcuaccgcgcgcggcgccagacggauggcuauccucggggacacagccugggauuucggcagcuga

SEQ ID NO: 26354 - RNA, 1332 nt, Artificial Sequence
  derived and/or modified CDS sequence (opt6) from DENV-1 CYD23__SSm-EdelTM
augacgcaaaaaggaauaauauuuauuuugcucaugcuuguaacaccaagcauggcaaugcgcuguguaggaauaggaaguagagacuucguagaaggauuaaguggagcaacauggguagauguaguauuagaacacggaaguuguguaacaacaauggcaaaagauaaaccaacccuagacauagaauuauuaaaaacagaaguaacuaacccagcaguauugagaaaacuuuguauugaagcaaaaauaaguaacacaacaacagacaguagauguccuacacagggagaagcaacauuaguugaagaacaagaugccaauuuuguaugcagaaggacauuuguagacagaggauggggaaauggaugcggauuauuuggaaaagguagucuaauaacaugugcuaaauucaaaugcguaacaaaauuagaaggaaaaauaguccaauaugaaaacuugaaguauaguguaauaguaacuguacauacaggggaucaacaucaaguaggaaacgaaaguacagaacacgguacaacagcaacaauaacaccacaagcuccaacgacagaaauacaauuaacagauuauggagcauuaaccuuagauuguagucccagaacaggacuagauuuuaaugagaugguacuauuaacaaugaaagaaaaaucaugguuaguccauaaacaaugguuucuagaucuaccacucccauggacaagcggagccucaacaucacaagagacauggaauagacaagauuuacuaguuacauucaaaacagcacacgcuaaaaaacaagaaguaguaguguuaggaagccaagaaggugcaaugcauaccgcgcuaacaggagcaacagaaauacaaacuucaggaacuacaaccauauuugcaggacacuuaaaauguagauuaaaaauggauaaauuaacacuaaaaggcaugaguuacguaauguguacaggaucauucaaacuagaaaaagaaguagcugaaacacaacaugguacaguuuuaguacaaaucaaauacgaaggaacagaugcaccaugcaaaauaccuuucaguacacaagaugaaaaaggaguaacacaaaauggaagacuaauaacagcaaauccaauaguaacagauaaagaaaaaccaguuaauauagaagcagaaccaccauucggagaaucauauauaguuauuggagcaggagaaaaagcauuaaaauuauccugguuuaaaaaagguucuaguauaggaaaaauguuugaagcaacagcaagaggcgcaagaagaauggcaauacuaggagacacagcaugggauuuuggaaguuaa

SEQ ID NO: 26355 - RNA, 1332 nt, Artificial Sequence
  derived and/or modified CDS sequence (opt11) from DENV-1 CYD23__SSm-EdelTM
augacccaaaaaggcaucaucuucauccuccucaugcucgucacccccagcauggccaugcgcugcgucggcaucggaucccgcgauuucguagaaggacuaucaggcgcaaccuggguagacguaguccucgaacacggcagcugcgucaccaccauggccaaagacaaaccaacccucgacaucgaacuccucaaaacagaagugaccaaccccgccguacugcgcaaacuuugcaucgaagccaaaauaucaaacaccacaacagacucacgaugcccaacccaaggcgaagccacacucgucgaagaacaagacgccaacuucgucugccgccguacauucguagaccgaggcuggggaaacggcugcggacuuuucggcaaaggcagccucauaacuugcgccaaauucaaaugcgucacaaaacucgaaggcaaaaucguacaauacgaaaaccucaaauacuccguaaucgucaccguacacaccggagaccagcaccaaguaggaaacgaaaguacagaacacggcaccacagccaccaucaccccacaagcacccaccaccgaaauacaacucaccgacuacggcgcccucacucuugacugcucaccccgcaccggucucgacuucaacgaaauggugcuccuaacaaugaaagaaaaguccuggcucguccacaaacaaugguuucuagaccucccacuccccuggacaagcggggccagcaccucccaagaaacauggaaccgacaagaccuacucgucaccuucaaaaccgcccacgccaagaaacaggaagucgucguacuaggaucccaggagggcgcaaugcacacggcccugacaggagcaaccgaaauucaaacguccggcaccaccaccauauucgccggccaccucaaaugccgccucaaaauggacaaacucacccuaaaaggaaugagcuacgucaugugcaccggauccuucaaacucgagaaagaaguagccgaaacccaacacggaaccguacucguccaaaucaaauacgaaggcaccgacgcacccugcaaaauccccuucuccacccaagacgaaaaaggagucacccaaaacggcagacuaauaaccgcaaaccccauuguaacagacaaagagaaacccgucaacauagaagccgaacccccauucggagaaagcuacaucgucauaggagcgggagaaaaagcccugaaacucucaugguucaaaaagggcagcuccaucggcaaaauguucgaagcaaccgcacgcggagcccgaagaauggcaauccuaggagacaccgccugggacuucggaagcuaa

SEQ ID NO: 26356 - RNA, 1549 nt, Artificial Sequence
  mRNA product Design1 comprising derived and/or modified sequence from DENV-1 CYD23__SSm-EdelTM (CDS opt1)
gggagaaagcuuaccaugacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 26357 - RNA, 1714 nt, Artificial Sequence
  mRNA product Design2 comprising derived and/or modified sequence from DENV-1 CYD23__SSm-EdelTM (CDS opt1) R3543/R3544
ggggcgcugccuacggagguggcagccaucuccuucucggcaucaagcuuaccaugacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 26358 - protein, 14 aa, Artificial Sequence
  carrier peptide 1
CRRRRRRRRRRRRC

SEQ ID NO: 26359 - protein, 13 aa, Artificial Sequence
  carrier peptide 2
CRRRRRRRRRRRR

SEQ ID NO: 26360 - protein, 14 aa, Artificial Sequence
  carrier peptide 3
WRRRRRRRRRRRRC

SEQ ID NO: 26361 - protein, 18 aa, Artificial Sequence
  carrier peptide 4
CHHHHHHRRRRHHHHHHC
